United States Patent 9,149,506 (MODIFIED POLYNUCLEOTIDES ENCODING SEPTIN-4) - sequence listing, part 7

SEQ ID NO: 9620 - DNA, 5592 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9621 - DNA, 2139 bp, Artificial Sequence
  Description of Artificial Sequence: Synthetic coding sequence
atgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9622 - DNA, 5655 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggacagccacatccacggccagagaaacaacagcatgttcagcaagagacccagagagcacatcagcgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9623 - DNA, 192 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtag

SEQ ID NO: 9624 - DNA, 192 bp, Artificial Sequence; identical to SEQ ID NO: 9623
  Description of Artificial Sequence: Synthetic coding sequence

SEQ ID NO: 9625 - DNA, 2100 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccggctgcccccccaactgcggctgcgccgccagatgcctggacagaggccagtggctgccctgcaactgggccgacgtgtag

SEQ ID NO: 9626 - DNA, 1950 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagtag

SEQ ID NO: 9627 - DNA, 5658 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggacagccacatccacggccagagaaacaacagcatgttcagcaagagacccagagagcacatcagcgccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9628 - DNA, 669 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaagtag

SEQ ID NO: 9629 - DNA, 1869 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgagtag

SEQ ID NO: 9630 - DNA, 1872 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagtag

SEQ ID NO: 9631 - DNA, 1497 bp, Artificial Sequence
  Description of Artificial Sequence: Synthetic coding sequence
gagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctggagaccagcctgagcgtgcagctgagcaacctgggcaccgtgagaaccctgagaaccaagcagagaatccagccccagaagaccagcgtgtacatcgagctggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagtag

SEQ ID NO: 9632 - DNA, 297 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatctag

SEQ ID NO: 9633 - DNA, 2280 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9634 - DNA, 180 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaaggtgctgctgtgctgccccagctggagcaccgtggtgagaagctag

SEQ ID NO: 9635 - DNA, 5451 bp, Artificial Sequence
  Description of Artificial Sequence: Synthetic coding sequence
atgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9636 - DNA, 1719 bp, Artificial Sequence
  Description of Artificial Sequence: Synthetic coding sequence
atgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagctag

SEQ ID NO: 9637 - DNA, 1422 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaactag

SEQ ID NO: 9638 - DNA, 534 bp, Artificial Sequence
  Description of Artificial Sequence: Synthetic coding sequence
atgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaactag

SEQ ID NO: 9639 - DNA, 10257 bp, Artificial Sequence
  Description of Artificial Sequence: Synthetic coding sequence
atgcccatcggcagcaaggagagacccaccttcttcgagatcttcaagaccagatgcaacaaggccgacctgggccccatcagcctgaactggttcgaggagctgagcagcgaggcccccccctacaacagcgagcccgccgaggagagcgagcacaagaacaacaactacgagcccaacctgttcaagaccccccagagaaagcccagctacaaccagctggccagcacccccatcatcttcaaggagcagggcctgaccctgcccctgtaccagagccccgtgaaggagctggacaagttcaagctggacctgggcagaaacgtgcccaacagcagacacaagagcctgagaaccgtgaagaccaagatggaccaggccgacgacgtgagctgccccctgctgaacagctgcctgagcgagagccccgtggtgctgcagtgcacccacgtgaccccccagagagacaagagcgtggtgtgcggcagcctgttccacacccccaagttcgtgaagggcagacagacccccaagcacatcagcgagagcctgggcgccgaggtggaccccgacatgagctggagcagcagcctggccaccccccccaccctgagcagcaccgtgctgatcgtgagaaacgaggaggccagcgagaccgtgttcccccacgacaccaccgccaacgtgaagagctacttcagcaaccacgacgagagcctgaagaagaacgacagattcatcgccagcgtgaccgacagcgagaacaccaaccagagagaggccgccagccacggcttcggcaagaccagcggcaacagcttcaaggtgaacagctgcaaggaccacatcggcaagagcatgcccaacgtgctggaggacgaggtgtacgagaccgtggtggacaccagcgaggaggacagcttcagcctgtgcttcagcaagtgcagaaccaagaacctgcagaaggtgagaaccagcaagaccagaaagaagatcttccacgaggccaacgccgacgagtgcgagaagagcaagaaccaggtgaaggagaagtacagcttcgtgagcgaggtggagcccaacgacaccgaccccctggacagcaacgtggccaaccagaagcccttcgagagcggcagcgacaagatcagcaaggaggtggtgcccagcctggcctgcgagtggagccagctgaccctgagcggcctgaacggcgcccagatggagaagatccccctgctgcacatcagcagctgcgaccagaacatcagcgagaaggacctgctggacaccgagaacaagagaaagaaggacttcctgaccagcgagaacagcctgcccagaatcagcagcctgcccaagagcgagaagcccctgaacgaggagaccgtggtgaacaagagagacgaggagcagcacctggagagccacaccgactgcatcctggccgtgaagcaggccatcagcggcaccagccccgtggccagcagcttccagggcatcaagaagagcatcttcagaatcagagagagccccaaggagaccttcaacgccagcttcagcggccacatgaccgaccccaacttcaagaaggagaccgaggccagcgagagcggcctggagatccacaccgtgtgcagccagaaggaggacagcctgtgccccaacctgatcgacaacggcagctggcccgccaccaccacccagaacagcgtggccctgaagaacgccggcctgatcagcaccctgaagaagaagaccaacaagttcatctacgccatccacgacgagaccagctacaagggcaagaagatccccaaggaccagaagagcgagctgatcaactgcagcgcccagttcgaggccaacgccttcgaggcccccctgaccttcgccaacgccgacagcggcctgctgcacagcagcgtgaagagaagctgcagccagaacgacagcgaggagcccaccctgagcctgaccagcagcttcggcaccatcctgagaaagtgcagcagaaacgagacctgcagcaacaacaccgtgatcagccaggacctggactacaaggaggccaagtgcaacaaggagaagctgcagctgttcatcacccccgaggccgacagcctgagctgcctgcaggagggccagtgcgagaacgaccccaagagcaagaaggtgagcgacatcaaggaggaggtgctggccgccgcctgccaccccgtgcagcacagcaaggtggagtacagcgacaccgacttccagagccagaagagcctgctgtacgaccacgagaacgccagcaccctgatcctgacccccaccagcaaggacgtgctgagcaacctggtgatgatcagcagaggcaaggagagctacaagatgagcgacaagctgaagggcaacaactacgagagcgacgtggagctgaccaagaacatccccatggagaagaaccaggacgtgtgcgccctgaacgagaactacaagaacgtggagctgctgccccccgagaagtacatgagagtggccagccccagcagaaaggtgcagttcaaccagaacaccaacctgagagtgatccagaagaaccaggaggagaccaccagcatcagcaagatcaccgtgaaccccgacagcgaggagctgttcagcgacaacgagaacaacttcgtgttccaggtggccaacgagagaaacaacctggccctgggcaacaccaaggagctgcacgagaccgacctgacctgcgtgaacgagcccatcttcaagaacagcaccatggtgctgtacggcgacaccggcgacaagcaggccacccaggtgagcatcaagaaggacctggtgtacgtgctggccgaggagaacaagaacagcgtgaagcagcacatcaagatgaccctgggccaggacctgaagagcgacatcagcctgaacatcgacaagatccccgagaagaacaacgactacatgaacaagtgggccggcctgctgggccccatcagcaaccacagcttcggcggcagcttcagaaccgccagcaacaaggagatcaagctgagcgagcacaacatcaagaagagcaagatgttcttcaaggacatcgaggagcagtaccccaccagcctggcctgcgtggagatcgtgaacaccctggccctggacaaccagaagaagctgagcaagccccagagcatcaacaccgtgagcgcccacctgcagagcagcgtggtggtgagcgactgcaagaacagccacatcaccccccagatgctgttcagcaagcaggacttcaacagcaaccacaacctgacccccagccagaaggccgagatcaccgagctgagcaccatcctggaggagagcggcagccagttcgagttcacccagttcagaaagcccagctacatcctgcagaagagcaccttcgaggtgcccgagaaccagatgaccatcctgaagaccaccagcgaggagtgcagagacgccgacctgcacgtgatcatgaacgcccccagcatcggccaggtggacagcagcaagcagttcgagggcaccgtggagatcaagagaaagttcgccggcctgctgaagaacgactgcaacaagagcgccagcggctacctgaccgacgagaacgaggtgggcttcagaggcttctacagcgcccacggcaccaagctgaacgtgagcaccgaggccctgcagaaggccgtgaagctgttcagcgacatcgagaacatcagcgaggagaccagcgccgaggtgcaccccatcagcctgagcagcagcaagtgccacgacagcgtggtgagcatgttcaagatcgagaaccacaacgacaagaccgtgagcgagaagaacaacaagtgccagctgatcctgcagaacaacatcgagatgaccaccggcaccttcgtggaggagatcaccgagaactacaagagaaacaccgagaacgaggacaacaagtacaccgccgccagcagaaacagccacaacctggagttcgacggcagcgacagcagcaagaacgacaccgtgtgcatccacaaggacgagaccgacctgctgttcaccgaccagcacaacatctgcctgaagctgagcggccagttcatgaaggagggcaacacccagatcaaggaggacctgagcgacctgaccttcctggaggtggccaaggcccaggaggcctgccacggcaacaccagcaacaaggagcagctgaccgccaccaagaccgagcagaacatcaaggacttcgagaccagcgacaccttcttccagaccgccagcggcaagaacatcagcgtggccaaggagagcttcaacaagatcgtgaacttcttcgaccagaagcccgaggagctgcacaacttcagcctgaacagcgagctgcacagcgacatcagaaagaacaagatggacatcctgagctacgaggagaccgacatcgtgaagcacaagatcctgaaggagagcgtgcccgtgggcaccggcaaccagctggtgaccttccagggccagcccgagagagacgagaagatcaaggagcccaccctgctgggcttccacaccgccagcggcaagaaggtgaagatcgccaaggagagcctggacaaggtgaagaacctgttcgacgagaaggagcagggcaccagcgagatcaccagcttcagccaccagtgggccaagaccctgaagtacagagaggcctgcaaggacctggagctggcctgcgagaccatcgagatcaccgccgcccccaagtgcaaggagatgcagaacagcctgaacaacgacaagaacctggtgagcatcgagaccgtggtgccccccaagctgctgagcgacaacctgtgcagacagaccgagaacctgaagaccagcaagagcatcttcctgaaggtgaaggtgcacgagaacgtggagaaggagaccgccaagagccccgccacctgctacaccaaccagagcccctacagcgtgatcgagaacagcgccctggccttctacaccagctgcagcagaaagaccagcgtgagccagaccagcctgctggaggccaagaagtggctgagagagggcatcttcgacggccagcccgagagaatcaacaccgccgactacgtgggcaactacctgtacgagaacaacagcaacagcaccatcgccgagaacgacaagaaccacctgagcgagaagcaggacacctacctgagcaacagcagcatgagcaacagctacagctaccacagcgacgaggtgtacaacgacagcggctacctgagcaagaacaagctggacagcggcatcgagcccgtgctgaagaacgtggaggaccagaagaacaccagcttcagcaaggtgatcagcaacgtgaaggacgccaacgcctacccccagaccgtgaacgaggacatctgcgtggaggagctggtgaccagcagcagcccctgcaagaacaagaacgccgccatcaagctgagcatcagcaacagcaacaacttcgaggtgggcccccccgccttcagaatcgccagcggcaagatcgtgtgcgtgagccacgagaccatcaagaaggtgaaggacatcttcaccgacagcttcagcaaggtgatcaaggagaacaacgagaacaagagcaagatctgccagaccaagatcatggccggctgctacgaggccctggacgacagcgaggacatcctgcacaacagcctggacaacgacgagtgcagcacccacagccacaaggtgttcgccgacatccagagcgaggagatcctgcagcacaaccagaacatgagcggcctggagaaggtgagcaagatcagcccctgcgacgtgagcctggagaccagcgacatctgcaagtgcagcatcggcaagctgcacaagagcgtgagcagcgccaacacctgcggcatcttcagcaccgccagcggcaagagcgtgcaggtgagcgacgccagcctgcagaacgccagacaggtgttcagcgagatcgaggacagcaccaagcaggtgttcagcaaggtgctgttcaagagcaacgagcacagcgaccagctgaccagagaggagaacaccgccatcagaacccccgagcacctgatcagccagaagggcttcagctacaacgtggtgaacagcagcgccttcagcggcttcagcaccgccagcggcaagcaggtgagcatcctggagagcagcctgcacaaggtgaagggcgtgctggaggagttcgacctgatcagaaccgagcacagcctgcactacagccccaccagcagacagaacgtgagcaagatcctgcccagagtggacaagagaaaccccgagcactgcgtgaacagcgagatggagaagacctgcagcaaggagttcaagctgagcaacaacctgaacgtggagggcggcagcagcgagaacaaccacagcatcaaggtgagcccctacctgagccagttccagcaggacaagcagcagctggtgctgggcaccaaggtgagcctggtggagaacatccacgtgctgggcaaggagcaggccagccccaagaacgtgaagatggagatcggcaagaccgagaccttcagcgacgtgcccgtgaagaccaacatcgaggtgtgcagcacctacagcaaggacagcgagaactacttcgagaccgaggccgtggagatcgccaaggccttcatggaggacgacgagctgaccgacagcaagctgcccagccacgccacccacagcctgttcacctgccccgagaacgaggagatggtgctgagcaacagcagaatcggcaagagaagaggcgagcccctgatcctggtgggcgagcccagcatcaagagaaacctgctgaacgagttcgacagaatcatcgagaaccaggagaagagcctgaaggccagcaagagcacccccgacggcaccatcaaggacagaagactgttcatgcaccacgtgagcctggagcccatcacctgcgtgcccttcagaaccaccaaggagagacaggagatccagaaccccaacttcaccgcccccggccaggagttcctgagcaagagccacctgtacgagcacctgaccctggagaagagcagcagcaacctggccgtgagcggccaccccttctaccaggtgagcgccaccagaaacgagaagatgagacacctgatcaccaccggcagacccaccaaggtgttcgtgccccccttcaagaccaagagccacttccacagagtggagcagtgcgtgagaaacatcaacctggaggagaacagacagaagcagaacatcgacggccacggcagcgacgacagcaagaacaagatcaacgacaacgagatccaccagttcaacaagaacaacagcaaccaggccgtggccgtgaccttcaccaagtgcgaggaggagcccctggacctgatcaccagcctgcagaacgccagagacatccaggacatgagaatcaagaagaagcagagacagagagtgttcccccagcccggcagcctgtacctggccaagaccagcaccctgcccagaatcagcctgaaggccgccgtgggcggccaggtgcccagcgcctgcagccacaagcagctgtacacctacggcgtgagcaagcactgcatcaagatcaacagcaagaacgccgagagcttccagttccacaccgaggactacttcggcaaggagagcctgtggaccggcaagggcatccagctggccgacggcggctggctgatccccagcaacgacggcaaggccggcaaggaggagttctacagagccctgtgcgacacccccggcgtggaccccaagctgatcagcagaatctgggtgtacaaccactacagatggatcatctggaagctggccgccatggagtgcgccttccccaaggagttcgccaacagatgcctgagccccgagagagtgctgctgcagctgaagtacagatacgacaccgagatcgacagaagcagaagaagcgccatcaagaagatcatggagagagacgacaccgccgccaagaccctggtgctgtgcgtgagcgacatcatcagcctgagcgccaacatcagcgagaccagcagcaacaagaccagcagcgccgacacccagaaggtggccatcatcgagctgaccgacggctggtacgccgtgaaggcccagctggacccccccctgctggccgtgctgaagaacggcagactgaccgtgggccagaagatcatcctgcacggcgccgagctggtgggcagccccgacgcctgcacccccctggaggcccccgagagcctgatgctgaagatcagcgccaacagcaccagacccgccagatggtacaccaagctgggcttcttccccgaccccagacccttccccctgcccctgagcagcctgttcagcgacggcggcaacgtgggctgcgtggacgtgatcatccagagagcctaccccatccagtggatggagaagaccagcagcggcctgtacatcttcagaaacgagagagaggaggagaaggaggccgccaagtacgtggaggcccagcagaagagactggaggccctgttcaccaagatccaggaggagttcgaggagcacgaggagaacaccaccaagccctacctgcccagcagagccctgaccagacagcaggtgagagccctgcaggacggcgccgagctgtacgaggccgtgaagaacgccgccgaccccgcctacctggagggctacttcagcgaggagcagctgagagccctgaacaaccacagacagatgctgaacgacaagaagcaggcccagatccagctggagatcagaaaggccatggagagcgccgagcagaaggagcagggcctgagcagagacgtgaccaccgtgtggaagctgagaatcgtgagctacagcaagaaggagaaggacagcgtgatcctgagcatctggagacccagcagcgacctgtacagcctgctgaccgagggcaagagatacagaatctaccacctggccaccagcaagagcaagagcaagagcgagagagccaacatccagctggccgccaccaagaagacccagtaccagcagctgcccgtgagcgacgagatcctgttccagatctaccagcccagagagcccctgcacttcagcaagttcctggaccccgacttccagcccagctgcagcgaggtggacctgatcggcttcgtggtgagcgtggtgaagaagaccggcctggcccccttcgtgtacctgagcgacgagtgctacaacctgctggccatcaagttctggatcgacctgaacgaggacatcatcaagccccacatgctgatcgccgccagcaacctgcagtggagacccgagagcaagagcggcctgctgaccctgttcgccggcgacttcagcgtgttcagcgccagccccaaggagggccacttccaggagaccttcaacaagatgaagaacaccgtggagaacatcgacatcctgtgcaacgaggccgagaacaagctgatgcacatcctgcacgccaacgaccccaagtggagcacccccaccaaggactgcaccagcggcccctacaccgcccagatcatccccggcaccggcaacaagctgctgatgagcagccccaactgcgagatctactaccagagccccctgagcctgtgcatggccaagagaaagagcgtgagcacccccgtgagcgcccagatgaccagcaagagctgcaagggcgagaaggagatcgacgaccagaagaactgcaagaagagaagagccctggacttcctgagcagactgcccctgcccccccccgtgagccccatctgcaccttcgtgagccccgccgcccagaaggccttccagccccccagaagctgcggcaccaagtacgagacccccatcaagaagaaggagctgaacagcccccagatgacccccttcaagaagttcaacgagatcagcctgctggagagcaacagcatcgccgacgaggagctggccctgatcaacacccaggccctgctgagcggcagcaccggcgagaagcagttcatcagcgtgagcgagagcaccagaaccgcccccaccagcagcgaggactacctgagactgaagagaagatgcaccaccagcctgatcaaggagcaggagagcagccaggccagcaccgaggagtgcgagaagaacaagcaggacaccatcaccaccaagaagtacatctag

SEQ ID NO: 9640 - DNA, 1809 bp, Artificial Sequence
  Description of Artificial Sequence: Synthetic coding sequence
atgcccatcggcagcaaggagagacccaccttcttcgagatcttcaagaccagatgcaacaaggccggccccatcagcctgaactggttcgaggagctgagcagcgaggcccccccctacaacagcgagcccgccgaggagagcgagcacaagaacaacaactacgagcccaacctgttcaagaccccccagagaaagcccagctacaaccagctggccagcacccccatcatcttcaaggagcagggcctgaccctgcccctgtaccagagccccgtgaaggagctggacaagttcaagctggacctgggcagaaacgtgcccaacagcagacacaagagcctgagaaccgtgaagaccaagatggaccaggccgacgacgtgagctgccccctgctgaacagctgcctgagcgagagccccgtggtgctgcagtgcacccacgtgaccccccagagagacaagagcgtggtgtgcggcagcctgttccacacccccaagttcgtgaagggcagacagacccccaagcacatcagcgagagcctgggcgccgaggtggaccccgacatgagctggagcagcagcctggccaccccccccaccctgagcagcaccgtgctgatcgtgagaaacgaggaggccagcgagaccgtgttcccccacgacaccaccgccaacgtgaagagctacttcagcaaccacgacgagagcctgaagaagaacgacagattcatcgccagcgtgaccgacagcgagaacaccaaccagagagaggccgccagccacggcttcggcaagaccagcggcaacagcttcaaggtgaacagctgcaaggaccacatcggcaagagcatgcccaacgtgctggaggacgaggtgtacgagaccgtggtggacaccagcgaggaggacagcttcagcctgtgcttcagcaagtgcagaaccaagaacctgcagaaggtgagaaccagcaagaccagaaagaagatcttccacgaggccaacgccgacgagtgcgagaagagcaagaaccaggtgaaggagaagtacagcttcgtgagcgaggtggagcccaacgacaccgaccccctggacagcaacgtggccaaccagaagcccttcgagagcggcagcgacaagatcagcaaggaggtggtgcccagcctggcctgcgagtggagccagctgaccctgagcggcctgaacggcgcccagatggagaagatccccctgctgcacatcagcagctgcgaccagaacatcagcgagaaggacctgctggacaccgagaacaagagaaagaaggacttcctgaccagcgagaacagcctgcccagaatcagcagcctgcccaagagcgagaagcccctgaacgaggagaccgtggtgaacaagagagacgaggagcagcacctggagagccacaccgactgcatcctggccgtgaagcaggccatcagcggcaccagccccgtggccagcagcttccagggcatcaagaagagcatcttcagaatcagagagagccccaaggagaccttcaacgccagcttcagcggccacatgaccgaccccaacttcaagaaggagaccgaggccagcgagagcggcctggagatccacaccgtgtgcagccagaaggaggacagcctgtgccccaacctgatcgacaacggcagctggcccgccaccaccacccagaacagcgtggccctgaagaacgccggcctgatcagcaccctgaagaagaagaccaacaagttcatctacgccatccacgacgagaccagctacaagggcaagaagtag

SEQ ID NO: 9641 - DNA, 10257 bp, Artificial Sequence; identical to SEQ ID NO: 9639
  Description of Artificial Sequence: Synthetic coding sequence

SEQ ID NO: 9642 - DNA, 2667 bp, Artificial Sequence
  Description of Artificial Sequence: Synthetic coding sequence
atgcactgccccggcgaggcccccctggccgcccccagacccacccccaaggacccctgcctgagaaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9643 - DNA, 2613 bp, Artificial Sequence
  Description of Artificial Sequence: Synthetic coding sequence
atgaaccacctgaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9644 - DNA, 2667 bp, Artificial Sequence
  Description of Artificial Sequence: Synthetic coding sequence
atgaaccacctgaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgagcaagtgccagggcaacgccagagccagactgagactgtggggcgtgtgggtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9645 - DNA, 2751 bp, Artificial Sequence
  Description of Artificial Sequence: Synthetic coding sequence
atgcccgccaagcccttcctgagcagcgtgctgctgagctggaaggtgctggacttcagcggccccggcccccagggcaccggccagccctgcagctgcggccactgggccgagggccagggcggcccccccgagcccgccggcggccccaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9646 - DNA, 2667 bp, Artificial Sequence
  Description of Artificial Sequence: Synthetic coding sequence
atgctgacccacagaccccaggaggccgagcagagaggcagaacccccggccccagcttcgagtggaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9647 - DNA, 2169 bp, Artificial Sequence
  Description of Artificial Sequence: Synthetic coding sequence
atgcagggcaagaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9648 - DNA, 2613 bp, Artificial Sequence
  Description of Artificial Sequence: Synthetic coding sequence
atgagcgtgcccaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9649 - DNA, 2607 bp, Artificial Sequence
  Description of Artificial Sequence: Synthetic coding sequence
atggagaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9650 - DNA, 2526 bp, Artificial Sequence
  Description of Artificial Sequence: Synthetic coding sequence
atgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9651 - DNA, 741 bp, Artificial Sequence
  Description of Artificial Sequence: Synthetic coding sequence
atgcccgtgcagccccccagcaaggacaccgaggagatggaggccgagggcgacagcgccgccgagatgaacggcgaggaggaggagagcgaggaggagagaagcggcagccagaccgagagcgaggaggagagcagcgagatggacgacgaggactacgagagaagaagaagcgagtgcgtgagcgagatgctggacctggagaagcagttcagcgagctgaaggagaagctgttcagagagagactgagccagctgagactgagactggaggaggtgggcgccgagagagcccccgagtacaccgagcccctgggcggcctgcagagaagcctgaagatcagaatccaggtggccggcatctacaagggcttctgcctggacgtgatcagaaacaagtacgagtgcgagctgcagggcgccaagcagcacctggagagcgagaagctgctgctgtacgacaccctgcagggcgagctgcaggagagaatccagagactggaggaggacagacagagcctggacctgagcagcgagtggtgggacgacaagctgcacgccagaggcagcagcagaagctgggacagcctgccccccagcaagagaaagaaggcccccctggtgagcggcccctacatcgtgtacatgctgcaggagatcgacatcctggaggactggaccgccatcaagaaggccagagccgccgtgagcccccagaagagaaagagcgacggcccctag

SEQ ID NO: 9652 - DNA, 873 bp, Artificial Sequence
  Description of Artificial Sequence: Synthetic coding sequence
atgcccgtgcagccccccagcaaggacaccgaggagatggaggccgagggcgacagcgccgccgagatgaacggcgaggaggaggagagcgaggaggagagaagcggcagccagaccgagagcgaggaggagagcagcgagatggacgacgaggactacgagagaagaagaagcgagtgcgtgagcgagatgctggacctggagaagcagttcagcgagctgaaggagaagctgttcagagagagactgagccagctgagactgagactggaggaggtgggcgccgagagagcccccgagtacaccgagcccctgggcggcctgcagagaagcctgaagatcagaatccaggtggccggcatctacaagggcttctgcctggacgtgatcagaaacaagtacgagtgcgagctgcagggcgccaagcagcacctggagagcgagaagctgctgctgtacgacaccctgcagggcgagctgcaggagagaatccagagactggaggaggacagacagagcctggacctgagcagcgagtggtgggacgacaagctgcacgccagaggcagcagcagaagctgggacagcctgccccccagcaagagaaagaaggcccccctggtgagcggcccctacatcgtgtacatgctgcaggagatcgacatcctggaggactggaccgccatcaagaaggccagagccgccgtgagcccccagaagagaaagagcgacgacagaagaacccacagacccctgagagtgtgccccgccagactgctgtggtgctgctgggccctgcccctgcacctggccctggcctggaccccccccctgcccagcagcagacccgcccagctgtggccctggagctag

SEQ ID NO: 9653 - DNA, 735 bp, Artificial Sequence
  Description of Artificial Sequence: Synthetic coding sequence
atgcccgtgcagccccccagcaaggacaccgaggagatggaggccgagggcgacagcgccgccgagatgaacggcgaggaggaggagagcgaggaggagagaagcggcagccagaccgagagcgaggaggagagcagcgagatggacgacgaggactacgagagaagaagaagcgagtgcgtgagcgagatgctggacctggagaagcagttcagcgagctgaaggagaagctgttcagagagagactgagccagctgagactgagactggaggaggtgggcgccgagagagcccccgagtacaccgagcccctgggcggcctgcagagaagcctgaagatcagaatccaggtggccggcatctacaagggcttctgcctggacgtgatcagaaacaagtacgagtgcgagctgcagggcgccaagcagcacctggagagcgagaagctgctgctgtacgacaccctgcagggcgagctgcaggagagaatccagagactggaggaggacagacagagcctggacctgagcagcgagtggtgggacgacaagctgcacgccagaggcagcagcagaagctgggacagcctgccccccagcaagagaaagaaggcccccctggtgagcggcccctacatcgtgtacatgctgcaggagatcgacatcctggaggactggaccgccatcaagaaggccagagccgccgtgagcccccagaagagaaagagcgactag

SEQ ID NO: 9654 - DNA, 1494 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagaaagaagagcaagctgttcagcagactgagaagaaagaagaacagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9655 - DNA, 1782 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaagcccgtgagcctgctggagaaggccgccccccagtggtgccagggcaagctgcaggcccacctggtggcccagaccaacctgctgagaaaccaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagttcgaggcccccggccccttcagcgagcaggccagcctgctggacctggacttcgaccccctgccccccgtgaccagccccgtgaaggcccccacccccagcggccagagcatcccctgggacctgtgggagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9656 - DNA, 1557 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9657 - DNA, 1230 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9658 - DNA, 1521 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaagcccgtgagcctgctggagaaggccgccccccagtggtgccagggcaagctgcaggcccacctggtggcccagaccaacctgctgagaaaccaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9659 - DNA, 1365 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagaaagaagagcaagctgttcagcagactgagaagaaagaagaacagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9660 - DNA, 1653 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaagcccgtgagcctgctggagaaggccgccccccagtggtgccagggcaagctgcaggcccacctggtggcccagaccaacctgctgagaaaccaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagttcgaggcccccggccccttcagcgagcaggccagcctgctggacctggacttcgaccccctgccccccgtgaccagccccgtgaaggcccccacccccagcggccagagcatcccctgggacctgtgggagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9661 - DNA, 1449 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9662 - DNA, 1428 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9663 - DNA, 1320 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9664 - DNA, 1956 bp, Artificial Sequence
  Description of Artificial Sequence: Synthetic coding sequence
atgggcaagaagcacaagaagcacaagagcgacaagcacctgtacgaggagtacgtggagaagcccctgaagctggtgctgaaggtgggcggcaacgaggtgaccgagctgagcaccggcagcagcggccacgacagcagcctgttcgaggacaagaacgaccacgacaagcacaaggacagaaagagaaagaagagaaagaagggcgagaagcagatccccggcgaggagaagggcagaaagagaagaagagtgaaggaggacaagaagaagagagacagagacagagtggagaacgaggccgagaaggacctgcagtgccacgcccccgtgagactggacctgccccccgagaagcccctgaccagcagcctggccaagcaggaggaggtggagcagacccccctgcaggaggccctgaaccagctgatgagacagctgcagagaaaggaccccagcgccttcttcagcttccccgtgaccgacttcatcgcccccggctacagcatgatcatcaagcaccccatggacttcagcaccatgaaggagaagatcaagaacaacgactaccagagcatcgaggagctgaaggacaacttcaagctgatgtgcaccaacgccatgatctacaacaagcccgagaccatctactacaaggccgccaagaagctgctgcacagcggcatgaagatcctgagccaggagagaatccagagcctgaagcagagcatcgacttcatggccgacctgcagaagaccagaaagcagaaggacggcaccgacaccagccagagcggcgaggacggcggctgctggcagagagagagagaggacagcggcgacgccgaggcccacgccttcaagagccccagcaaggagaacaagaagaaggacaaggacatgctggaggacaagttcaagagcaacaacctggagagagagcaggagcagctggacagaatcgtgaaggagagcggcggcaagctgaccagaagactggtgaacagccagtgcgagttcgagagaagaaagcccgacggcaccaccaccctgggcctgctgcaccccgtggaccccatcgtgggcgagcccggctactgccccgtgagactgggcatgaccaccggcagactgcagagcggcgtgaacaccctgcagggcttcaaggaggacaagagaaacaaggtgacccccgtgctgtacctgaactacggcccctacagcagctacgccccccactacgacagcaccttcgccaacatcagcaaggacgacagcgacctgatctacagcacctacggcgaggacagcgacctgcccagcgacttcagcatccacgagttcctggccacctgccaggactacccctacgtgatggccgacagcctgctggacgtgctgaccaagggcggccacagcagaaccctgcaggagatggagatgagcctgcccgaggacgagggccacaccagaaccctggacaccgccaaggagatggagatcaccgaggtggagccccccggcagactggacagcagcacccaggacagactgatcgccctgaaggccgtgaccaacttcggcgtgcccgtggaggtgttcgacagcgaggaggccgagatcttccagaagaagctggacgagaccaccagactgctgagagagctgcaggaggcccagaacgagagactgagcaccagacccccccccaacatgatctgcctgctgggccccagctacagagagatgcacctggccgagcaggtgaccaacaacctgaaggagctggcccagcaggtgacccccggcgacatcgtgagcacctacggcgtgagaaaggccatgggcatcagcatccccagccccgtgatggagaacaacttcgtggacctgaccgaggacaccgaggagcccaagaagaccgacgtggccgagtgcggccccggcggcagctag

SEQ ID NO: 9665 - DNA, 1959 bp, Artificial Sequence
  Description of Artificial Sequence: Synthetic coding sequence
atgggcaagaagcacaagaagcacaagagcgacaagcacctgtacgaggagtacgtggagaagcccctgaagctggtgctgaaggtgggcggcaacgaggtgaccgagctgagcaccggcagcagcggccacgacagcagcctgttcgaggacaagaacgaccacgacaagcacaaggacagaaagagaaagaagagaaagaagggcgagaagcagatccccggcgaggagaagggcagaaagagaagaagagtgaaggaggacaagaagaagagagacagagacagagtggagaacgaggccgagaaggacctgcagtgccacgcccccgtgagactggacctgccccccgagaagcccctgaccagcagcctggccaagcaggaggaggtggagcagacccccctgcaggaggccctgaaccagctgatgagacagctgcagagaaaggaccccagcgccttcttcagcttccccgtgaccgacttcatcgcccccggctacagcatgatcatcaagcaccccatggacttcagcaccatgaaggagaagatcaagaacaacgactaccagagcatcgaggagctgaaggacaacttcaagctgatgtgcaccaacgccatgatctacaacaagcccgagaccatctactacaaggccgccaagaagctgctgcacagcggcatgaagatcctgagccaggagagaatccagagcctgaagcagagcatcgacttcatggccgacctgcagaagaccagaaagcagaaggacggcaccgacaccagccagagcggcgaggacggcggctgctggcagagagagagagaggacagcggcgacgccgaggcccacgccttcaagagccccagcaaggagaacaagaagaaggacaaggacatgctggaggacaagttcaagagcaacaacctggagagagagcaggagcagctggacagaatcgtgaaggagagcggcggcaagctgaccagaagactggtgaacagccagtgcgagttcgagagaagaaagcccgacggcaccaccaccctgggcctgctgcaccccgtggaccccatcgtgggcgagcccggctactgccccgtgagactgggcatgaccaccggcagactgcagagcggcgtgaacaccctgcagggcttcaaggaggacaagagaaacaaggtgacccccgtgctgtacctgaactacggcccctacagcagctacgccccccactacgacagcaccttcgccaacatcagcaaggacgacagcgacctgatctacagcacctacggcgaggacagcgacctgcccagcgacttcagcatccacgagttcctggccacctgccaggactacccctacgtgatggccgacagcctgctggacgtgctgaccaagggcggccacagcagaaccctgcaggagatggagatgagcctgcccgaggacgagggccacaccagaaccctggacaccgccaaggagatggagcagatcaccgaggtggagccccccggcagactggacagcagcacccaggacagactgatcgccctgaaggccgtgaccaacttcggcgtgcccgtggaggtgttcgacagcgaggaggccgagatcttccagaagaagctggacgagaccaccagactgctgagagagctgcaggaggcccagaacgagagactgagcaccagacccccccccaacatgatctgcctgctgggccccagctacagagagatgcacctggccgagcaggtgaccaacaacctgaaggagctggcccagcaggtgacccccggcgacatcgtgagcacctacggcgtgagaaaggccatgggcatcagcatccccagccccgtgatggagaacaacttcgtggacctgaccgaggacaccgaggagcccaagaagaccgacgtggccgagtgcggccccggcggcagctag

SEQ ID NO: 9666 - DNA, 1959 bp, Artificial Sequence; identical to SEQ ID NO: 9665
  Description of Artificial Sequence: Synthetic coding sequence

SEQ ID NO: 9667 - DNA, 1980 bp, Artificial Sequence
  Description of Artificial Sequence: Synthetic coding sequence
atggccgccgtgatcctggagagcatcttcctgaagagaagccagcagaagaagaagaccagccccctgaacttcaagaagagactgttcctgctgaccgtgcacaagctgagctactacgagtacgacttcgagagaggcagaagaggcagcaagaagggcagcatcgacgtggagaagatcacctgcgtggagaccgtggtgcccgagaagaaccccccccccgagagacagatccccagaagaggcgaggagagcagcgagatggagcagatcagcatcatcgagagattcccctaccccttccaggtggtgtacgacgagggccccctgtacgtgttcagccccaccgaggagctgagaaagagatggatccaccagctgaagaacgtgatcagatacaacagcgacctggtgcagaagtaccacccctgcttctggatcgacggccagtacctgtgctgcagccagaccgccaagaacgccatgggctgccagatcctggagaacagaaacggcagcctgaagcccggcagcagccacagaaagaccaagaagcccctgccccccacccccgaggaggaccagatcctgaagaagcccctgccccccgagcccgccgccgcccccgtgagcaccagcgagctgaagaaggtggtggccctgtacgactacatgcccatgaacgccaacgacctgcagctgagaaagggcgacgagtacttcatcctggaggagagcaacctgccctggtggagagccagagacaagaacggccaggagggctacatccccagcaactacgtgaccgaggccgaggacagcatcgagatgtacgagtggtacagcaagcacatgaccagaagccaggccgagcagctgctgaagcaggagggcaaggagggcggcttcatcgtgagagacagcagcaaggccggcaagtacaccgtgagcgtgttcgccaagagcaccggcgacccccagggcgtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgaacctgagccacgagaagctggtgcagctgtacggcgtgtgcaccaagcagagacccatcttcatcatcaccgagtacatggccaacggctgcctgctgaactacctgagagagatgagacacagattccagacccagcagctgctggagatgtgcaaggacgtgtgcgaggccatggagtacctggagagcaagcagttcctgcacagagacctggccgccagaaactgcctggtgaacgaccagggcgtggtgaaggtgagcgacttcggcctgagcagatacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9668 - DNA, 627 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagaacccagcagctgctggagatgtgcaaggacgtgtgcgaggccatggagtacctggagagcaagcagttcctgcacagagacctggccgccagaaactgcctggtgaacgaccagggcgtggtgaaggtgagcgacttcggcctgagcagatacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9669 - DNA, 420 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9670 - DNA, 705 bp, Artificial Sequence
  Description of Artificial Sequence: Synthetic coding sequence
agacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgtacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9671 - DNA, 225 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcatgagctggatgatgaacacccaggcccagtag

SEQ ID NO: 9672 - DNA, 1452 bp, Artificial Sequence
  Description of Artificial Sequence: Synthetic coding sequence
atggccgccgtgatcctggagagcatcttcctgaagagaagccagcagaagaagaagaccagccccctgaacttcaagaagagactgttcctgctgaccgtgcacaagctgagctactacgagtacgacttcgagagaggcagaagaggcagcaagaagggcagcatcgacgtggagaagatcacctgcgtggagaccgtggtgcccgagaagaaccccccccccgagagacagatccccagaagaggcgaggagagcagcgagatggagcagatcagcatcatcgagagattcccctaccccttccaggtggtgtacgacgagggccccctgtacgtgttcagccccaccgaggagctgagaaagagatggatccaccagctgaagaacgtgatcagatacaacagcgacctggtgcagaagtaccacccctgcttctggatcgacggccagtacctgtgctgcagccagaccgccaagaacgccatgggctgccagatcctggagaacagaaacggcagcctgaagcccggcagcagccacagaaagaccaagaagcccctgccccccacccccgaggaggaccagatcctgaagaagcccctgccccccgagcccgccgccgcccccgtgagcaccagcgagctgaagaaggtggtggccctgtacgactacatgcccatgaacgccaacgacctgcagctgagaaagggcgacgagtacttcatcctggaggagagcaacctgccctggtggagagccagagacaagaacggccaggagggctacatccccagcaactacgtgaccgaggccgaggacagcatcgagatgtacgagtggtacagcaagcacatgaccagaagccaggccgagcagctgctgaagcaggagggcaaggagggcggcttcatcgtgagagacagcagcaaggccggcaagtacaccgtgagcgtgttcgccaagagcaccggcgacccccagggcgtgatcagacactacgtggtgtgcagcaccccccagagccagtactacctggccgccagaaactgcctggtgaacgaccagggcgtggtgaaggtgagcgacttcggcctgagcagatacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9673 - DNA, 519 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgaacctgagccacgagaagctggtgcagctgtacggcgtgtgcaccaagcagagacccatcttcatcatcaccgagtacatggccaacggctgcctgccctgcaccgtggccggcatgagaaagcagatgagcgtgcccctgagcaagttcttctag

SEQ ID NO: 9674 - DNA, 594 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgaacctgagccacgagaagctggtgcagctgtacggcgtgtgcaccaagcagagacccatcttcatcatcaccgagtacatggccaacggctgcctgctgaactacctgagagagatgagacacagattccagacccagcagctgctggagatgtgcaaggacgtgtgcgaggccatggagtacctggagagcaagcagttcctgcacagagacctggtgtgccccggctag

SEQ ID NO: 9675 - DNA, 156 bp, Artificial Sequence
  Description of Artificial Sequence: Synthetic coding sequence
atcagacactacgtggtgtgcagcaccccccagagccagtactacctggccgagaagcacctgttcagcaccatccccgagctgatcaactaccaccagcacaacagcgccggcgaggacagcgccgccgccagagacgtgcagggctgcctgtag

SEQ ID NO: 9676 - DNA, 891 bp, Artificial Sequence
  Description of Artificial Sequence: Synthetic coding sequence
atgaagaacgagatcgccgccgtggtgttcttcttcaccagactggtgagaaagcacgacaagctgaagaaggaggccgtggagagattcgccgagaagctgaccctgatcctgcaggagaagtacaagaaccactggtaccccgagaagcccagcaagggccaggcctacagatgcatcagagtgaacaagttccagagagtggaccccgacgtgctgaaggcctgcgagaacagctgcatcctgtacagcgacctgggcctgcccaaggagctgaccctgtgggtggacccctgcgaggtgtgctgcagaagagacggcgtgagcccctgctggcccgactgcagccagacccccgacctggtgatcagacccccctggccccccaaggccctggactacagaagagagcccctgagacccgccagcagcttcctgatcatgtacggcgagaagaacaacgccttcatcgtggccagcttcgagaacaaggacgagaacaaggacgagatcagcagaaaggtgaccagagccctggacaaggtgaccagcgactaccacagcggcagcagcagcagcgacgaggagaccagcaaggagatggaggtgaagcccagcagcgtgaccgccgccgccagccccgtgtaccagatcagcgagctgatcttcccccccctgcccatgtggcaccccctgcccagaaagaagcccggcatgtacagaggcaacggccaccagaaccactaccccccccccgtgcccttcggctaccccaaccagggcagaaagaacaagccctacagacccatccccgtgacctgggtgcccccccccggcatgcactgcgacagaaaccactggatcaacccccacatgctggccccccactag

SEQ ID NO: 9677 - DNA, 759 bp, Artificial Sequence
  Description of Artificial Sequence: Synthetic coding sequence
atgaagaacgagatcgccgccgtggtgttcttcttcaccagactggtgagaaagcacgacaagctgaagaaggaggccgtggagagattcgccgagaagctgaccctgatcctgcaggagaagtacaagaaccactggtaccccgagaagcccagcaagggccaggcctacagatgcatcagagtgaacaagttccagagagtggaccccgacgtgctgaaggcctgcgagaacagctgcatcctgtacagcgacctgggcctgcccaaggagctgaccctgtgggtggacccctgcgaggtgtgctgcagatacggcgagaagaacaacgccttcatcgtggccagcttcgagaacaaggacgagaacaaggacgagatcagcagaaaggtgaccagagccctggacaaggtgaccagcgactaccacagcggcagcagcagcagcgacgaggagaccagcaaggagatggaggtgaagcccagcagcgtgaccgccgccgccagccccgtgtaccagatcagcgagctgatcttcccccccctgcccatgtggcaccccctgcccagaaagaagcccggcatgtacagaggcaacggccaccagaaccactaccccccccccgtgcccttcggctaccccaaccagggcagaaagaacaagccctacagacccatccccgtgacctgggtgcccccccccggcatgcactgcgacagaaaccactggatcaacccccacatgctggccccccactag

SEQ ID NO: 9678 - DNA, 141 bp, Artificial Sequence
  Description of Artificial Sequence: Synthetic coding sequence
atgaagaacgagatcgccgccgtggtgttcttcttcaccagactggtgagaaagcacgacaagctgaagaaggaggccgtggagagattcgccgagaagctgaccctgatcctgcaggagaagtacaagaaccactggtag

SEQ ID NO: 9679 - DNA, 1560 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgtggtgccccagaccaccgtgatcctgaacaacgacagacagaacgccatcgtggccaagatggaggaccccctgagcaacagagcccccgacagcctggagaacgtgatcagcaacgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgggccacctgcacatcgcccaggtgccccagggcgagcaggtgcagatcacccaggacagcgagggcaacctgcagatccaccacgtgggccaggacggccagctgctggaggccaccagaatcccctgcctgctggcccccagcgtgttcaaggccagcagcggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9680 - DNA, 1398 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9681 - DNA, 1410 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9682 - DNA, 1494 bp, Artificial Sequence
  Description of Artificial Sequence: Synthetic coding sequence
atgatgagcgagcacgacctggccgacgtggtgcagatcgccgtggaggacctgagccccgaccaccccggcaccgagctgtgggacatcgtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccagctgctggaggccaccagaatcccctgcctgctggcccccagcgtgttcaaggccagcagcggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9683 - DNA, 1560 bp, Artificial Sequence; identical to SEQ ID NO: 9679
  Description of Artificial Sequence: Synthetic coding sequence

SEQ ID NO: 9684 - DNA, 1476 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccagctgctggaggccaccagaatcccctgcctgctggcccccagcgtgttcaaggccagcagcggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9685 - DNA, 357 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaagtag

SEQ ID NO: 9686 - DNA, 87 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaactag

SEQ ID NO: 9687 - DNA, 288 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagtag

SEQ ID NO: 9688 - DNA, 372 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgtggtgtag

SEQ ID NO: 9689 - DNA, 588 bp, Artificial Sequence
  Description of Artificial Sequence: Synthetic coding sequence
atgatgagcgagcacgacctggccgacgtggtgcagatcgccgtggaggacctgagccccgaccaccccggcaccgagctgtgggacatcgtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggctag

SEQ ID NO: 9690 - DNA, 360 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgtag

SEQ ID NO: 9691 - DNA, 1401 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9692 - DNA, 753 bp, Artificial Sequence
  Description of Artificial Sequence: Synthetic coding sequence
atgggcagccccgagcccacccagggccccagactgagccccatcctgatcccctacagcggcagaagatacaaggtgggcagagccagcggcgccctgtgccaccaggacagcctgccccccatcctggagctgggcctgaccttcctgagagccagcgccggcttcagcgtgcccaccagcagcagcttcgccctgcccgagcccctgagaagcctgtgcctgggcaacggcgagggcctgggcctgagcctgaccctgaccgtgctggcctggatcctgggcctgagcggcaccctgggcgccctggtgctgttcatggtggccaccggcatcttccaggaggccctgtggcacctgctgctgctgagcttcagcgtggaggccctgccctgcttcttcttcttccccttcttcctgctgtgcagatgcctgagagccgagctgcagatccagcagagactggacggcaccctgagcctggacctgatgagactggagagcgacggcgagaccggctgcgccgccgagagcagcgtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9693 - DNA, 1527 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgtggtgccccagaccaccgtgatcctgaacaacgacagacagaacgccatcgtggccaagatggaggaccccctgagcaacagagcccccgacagcctggagaacgtgatcagcaacgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9694 - DNA, 1476 bp, Artificial Sequence; identical to SEQ ID NO: 9684
  Description of Artificial Sequence: Synthetic coding sequence

SEQ ID NO: 9695 - DNA, 3153 bp, Artificial Sequence
  Description of Artificial Sequence: Synthetic coding sequence
atggccgccgtgaagaaggagggcggcgccctgagcgaggccatgagcctggagggcgacgagtgggagctgagcaaggagaacgtgcagcccctgagacagggcagaatcatgagcaccctgcagggcgccctggcccaggagagcgcctgcaacaacaccctgcagcagcagaagagagccttcgagtacgagatcagattctacaccggcaacgaccccctggacgtgtgggacagatacatcagctggaccgagcagaactacccccagggcggcaaggagagcaacatgagcaccctgctggagagagccgtggaggccctgcagggcgagaagagatactacagcgaccccagattcctgaacctgtggctgaagctgggcagactgtgcaacgagcccctggacatgtacagctacctgcacaaccagggcatcggcgtgagcctggcccagttctacatcagctgggccgaggagtacgaggccagagagaacttcagaaaggccgacgccatcttccaggagggcatccagcagaaggccgagcccctggagagactgcagagccagcacagacagttccaggccagagtgagcagacagaccctgctggccctggagaaggaggaggaggaggaggtgttcgagagcagcgtgccccagagaagcaccctggccgagctgaagagcaagggcaagaagaccgccagagcccccatcatcagagtgggcggcgccctgaaggcccccagccagaacagaggcctgcagaaccccttcccccagcagatgcagaacaacagcagaatcaccgtgttcgacgagaacgccgacgaggccagcaccgccgagctgagcaagcccaccgtgcagccctggatcgccccccccatgcccagagccaaggagaacgagctgcaggccggcccctggaacaccggcagaagcctggagcacagacccagaggcaacaccgccagcctgatcgccgtgcccgccgtgctgcccagcttcaccccctacgtggaggagaccgccagacagcccgtgatgaccccctgcaagatcgagcccagcatcaaccacatcctgagcaccagaaagcccggcaaggaggagggcgaccccctgcagagagtgcagagccaccagcaggccagcgaggagaagaaggagaagatgatgtactgcaaggagaagatctacgccggcgtgggcgagttcagcttcgaggagatcagagccgaggtgttcagaaagaagctgaaggagcagagagaggccgagctgctgaccagcgccgagaagagagccgagatgcagaagcagatcgaggagatggagaagaagctgaaggagatccagaccacccagcaggagagaaccggcgaccagcaggaggagaccatgcccaccaaggagaccaccaagctgcagatcgccagcgagagccagaagatccccggcatgaccctgagcagcagcgtgtgccaggtgaactgctgcgccagagagaccagcctggccgagaacatctggcaggagcagccccacagcaagggccccagcgtgcccttcagcatcttcgacgagttcctgctgagcgagaagaagaacaagagcccccccgccgacccccccagagtgctggcccagagaagacccctggccgtgctgaagaccagcgagagcatcaccagcaacgaggacgtgagccccgacgtgtgcgacgagttcaccggcatcgagcccctgagcgaggacgccatcatcaccggcttcagaaacgtgaccatctgccccaaccccgaggacacctgcgacttcgccagagccgccagattcgtgagcacccccttccacgagatcatgagcctgaaggacctgcccagcgaccccgagagactgctgcccgaggaggacctggacgtgaagaccagcgaggaccagcagaccgcctgcggcaccatctacagccagaccctgagcatcaagaagctgagccccatcatcgaggacagcagagaggccacccacagcagcggcttcagcggcagcagcgccagcgtggccagcaccagcagcatcaagtgcctgcagatccccgagaagctggagctgaccaacgagaccagcgagaaccccacccagagcccctggtgcagccagtacagaagacagctgctgaagagcctgcccgagctgagcgccagcgccgagctgtgcatcgaggacagacccatgcccaagctggagatcgagaaggagatcgagctgggcaacgaggactactgcatcaagagagagtacctgatctgcgaggactacaagctgttctgggtggcccccagaaacagcgccgagctgaccgtgatcaaggtgagcagccagcccgtgccctgggacttctacatcaacctgaagctgaaggagagactgaacgaggacttcgaccacttctgcagctgctaccagtaccaggacggctgcatcgtgtggcaccagtacatcaactgcttcaccctgcaggacctgctgcagcacagcgagtacatcacccacgagatcaccgtgctgatcatctacaacctgctgaccatcgtggagatgctgcacaaggccgagatcgtgcacggcgacctgagccccagatgcctgatcctgagaaacagaatccacgacccctacgactgcaacaagaacaaccaggccctgaagatcgtggacttcagctacagcgtggacctgagagtgcagctggacgtgttcaccctgagcggcttcagaaccgtgcagatcctggagggccagaagatcctggccaactgcagcagcccctaccaggtggacctgttcggcatcgccgacctggcccacctgctgctgttcaaggagcacctgcaggtgttctgggacggcagcttctggaagctgagccagaacatcagcgagctgaaggacggcgagctgtggaacaagttcttcgtgagaatcctgaacgccaacgacgaggccaccgtgagcgtgctgggcgagctggccgccgagatgaacggcgtgttcgacaccaccttccagagccacctgaacaaggccctgtggaaggtgggcaagctgaccagccccggcgccctgctgttccagtag

SEQ ID NO: 9696 - DNA, 3195 bp, Artificial Sequence
  Description of Artificial Sequence: Synthetic coding sequence
atggccgccgtgaagaaggagggcggcgccctgagcgaggccatgagcctggagggcgacgagtgggagctgagcaaggagaacgtgcagcccctgagacagggcagaatcatgagcaccctgcagggcgccctggcccaggagagcgcctgcaacaacaccctgcagcagcagaagagagccttcgagtacgagatcagattctacaccggcaacgaccccctggacgtgtgggacagatgggtgttcctgttccacaaggacaacagaaacatcaacagatacatcagctggaccgagcagaactacccccagggcggcaaggagagcaacatgagcaccctgctggagagagccgtggaggccctgcagggcgagaagagatactacagcgaccccagattcctgaacctgtggctgaagctgggcagactgtgcaacgagcccctggacatgtacagctacctgcacaaccagggcatcggcgtgagcctggcccagttctacatcagctgggccgaggagtacgaggccagagagaacttcagaaaggccgacgccatcttccaggagggcatccagcagaaggccgagcccctggagagactgcagagccagcacagacagttccaggccagagtgagcagacagaccctgctggccctggagaaggaggaggaggaggaggtgttcgagagcagcgtgccccagagaagcaccctggccgagctgaagagcaagggcaagaagaccgccagagcccccatcatcagagtgggcggcgccctgaaggcccccagccagaacagaggcctgcagaaccccttcccccagcagatgcagaacaacagcagaatcaccgtgttcgacgagaacgccgacgaggccagcaccgccgagctgagcaagcccaccgtgcagccctggatcgccccccccatgcccagagccaaggagaacgagctgcaggccggcccctggaacaccggcagaagcctggagcacagacccagaggcaacaccgccagcctgatcgccgtgcccgccgtgctgcccagcttcaccccctacgtggaggagaccgccagacagcccgtgatgaccccctgcaagatcgagcccagcatcaaccacatcctgagcaccagaaagcccggcaaggaggagggcgaccccctgcagagagtgcagagccaccagcaggccagcgaggagaagaaggagaagatgatgtactgcaaggagaagatctacgccggcgtgggcgagttcagcttcgaggagatcagagccgaggtgttcagaaagaagctgaaggagcagagagaggccgagctgctgaccagcgccgagaagagagccgagatgcagaagcagatcgaggagatggagaagaagctgaaggagatccagaccacccagcaggagagaaccggcgaccagcaggaggagaccatgcccaccaaggagaccaccaagctgcagatcgccagcgagagccagaagatccccggcatgaccctgagcagcagcgtgtgccaggtgaactgctgcgccagagagaccagcctggccgagaacatctggcaggagcagccccacagcaagggccccagcgtgcccttcagcatcttcgacgagttcctgctgagcgagaagaagaacaagagcccccccgccgacccccccagagtgctggcccagagaagacccctggccgtgctgaagaccagcgagagcatcaccagcaacgaggacgtgagccccgacgtgtgcgacgagttcaccggcatcgagcccctgagcgaggacgccatcatcaccggcttcagaaacgtgaccatctgccccaaccccgaggacacctgcgacttcgccagagccgccagattcgtgagcacccccttccacgagatcatgagcctgaaggacctgcccagcgaccccgagagactgctgcccgaggaggacctggacgtgaagaccagcgaggaccagcagaccgcctgcggcaccatctacagccagaccctgagcatcaagaagctgagccccatcatcgaggacagcagagaggccacccacagcagcggcttcagcggcagcagcgccagcgtggccagcaccagcagcatcaagtgcctgcagatccccgagaagctggagctgaccaacgagaccagcgagaaccccacccagagcccctggtgcagccagtacagaagacagctgctgaagagcctgcccgagctgagcgccagcgccgagctgtgcatcgaggacagacccatgcccaagctggagatcgagaaggagatcgagctgggcaacgaggactactgcatcaagagagagtacctgatctgcgaggactacaagctgttctgggtggcccccagaaacagcgccgagctgaccgtgatcaaggtgagcagccagcccgtgccctgggacttctacatcaacctgaagctgaaggagagactgaacgaggacttcgaccacttctgcagctgctaccagtaccaggacggctgcatcgtgtggcaccagtacatcaactgcttcaccctgcaggacctgctgcagcacagcgagtacatcacccacgagatcaccgtgctgatcatctacaacctgctgaccatcgtggagatgctgcacaaggccgagatcgtgcacggcgacctgagccccagatgcctgatcctgagaaacagaatccacgacccctacgactgcaacaagaacaaccaggccctgaagatcgtggacttcagctacagcgtggacctgagagtgcagctggacgtgttcaccctgagcggcttcagaaccgtgcagatcctggagggccagaagatcctggccaactgcagcagcccctaccaggtggacctgttcggcatcgccgacctggcccacctgctgctgttcaaggagcacctgcaggtgttctgggacggcagcttctggaagctgagccagaacatcagcgagctgaaggacggcgagctgtggaacaagttcttcgtgagaatcctgaacgccaacgacgaggccaccgtgagcgtgctgggcgagctggccgccgagatgaacggcgtgttcgacaccaccttccagagccacctgaacaaggccctgtggaaggtgggcaagctgaccagccccggcgccctgctgttccagtag

SEQ ID NO: 9697 - DNA, 2802 bp, Artificial Sequence
  Description of Artificial Sequence: Synthetic coding sequence
atggccgccgtgaagaaggagggcggcgccctgagcgaggccatgagcctggagggcgacgagtgggagctgagcaaggagaacgtgcagcccctgagacagggcagaatcatgagcaccctgcagggcgccctggcccaggagagcgcctgcaacaacaccctgcagcagcagaagagagccttcgagtacgagatcagattctacaccggcaacgaccccctggacgtgtgggacagatacatcagctggaccgagcagaactacccccagggcggcaaggagagcaacatgagcaccctgctggagagagccgtggaggccctgcagggcgagaacttctggaaggccgacgccatcttccaggagggcatccagcagaaggccgagcccctggagagactgcagagccagcacagacagttccaggccagagtgagcagacagaccctgctggccctggagaaggaggaggaggaggaggtgttcgagagcagcgtgccccagagaagcaccctggccgagctgaagagcaagggcaagaagaccgccagagcccccatcatcagagtgggcggcgccctgaaggcccccagccagaacagaggcctgcagaaccccttcccccagcagatgcagaacaacagcagaatcaccgtgttcgacgagaacgccgacgaggccagcaccgccgagctgagcaagcccaccgtgcagccctggatcgccccccccatgcccagagccaaggagaacgagctgcaggccggcccctggaacaccggcagaagcctggagcacagacccagaggcaacaccgccagcctgatcgccgtgcccgccgtgctgcccagcttcaccccctacgtggaggagaccgccagacagcccgtgatgaccccctgcaagatcgagcccagcatcaaccacatcctgagcaccagaaagcccggcaaggaggagggcgaccccctgcagagagtgcagagccaccagcaggccagcgaggagaagaaggagaagatgatgtactgcaaggagaagatctacgccggcgtgggcgagttcagcttcgaggagatcagagccgaggtgttcagaaagaagctgaaggagcagagagaggccgagctgctgaccagcgccgagaagagagccgagatgcagaagcagatcgaggagatggagaagaagctgaaggagatccagaccacccagcaggagagaaccggcgaccagcaggaggagaccatgcccaccaaggagaccaccaagctgcagatcgccagcgagagccagaagatccccggcatgaccctgagcagcagcgtgtgccaggtgaactgctgcgccagagagaccagcctggccgagaacatctggcaggagcagccccacagcaaggtgagcctgagcctgggccccagcgtgcccttcagcatcttcgacgagttcctgctgagcgagaagaagaacaagagcccccccgccgacccccccagagtgctggcccagagaagacccctggccgtgctgaagaccagcgagagcatcaccagcaacgaggacgtgagccccgacgtgtgcgacgagttcaccggcatcgagcccctgagcgaggacgccatcatcaccggcttcagaaacgtgaccatctgccccaaccccgaggacaccagagaggccacccacagcagcggcttcagcggcagcagcgccagcgtggccagcaccagcagcatcaagtgcctgcagatccccgagaagctggagctgaccaacgagaccagcgagaaccccacccagagcccctggtgcagccagtacagaagacagctgctgaagagcctgcccgagctgagcgccagcgccgagctgtgcatcgaggacagacccatgcccaagctggagatcgagaaggagatcgagctgggcaacgaggactactgcatcaagagagagtacctgatctgcgaggactacaagctgttctgggtggcccccagaaacagcgccgagctgaccgtgatcaaggtgagcagccagcccgtgccctgggacttctacatcaacctgaagctgaaggagagactgaacgaggacttcgaccacttctgcagctgctaccagtaccaggacggctgcatcgtgtggcaccagtacatcaactgcttcaccctgcaggacctgctgcagcacagcgagtacatcacccacgagatcaccgtgctgatcatctacaacctgctgaccatcgtggagatgctgcacaaggccgagatcgtgcacggcgacctgagccccagatgcctgatcctgagaaacagaatccacgacccctacgactgcaacaagaacaaccaggccctgaagatcgtggacttcagctacagcgtggacctgagagtgcagctggacgtgttcaccctgagcggcttcagaaccgtgcagatcctggagggccagaagatcctggccaactgcagcagcccctaccaggtggacctgttcggcatcgccgacctggcccacctgctgctgttcaaggagcacctgcaggtgttctgggacggcagcttctggaagctgagccagaacatcagcgagctgaaggacggcgagctgtggaacaagttcttcgtgagaatcctgaacgccaacgacgaggccaccgtgagcgtgctgggcgagctggccgccgagatgaacggcgtgttcgacaccaccttccagagccacctgaacaaggccctgtggaaggtgggcaagctgaccagccccggcgccctgctgttccagtag

SEQ ID NO: 9698 - DNA, 3393 bp, Artificial Sequence
  Description of Artificial Sequence: Synthetic coding sequence
atgctggagatctgcctgaagctggtgggctgcaagagcaagaagggcctgagcagcagcagcagctgctacctggaggaggccctgcagagacccgtggccagcgacttcgagccccagggcctgagcgaggccgccagatggaacagcaaggagaacctgctggccggccccagcgagaacgaccccaacctgttcgtggccctgtacgacttcgtggccagcggcgacaacaccctgagcatcaccaagggcgagaagctgagagtgctgggctacaaccacaacggcgagtggtgcgaggcccagaccaagaacggccagggctgggtgcccagcaactacatcacccccgtgaacagcctggagaagcacagctggtaccacggccccgtgagcagaaacgccgccgagtacctgctgagcagcggcatcaacggcagcttcctggtgagagagagcgagagcagccccggccagagaagcatcagcctgagatacgagggcagagtgtaccactacagaatcaacaccgccagcgacggcaagctgtacgtgagcagcgagagcagattcaacaccctggccgagctggtgcaccaccacagcaccgtggccgacggcctgatcaccaccctgcactaccccgcccccaagagaaacaagcccaccgtgtacggcgtgagccccaactacgacaagtgggagatggagagaaccgacatcaccatgaagcacaagctgggcggcggccagtacggcgaggtgtacgagggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccagagagccccccttctacatcatcaccgagttcatgacctacggcaacctgctggactacctgagagagtgcaacagacaggaggtgaacgccgtggtgctgctgtacatggccacccagatcagcagcgccatggagtacctggagaagaagaacttcatccacagagacctggccgccagaaactgcctggtgggcgagaaccacctggtgaaggtggccgacttcggcctgagcagactgatgaccggcgacacctacaccgcccacgccggcgccaagttccccatcaagtggaccgcccccgagagcctggcctacaacaagttcagcatcaagagcgacgtgtgggccttcggcgtgctgctgtgggagatcgccacctacggcatgagcccctaccccggcatcgacctgagccaggtgtacgagctgctggagaaggactacagaatggagagacccgagggctgccccgagaaggtgtacgagctgatgagagcctgctggcagtggaaccccagcgacagacccagcttcgccgagatccaccaggccttcgagaccatgttccaggagagcagcatcagcgacgaggtggagaaggagctgggcaagcagggcgtgagaggcgccgtgagcaccctgctgcaggcccccgagctgcccaccaagaccagaaccagcagaagagccgccgagcacagagacaccaccgacgtgcccgagatgccccacagcaagggccagggcgagagcgaccccctggaccacgagcccgccgtgagccccctgctgcccagaaaggagagaggcccccccgagggcggcctgaacgaggacgagagactgctgcccaaggacaagaagaccaacctgttcagcgccctgatcaagaagaagaagaagaccgcccccaccccccccaagagaagcagcagcttcagagagatggacggccagcccgagagaagaggcgccggcgaggaggagggcagagacatcagcaacggcgccctggccttcacccccctggacaccgccgaccccgccaagagccccaagcccagcaacggcgccggcgtgcccaacggcgccctgagagagagcggcggcagcggcttcagaagcccccacctgtggaagaagagcagcaccctgaccagcagcagactggccaccggcgaggaggagggcggcggcagcagcagcaagagattcctgagaagctgcagcgccagctgcgtgccccacggcgccaaggacaccgagtggagaagcgtgaccctgcccagagacctgcagagcaccggcagacagttcgacagcagcaccttcggcggccacaagagcgagaagcccgccctgcccagaaagagagccggcgagaacagaagcgaccaggtgaccagaggcaccgtgacccccccccccagactggtgaagaagaacgaggaggccgccgacgaggtgttcaaggacatcatggagagcagccccggcagcagcccccccaacctgacccccaagcccctgagaagacaggtgaccgtggcccccgccagcggcctgccccacaaggaggaggccggcaagggcagcgccctgggcacccccgccgccgccgagcccgtgacccccaccagcaaggccggcagcggcgcccccggcggcaccagcaagggccccgccgaggagagcagagtgagaagacacaagcacagcagcgagagccccggcagagacaagggcaagctgagcagactgaagcccgcccccccccccccccccgccgccagcgccggcaaggccggcggcaagcccagccagagccccagccaggaggccgccggcgaggccgtgctgggcgccaagaccaaggccaccagcctggtggacgccgtgaacagcgacgccgccaagcccagccagcccggcgagggcctgaagaagcccgtgctgcccgccacccccaagccccagagcgccaagcccagcggcacccccatcagccccgcccccgtgcccagcaccctgcccagcgccagcagcgccctggccggcgaccagcccagcagcaccgccttcatccccctgatcagcaccagagtgagcctgagaaagaccagacagccccccgagagaatcgccagcggcgccatcaccaagggcgtggtgctggacagcaccgaggccctgtgcctggccatcagcagaaacagcgagcagatggccagccacagcgccgtgctggaggccggcaagaacctgtacaccttctgcgtgagctacgtggacagcatccagcagatgagaaacaagttcgccttcagagaggccatcaacaagctggagaacaacctgagagagctgcagatctgccccgccaccgccggcagcggccccgccgccacccaggacttcagcaagctgctgagcagcgtgaaggagatcagcgacatcgtgcagagatag

SEQ ID NO: 9699 - DNA, 3450 bp, Artificial Sequence
  Description of Artificial Sequence: Synthetic coding sequence
atgggccagcagcccggcaaggtgctgggcgaccagagaagacccagcctgcccgccctgcacttcatcaagggcgccggcaagaaggagagcagcagacacggcggcccccactgcaacgtgttcgtggagcacgaggccctgcagagacccgtggccagcgacttcgagccccagggcctgagcgaggccgccagatggaacagcaaggagaacctgctggccggccccagcgagaacgaccccaacctgttcgtggccctgtacgacttcgtggccagcggcgacaacaccctgagcatcaccaagggcgagaagctgagagtgctgggctacaaccacaacggcgagtggtgcgaggcccagaccaagaacggccagggctgggtgcccagcaactacatcacccccgtgaacagcctggagaagcacagctggtaccacggccccgtgagcagaaacgccgccgagtacctgctgagcagcggcatcaacggcagcttcctggtgagagagagcgagagcagccccggccagagaagcatcagcctgagatacgagggcagagtgtaccactacagaatcaacaccgccagcgacggcaagctgtacgtgagcagcgagagcagattcaacaccctggccgagctggtgcaccaccacagcaccgtggccgacggcctgatcaccaccctgcactaccccgcccccaagagaaacaagcccaccgtgtacggcgtgagccccaactacgacaagtgggagatggagagaaccgacatcaccatgaagcacaagctgggcggcggccagtacggcgaggtgtacgagggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccagagagccccccttctacatcatcaccgagttcatgacctacggcaacctgctggactacctgagagagtgcaacagacaggaggtgaacgccgtggtgctgctgtacatggccacccagatcagcagcgccatggagtacctggagaagaagaacttcatccacagagacctggccgccagaaactgcctggtgggcgagaaccacctggtgaaggtggccgacttcggcctgagcagactgatgaccggcgacacctacaccgcccacgccggcgccaagttccccatcaagtggaccgcccccgagagcctggcctacaacaagttcagcatcaagagcgacgtgtgggccttcggcgtgctgctgtgggagatcgccacctacggcatgagcccctaccccggcatcgacctgagccaggtgtacgagctgctggagaaggactacagaatggagagacccgagggctgccccgagaaggtgtacgagctgatgagagcctgctggcagtggaaccccagcgacagacccagcttcgccgagatccaccaggccttcgagaccatgttccaggagagcagcatcagcgacgaggtggagaaggagctgggcaagcagggcgtgagaggcgccgtgagcaccctgctgcaggcccccgagctgcccaccaagaccagaaccagcagaagagccgccgagcacagagacaccaccgacgtgcccgagatgccccacagcaagggccagggcgagagcgaccccctggaccacgagcccgccgtgagccccctgctgcccagaaaggagagaggcccccccgagggcggcctgaacgaggacgagagactgctgcccaaggacaagaagaccaacctgttcagcgccctgatcaagaagaagaagaagaccgcccccaccccccccaagagaagcagcagcttcagagagatggacggccagcccgagagaagaggcgccggcgaggaggagggcagagacatcagcaacggcgccctggccttcacccccctggacaccgccgaccccgccaagagccccaagcccagcaacggcgccggcgtgcccaacggcgccctgagagagagcggcggcagcggcttcagaagcccccacctgtggaagaagagcagcaccctgaccagcagcagactggccaccggcgaggaggagggcggcggcagcagcagcaagagattcctgagaagctgcagcgccagctgcgtgccccacggcgccaaggacaccgagtggagaagcgtgaccctgcccagagacctgcagagcaccggcagacagttcgacagcagcaccttcggcggccacaagagcgagaagcccgccctgcccagaaagagagccggcgagaacagaagcgaccaggtgaccagaggcaccgtgacccccccccccagactggtgaagaagaacgaggaggccgccgacgaggtgttcaaggacatcatggagagcagccccggcagcagcccccccaacctgacccccaagcccctgagaagacaggtgaccgtggcccccgccagcggcctgccccacaaggaggaggccggcaagggcagcgccctgggcacccccgccgccgccgagcccgtgacccccaccagcaaggccggcagcggcgcccccggcggcaccagcaagggccccgccgaggagagcagagtgagaagacacaagcacagcagcgagagccccggcagagacaagggcaagctgagcagactgaagcccgcccccccccccccccccgccgccagcgccggcaaggccggcggcaagcccagccagagccccagccaggaggccgccggcgaggccgtgctgggcgccaagaccaaggccaccagcctggtggacgccgtgaacagcgacgccgccaagcccagccagcccggcgagggcctgaagaagcccgtgctgcccgccacccccaagccccagagcgccaagcccagcggcacccccatcagccccgcccccgtgcccagcaccctgcccagcgccagcagcgccctggccggcgaccagcccagcagcaccgccttcatccccctgatcagcaccagagtgagcctgagaaagaccagacagccccccgagagaatcgccagcggcgccatcaccaagggcgtggtgctggacagcaccgaggccctgtgcctggccatcagcagaaacagcgagcagatggccagccacagcgccgtgctggaggccggcaagaacctgtacaccttctgcgtgagctacgtggacagcatccagcagatgagaaacaagttcgccttcagagaggccatcaacaagctggagaacaacctgagagagctgcagatctgccccgccaccgccggcagcggccccgccgccacccaggacttcagcaagctgctgagcagcgtgaaggagatcagcgacatcgtgcagagatag

SEQ ID NO: 9700 - DNA, 195 bp, Artificial Sequence
  Description of Artificial Sequence: Synthetic coding sequence
atgggccagcagcccggcaaggtgctgggcgaccagagaagacccagcctgcccgccctgcacttcatcaagggcgccggcaagaaggagagcagcagacacggcggcccccactgcaacgtgttcgtggagcaggccctgcagagacccgtggccagcgacttcgagccccagggcctgagcgaggccgcctag

SEQ ID NO: 9701 - DNA, 486 bp, Artificial Sequence
  Description of Artificial Sequence: Synthetic coding sequence
ggcagacccggcagaagcagagccagaggcggcggcgagggcggctggagaggcggcggcagagccggcagagccggccccgagcccggccccagagccggcagaggcgtgcccgcccccgactgctggagaggcaagatgctggagatctgcctgaagctggtgggctgcaagagcaagaagggcctgagcagcagcagcagctgctacctggaggaggccctgcagagacccgtggccagcgacttcgagccccagggcctgagcgaggccgccagatggaacagcaaggagaacctgctggccggccccagcgagaacgaccccaacctgttcgtggccctgtacgacttcgtggccagcggcgacaacaccctgagcatcaccaagggcgagaagctgagagtgctgggctacaaccacaacggcgagtggtgcgaggcccagaccaagaacggccagggctgggtgcccagcaactactag

SEQ ID NO: 9702 - DNA, 2838 bp, Artificial Sequence
  Description of Artificial Sequence: Synthetic coding sequence
ctgagactgctgagagagcccctgcagcaccccggcagagtgggcagcagcagcttcaacggcggcagaagagcccaccaccacgcccccctgagcagccccaaggcccagcaggcccactgcctgtggtgcgtgccccagctgagacaggtgggcgacggcacccacggccaccaccacgaggcccagggcggcggccagtacggcgaggtgtacgagggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccagagagccccccttctacatcatcaccgagttcatgacctacggcaacctgctggactacctgagagagtgcaacagacaggaggtgaacgccgtggtgctgctgtacatggccacccagatcagcagcgccatggagtacctggagaagaagaacttcatccacagagacctggccgccagaaactgcctggtgggcgagaaccacctggtgaaggtggccgacttcggcctgagcagactgatgaccggcgacacctacaccgcccacgccggcgccaagttccccatcaagtggaccgcccccgagagcctggcctacaacaagttcagcatcaagagcgacgtgtgggccttcggcgtgctgctgtgggagatcgccacctacggcatgagcccctaccccggcatcgacctgagccaggtgtacgagctgctggagaaggactacagaatggagagacccgagggctgccccgagaaggtgtacgagctgatgagagcctgctggcagtggaaccccagcgacagacccagcttcgccgagatccaccaggccttcgagaccatgttccaggagagcagcatcagcgacgaggtggagaaggagctgggcaagcagggcgtgagaggcgccgtgagcaccctgctgcaggcccccgagctgcccaccaagaccagaaccagcagaagagccgccgagcacagagacaccaccgacgtgcccgagatgccccacagcaagggccagggcgagagcgaccccctggaccacgagcccgccgtgagccccctgctgcccagaaaggagagaggcccccccgagggcggcctgaacgaggacgagagactgctgcccaaggacaagaagaccaacctgttcagcgccctgatcaagaagaagaagaagaccgcccccaccccccccaagagaagcagcagcttcagagagatggacggccagcccgagagaagaggcgccggcgaggaggagggcagagacatcagcaacggcgccctggccttcacccccctggacaccgccgaccccgccaagagccccaagcccagcaacggcgccggcgtgcccaacggcgccctgagagagagcggcggcagcggcttcagaagcccccacctgtggaagaagagcagcaccctgaccagcagcagactggccaccggcgaggaggagggcggcggcagcagcagcaagagattcctgagaagctgcagcgccagctgcgtgccccacggcgccaaggacaccgagtggagaagcgtgaccctgcccagagacctgcagagcaccggcagacagttcgacagcagcaccttcggcggccacaagagcgagaagcccgccctgcccagaaagagagccggcgagaacagaagcgaccaggtgaccagaggcaccgtgacccccccccccagactggtgaagaagaacgaggaggccgccgacgaggtgttcaaggacatcatggagagcagccccggcagcagcccccccaacctgacccccaagcccctgagaagacaggtgaccgtggcccccgccagcggcctgccccacaaggaggaggccggcaagggcagcgccctgggcacccccgccgccgccgagcccgtgacccccaccagcaaggccggcagcggcgcccccggcggcaccagcaagggccccgccgaggagagcagagtgagaagacacaagcacagcagcgagagccccggcagagacaagggcaagctgagcagactgaagcccgcccccccccccccccccgccgccagcgccggcaaggccggcggcaagcccagccagagccccagccaggaggccgccggcgaggccgtgctgggcgccaagaccaaggccaccagcctggtggacgccgtgaacagcgacgccgccaagcccagccagcccggcgagggcctgaagaagcccgtgctgcccgccacccccaagccccagagcgccaagcccagcggcacccccatcagccccgcccccgtgcccagcaccctgcccagcgccagcagcgccctggccggcgaccagcccagcagcaccgccttcatccccctgatcagcaccagagtgagcctgagaaagaccagacagccccccgagagaatcgccagcggcgccatcaccaagggcgtggtgctggacagcaccgaggccctgtgcctggccatcagcagaaacagcgagcagatggccagccacagcgccgtgctggaggccggcaagaacctgtacaccttctgcgtgagctacgtggacagcatccagcagatgagaaacaagttcgccttcagagaggccatcaacaagctggagaacaacctgagagagctgcagatctgccccgccaccgccggcagcggccccgccgccacccaggacttcagcaagctgctgagcagcgtgaaggagatcagcgacatcgtgcagagatag

SEQ ID NO: 9703 - DNA, 2649 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccacctacaagggccaggtgcccgagaacgaggccaacgtggtgatcaccaccctgaaggtgaccgacgccgacgcccccaacacccccgcctgggaggccgtgtacaccatcctgaacgacgacggcggccagttcgtggtgaccaccaaccccgtgaacaacgacggcatcctgaagaccgccaagggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacaccagccccttcaccgccgagctgacccacggcgccagcgccaactggaccatccagtacaacgaccccacccaggagagcatcatcctgaagcccaagatggccctggaggtgggcgactacaagatcaacctgaagctgatggacaaccagaacaaggaccaggtgaccaccctggaggtgagcgtgtgcgactgcgagggcgccgccggcgtgtgcagaaaggcccagcccgtggaggccggcctgcagatccccgccatcctgggcatcctgggcggcatcctggccctgctgatcctgatcctgctgctgctgctgttcctgagaagaagagccgtggtgaaggagcccctgctgccccccgaggacgacaccagagacaacgtgtactactacgacgaggagggcggcggcgaggaggaccaggacttcgacctgagccagctgcacagaggcctggacgccagacccgaggtgaccagaaacgacgtggcccccaccctgatgagcgtgcccagatacctgcccagacccgccaaccccgacgagatcggcaacttcatcgacgagaacctgaaggccgccgacaccgaccccaccgcccccccctacgacagcctgctggtgttcgactacgagggcagcggcagcgaggccgccagcctgagcagcctgaacagcagcgagagcgacaaggaccaggactacgactacctgaacgagtggggcaacagattcaagaagctggccgacatgtacggcggcggcgaggacgactag

SEQ ID NO: 9704 - DNA, 1944 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccacctacaagggccaggtgcccgagaacgaggccaacgtggtgatcaccaccctgaaggtgaccgacgccgacgcccccaacacccccgcctgggaggccgtgtacaccatcctgaacgacgacggcggccagttcgtggtgaccaccaaccccgtgaacaacgacggcatcctgaagaccgccaagggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacctggccagccagagcatcggcatcaccgacatgagccactgcacctgccccgccccccagctgcccgccatcttctag

SEQ ID NO: 9705 - DNA, 2703 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccacctacaagggccaggtgcccgagaacgaggccaacgtggtgatcaccaccctgaaggtgaccgacgccgacgcccccaacacccccgcctgggaggccgtgtacaccatcctgaacgacgacggcggccagttcgtggtgaccaccaaccccgtgaacaacgacggcatcctgaagaccgccaagctggccagatgcagaaactggcacccccacagctgcagctacccctgccccctgggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacaccagccccttcaccgccgagctgacccacggcgccagcgccaactggaccatccagtacaacgaccccacccaggagagcatcatcctgaagcccaagatggccctggaggtgggcgactacaagatcaacctgaagctgatggacaaccagaacaaggaccaggtgaccaccctggaggtgagcgtgtgcgactgcgagggcgccgccggcgtgtgcagaaaggcccagcccgtggaggccggcctgcagatccccgccatcctgggcatcctgggcggcatcctggccctgctgatcctgatcctgctgctgctgctgttcctgagaagaagagccgtggtgaaggagcccctgctgccccccgaggacgacaccagagacaacgtgtactactacgacgaggagggcggcggcgaggaggaccaggacttcgacctgagccagctgcacagaggcctggacgccagacccgaggtgaccagaaacgacgtggcccccaccctgatgagcgtgcccagatacctgcccagacccgccaaccccgacgagatcggcaacttcatcgacgagaacctgaaggccgccgacaccgaccccaccgcccccccctacgacagcctgctggtgttcgactacgagggcagcggcagcgaggccgccagcctgagcagcctgaacagcagcgagagcgacaaggaccaggactacgactacctgaacgagtggggcaacagattcaagaagctggccgacatgtacggcggcggcgaggacgactag

SEQ ID NO: 9706 - DNA, 2466 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccaccggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacaccagccccttcaccgccgagctgacccacggcgccagcgccaactggaccatccagtacaacgaccccacccaggagagcatcatcctgaagcccaagatggccctggaggtgggcgactacaagatcaacctgaagctgatggacaaccagaacaaggaccaggtgaccaccctggaggtgagcgtgtgcgactgcgagggcgccgccggcgtgtgcagaaaggcccagcccgtggaggccggcctgcagatccccgccatcctgggcatcctgggcggcatcctggccctgctgatcctgatcctgctgctgctgctgttcctgagaagaagagccgtggtgaaggagcccctgctgccccccgaggacgacaccagagacaacgtgtactactacgacgaggagggcggcggcgaggaggaccaggacttcgacctgagccagctgcacagaggcctggacgccagacccgaggtgaccagaaacgacgtggcccccaccctgatgagcgtgcccagatacctgcccagacccgccaaccccgacgagatcggcaacttcatcgacgagaacctgaaggccgccgacaccgaccccaccgcccccccctacgacagcctgctggtgttcgactacgagggcagcggcagcgaggccgccagcctgagcagcctgaacagcagcgagagcgacaaggaccaggactacgactacctgaacgagtggggcaacagattcaagaagctggccgacatgtacggcggcggcgaggacgactag

SEQ ID NO: 9707 - DNA, 2391 bp, Artificial Sequence
  Description of Artificial Sequence: Synthetic coding sequence
atgaaggagaactactgcctgcaggccgccctggtgtgcctgggcatgctgtgccacagccacgccttcgcccccgagagaagaggccacctgagacccagcttccacggccaccacgagaagggcaaggagggccaggtgctgcagagaagcaagagaggctgggtgtggaaccagttcttcgtgatcgaggagtacaccggccccgaccccgtgctggtgggcagactgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagacccctggagccccccagcgagttcatcgtgaaggtgcaggacatcaacgacaacccccccgagttcctgcacgagacctaccacgccaacgtgcccgagagaagcaacgtgggcaccagcgtgatccaggtgaccgccagcgacgccgacgaccccacctacggcaacagcgccaagctggtgtacagcatcctggagggccagccctacttcagcgtggaggcccagaccggcatcatcagaaccgccctgcccaacatggacagagaggccaaggaggagtaccacgtggtgatccaggccaaggacatgggcggccacatgggcggcctgagcggcaccaccaaggtgaccatcaccctgaccgacgtgaacgacaacccccccaagttcccccagagcgtgtaccagatgagcgtgagcgaggccgccgtgcccggcgaggaggtgggcagagtgaaggccaaggaccccgacatcggcgagaacggcctggtgacctacaacatcgtggacggcgacggcatggagagcttcgagatcaccaccgactacgagacccaggagggcgtgatcaagctgaagaagcccgtggacttcgagaccaagagagcctacagcctgaaggtggaggccgccaacgtgcacatcgaccccaagttcatcagcaacggccccttcaaggacaccgtgaccgtgaagatcagcgtggaggacgccgacgagccccccatgttcctggcccccagctacatccacgaggtgcaggagaacgccgccgccggcaccgtggtgggcagagtgcacgccaaggaccccgacgccgccaacagccccatcagatacagcatcgacagacacaccgacctggacagattcttcaccatcaaccccgaggacggcttcatcaagaccaccaagcccctggacagagaggagaccgcctggctgaacatcaccgtgttcgccgccgagatccacaacagacaccaggaggccaaggtgcccgtggccatcagagtgctggacgtgaacgacaacgcccccaagttcgccgccccctacgagggcttcatctgcgagagcgaccagaccaagcccctgagcaaccagcccatcgtgaccatcagcgccgacgacaaggacgacaccgccaacggccccagattcatcttcagcctgccccccgagatcatccacaaccccaacttcaccgtgagagacaacagagacaacaccgccggcgtgtacgccagaagaggcggcttcagcagacagaagcaggacctgtacctgctgcccatcgtgatcagcgacggcggcatcccccccatgagcagcaccaacaccctgaccatcaaggtgtgcggctgcgacgtgaacggcgccctgctgagctgcaacgccgaggcctacatcctgaacgccggcctgagcaccggcgccctgatcgccatcctggcctgcatcgtgatcctgctggtgatcgtggtgctgttcgtgaccctgagaagacagaagaaggagcccctgatcgtgttcgaggaggaggacgtgagagagaacatcatcacctacgacgacgagggcggcggcgaggaggacaccgaggccttcgacatcgccaccctgcagaaccccgacggcatcaacggcttcatccccagaaaggacatcaagcccgagtaccagtacatgcccagacccggcctgagacccgcccccaacagcgtggacgtggacgacttcatcaacaccagaatccaggaggccgacaacgaccccaccgcccccccctacgacagcatccagatctacggctacgagggcagaggcagcgtggccggcagcctgagcagcctggagagcgccaccaccgacagcgacctggactacgactacctgcagaactggggccccagattcaagaagctggccgacctgtacggcagcaaggacaccttcgacgacgacagctag

SEQ ID NO: 9708 - DNA, 2082 bp, Artificial Sequence
  Description of Artificial Sequence: Synthetic coding sequence
atgaaggagaactactgcctgcaggccgccctggtgtgcctgggcatgctgtgccacagccacgccttcgcccccgagagaagaggccacctgagacccagcttccacggccaccacgagaagggcaaggagggccaggtgctgcagagaagcaagagaggctgggtgtggaaccagttcttcgtgatcgaggagtacaccggccccgaccccgtgctggtgggcagactgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagacccctggagccccccagcgagttcatcgtgaaggtgcaggacatcaacgacaacccccccgagttcctgcacgagacctaccacgccaacgtgcccgagagaagcaacgtgggcaccagcgtgatccaggtgaccgccagcgacgccgacgaccccacctacggcaacagcgccaagctggtgtacagcatcctggagggccagccctacttcagcgtggaggcccagaccggcatcatcagaaccgccctgcccaacatggacagagaggccaaggaggagtaccacgtggtgatccaggccaaggacatgggcggccacatgggcggcctgagcggcaccaccaaggtgaccatcaccctgaccgacgtgaacgacaacccccccaagttcccccagagcgtgtaccagatgagcgtgagcgaggccgccgtgcccggcgaggaggtgggcagagtgaaggccaaggaccccgacatcggcgagaacggcctggtgacctacaacatcgtggacggcgacggcatggagagcttcgagatcaccaccgactacgagacccaggagggcgtgatcaagctgaagaagcccgtggacttcgagaccaagagagcctacagcctgaaggtggaggccgccaacgtgcacatcgaccccaagttcatcagcaacggccccttcaaggacaccgtgaccgtgaagatcagcgtggaggacgccgacgagccccccatgttcctggcccccagctacatccacgaggtgcaggagaacgccgccgccggcaccgtggtgggcagagtgcacgccaaggaccccgacgccgccaacagccccatcagatacagcatcgacagacacaccgacctggacagattcttcaccatcaaccccgaggacggcttcatcaagaccaccaagcccctggacagagaggagaccgcctggctgaacatcaccgtgttcgccgccgagatccacaacagacaccaggaggccaaggtgcccgtggccatcagagtgctggacgtgaacgacaacgcccccaagttcgccgccccctacgagggcttcatctgcgagagcgaccagaccaagcccctgagcaaccagcccatcgtgaccatcagcgccgacgacaaggacgacaccgccaacggccccagattcatcttcagcctgccccccgagatcatccacaaccccaacttcaccgtgagagacaacagagacaacaccgccggcgtgtacgccagaagaggcggcttcagcagacagaagcaggacctgtacctgctgcccatcgtgatcagcgacggcggcatcccccccatgagcagcaccaacaccctgaccatcaaggtgtgcggctgcgacgtgaacggcgccctgctgagctgcaacgccgaggcctacatcctgaacgccggcctgagcaccggcgccctgatcgccatcctggcctgcatcgtgatcctgctgggctgccccagcctgatggagccccccagccccagagaggacatgagactgctgtacctgggcttccagctgatgctgttcagctacgtgaaggtgaacagaagattctgcctgctgggcgtgttcatcaagctgcccttcctgtacgtggtggccaccgagagccccaccaccctgaccagcctgtag

SEQ ID NO: 9709 - DNA, 516 bp, Artificial Sequence
  Description of Artificial Sequence: Synthetic coding sequence
atgaaggagaactactgcctgcaggccgccctggtgtgcctgggcatgctgtgccacagccacgccttcgcccccgagagaagaggccacctgagacccagcttccacggccaccacgagaagggcaaggagggccaggtgctgcagagaagcaagagaggctgggtgtggaaccagttcttcgtgatcgaggagtacaccggccccgaccccgtgctggtgggcagactgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagaaacagcctgagcagaagcagaaccctgatgaccaccctgagaagcagctgcaccagacccatcatgcccacctgcctgagaggccccatgtgggtgagaacctag

SEQ ID NO: 9710 - DNA, 2340 bp, Artificial Sequence
  Description of Artificial Sequence: Synthetic coding sequence
atgggccccggcctggccgccagaagactgagaccccccagcagagcccccgagatcaccgtgttcagcgcccagagaccctgcgacatccccagctgctgccacctgctgagcgaccagagcgacggctggagcgtgctgcagaagctggccgccagcatccagtgggtgaagaagctgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagacccctggagccccccagcgagttcatcgtgaaggtgcaggacatcaacgacaacccccccgagttcctgcacgagacctaccacgccaacgtgcccgagagaagcaacgtgggcaccagcgtgatccaggtgaccgccagcgacgccgacgaccccacctacggcaacagcgccaagctggtgtacagcatcctggagggccagccctacttcagcgtggaggcccagaccggcatcatcagaaccgccctgcccaacatggacagagaggccaaggaggagtaccacgtggtgatccaggccaaggacatgggcggccacatgggcggcctgagcggcaccaccaaggtgaccatcaccctgaccgacgtgaacgacaacccccccaagttcccccagagcgtgtaccagatgagcgtgagcgaggccgccgtgcccggcgaggaggtgggcagagtgaaggccaaggaccccgacatcggcgagaacggcctggtgacctacaacatcgtggacggcgacggcatggagagcttcgagatcaccaccgactacgagacccaggagggcgtgatcaagctgaagaagcccgtggacttcgagaccaagagagcctacagcctgaaggtggaggccgccaacgtgcacatcgaccccaagttcatcagcaacggccccttcaaggacaccgtgaccgtgaagatcagcgtggaggacgccgacgagccccccatgttcctggcccccagctacatccacgaggtgcaggagaacgccgccgccggcaccgtggtgggcagagtgcacgccaaggaccccgacgccgccaacagccccatcagatacagcatcgacagacacaccgacctggacagattcttcaccatcaaccccgaggacggcttcatcaagaccaccaagcccctggacagagaggagaccgcctggctgaacatcaccgtgttcgccgccgagatccacaacagacaccaggaggccaaggtgcccgtggccatcagagtgctggacgtgaacgacaacgcccccaagttcgccgccccctacgagggcttcatctgcgagagcgaccagaccaagcccctgagcaaccagcccatcgtgaccatcagcgccgacgacaaggacgacaccgccaacggccccagattcatcttcagcctgccccccgagatcatccacaaccccaacttcaccgtgagagacaacagagacaacaccgccggcgtgtacgccagaagaggcggcttcagcagacagaagcaggacctgtacctgctgcccatcgtgatcagcgacggcggcatcccccccatgagcagcaccaacaccctgaccatcaaggtgtgcggctgcgacgtgaacggcgccctgctgagctgcaacgccgaggcctacatcctgaacgccggcctgagcaccggcgccctgatcgccatcctggcctgcatcgtgatcctgctggtgatcgtggtgctgttcgtgaccctgagaagacagaagaaggagcccctgatcgtgttcgaggaggaggacgtgagagagaacatcatcacctacgacgacgagggcggcggcgaggaggacaccgaggccttcgacatcgccaccctgcagaaccccgacggcatcaacggcttcatccccagaaaggacatcaagcccgagtaccagtacatgcccagacccggcctgagacccgcccccaacagcgtggacgtggacgacttcatcaacaccagaatccaggaggccgacaacgaccccaccgcccccccctacgacagcatccagatctacggctacgagggcagaggcagcgtggccggcagcctgagcagcctggagagcgccaccaccgacagcgacctggactacgactacctgcagaactggggccccagattcaagaagctggccgacctgtacggcagcaaggacaccttcgacgacgacagctag

SEQ ID NO: 9711 - DNA, 528 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaagatgaagatctggcaggtgctgtgcctggccagatggctgacctag

SEQ ID NO: 9712 - DNA, 2142 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcctgtag

SEQ ID NO: 9713 - DNA, 2283 bp, Artificial Sequence
  Description of Artificial Sequence: Synthetic coding sequence
atgaagaccccccccggcgccagcagcagaaccaagtgcagcagagagctgagaagcttctgcgccttcagctgccccagagccaagcagcccacctgcaccgcctggttcccccagcaggagcaccccagcgagaacggcccccagatgcccggcagagacccccccgccgccagcaccatgcaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9714 - DNA, 2142 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9715 - DNA, 573 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaagagaacccacaaccccatcaacagcgagctgctgctgaacgagggcatcaccgccgacctgaacccctgcatcaccatcctggccatctag

SEQ ID NO: 9716 - DNA, 528 bp, Artificial Sequence; identical to SEQ ID NO: 9711
  Description of Artificial Sequence: Synthetic coding sequence

SEQ ID NO: 9717 - DNA, 2025 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9718 - DNA, 1248 bp, Artificial Sequence
  Description of Artificial Sequence: Synthetic coding sequence
atgcagcccagaacccccctggtgctgtgcgtgctgctgagccaggtggccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9719 - DNA, 819 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9720 - DNA, 1212 bp, Artificial Sequence
  Description of Artificial Sequence: Synthetic coding sequence
gtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcctgtag

SEQ ID NO: 9721 - DNA, 2721 bp, Artificial Sequence
  Description of Artificial Sequence: Synthetic coding sequence
atgtgcagaatcgccggcgccctgagaaccctgctgcccctgctggccgccctgctgcaggccagcgtggaggccagcggcgagatcgccctgtgcaagaccggcttccccgaggacgtgtacagcgccgtgctgagcaaggacgtgcacgagggccagcccctgctgaacgtgaagttcagcaactgcaacggcaagagaaaggtgcagtacgagagcagcgagcccgccgacttcaaggtggacgaggacggcatggtgtacgccgtgagaagcttccccctgagcagcgagcacgccaagttcctgatctacgcccaggacaaggagacccaggagaagtggcaggtggccgtgaagctgagcctgaagcccaccctgaccgaggagagcgtgaaggagagcgccgaggtggaggagatcgtgttccccagacagttcagcaagcacagcggccacctgcagagacagaagagagactgggtgatcccccccatcaacctgcccgagaacagcagaggccccttcccccaggagctggtgagaatcagaagcgacagagacaagaacctgagcctgagatacagcgtgaccggccccggcgccgaccagccccccaccggcatcttcatcatcaaccccatcagcggccagctgagcgtgaccaagcccctggacagagagcagatcgccagattccacctgagagcccacgccgtggacatcaacggcaaccaggtggagaaccccatcgacatcgtgatcaacgtgatcgacatgaacgacaacagacccgagttcctgcaccaggtgtggaacggcaccgtgcccgagggcagcaagcccggcacctacgtgatgaccgtgaccgccatcgacgccgacgaccccaacgccctgaacggcatgctgagatacagaatcgtgagccaggcccccagcacccccagccccaacatgttcaccatcaacaacgagaccggcgacatcatcaccgtggccgccggcctggacagagagaaggtgcagcagtacaccctgatcatccaggccaccgacatggagggcaaccccacctacggcctgagcaacaccgccaccgccgtgatcaccgtgaccgacgtgaacgacaacccccccgagttcaccgccatgaccttctacggcgaggtgcccgagaacagagtggacatcatcgtggccaacctgaccgtgaccgacaaggaccagccccacacccccgcctggaacgccgtgtacagaatcagcggcggcgaccccaccggcagattcgccatccagaccgaccccaacagcaacgacggcctggtgaccgtggtgaagcccatcgacttcgagaccaacagaatgttcgtgctgaccgtggccgccgagaaccaggtgcccctggccaagggcatccagcaccccccccagagcaccgccaccgtgagcgtgaccgtgatcgacgtgaacgagaacccctacttcgcccccaaccccaagatcatcagacaggaggagggcctgcacgccggcaccatgctgaccaccttcaccgcccaggaccccgacagatacatgcagcagaacatcagatacaccaagctgagcgaccccgccaactggctgaagatcgaccccgtgaacggccagatcaccaccatcgccgtgctggacagagagagccccaacgtgaagaacaacatctacaacgccaccttcctggccagcgacaacggcatcccccccatgagcggcaccggcaccctgcagatctacctgctggacatcaacgacaacgccccccaggtgctgccccaggaggccgagacctgcgagacccccgaccccaacagcatcaacatcaccgccctggactacgacatcgaccccaacgccggccccttcgccttcgacctgcccctgagccccgtgaccatcaagagaaactggaccatcaccagactgaacggcgacttcgcccagctgaacctgaagatcaagttcctggaggccggcatctacgaggtgcccatcatcatcaccgacagcggcaacccccccaagagcaacatcagcatcctgagagtgaaggtgtgccagtgcgacagcaacggcgactgcaccgacgtggacagaatcgtgggcgccggcctgggcaccggcgccatcatcgccatcctgctgtgcatcatcatcctgctgatcctggtgctgatgttcgtggtgtggatgaagagaagagacaaggagagacaggccaagcagctgctgatcgaccccgaggacgacgtgagagacaacatcctgaagtacgacgaggagggcggcggcgaggaggaccaggactacgacctgagccagctgcagcagcccgacaccgtggagcccgacgccatcaagcccgtgggcatcagaagaatggacgagagacccatccacgccgagccccagtaccccgtgagaagcgccgccccccaccccggcgacatcggcgacttcatcaacgagggcctgaaggccgccgacaacgaccccaccgcccccccctacgacagcctgctggtgttcgactacgagggcagcggcagcaccgccggcagcctgagcagcctgaacagcagcagcagcggcggcgagcaggactacgactacctgaacgactggggccccagattcaagaagctggccgacatgtacggcggcggcgacgactag

SEQ ID NO: 9722 - DNA, 2628 bp, Artificial Sequence
  Description of Artificial Sequence: Synthetic coding sequence
atgttcctgctgagaagatacgtgtgcatcttcaccgagaagctgaagaaccaggccgagctgtacgtgttcctgagcgtgaagttcagcaactgcaacggcaagagaaaggtgcagtacgagagcagcgagcccgccgacttcaaggtggacgaggacggcatggtgtacgccgtgagaagcttccccctgagcagcgagcacgccaagttcctgatctacgcccaggacaaggagacccaggagaagtggcaggtggccgtgaagctgagcctgaagcccaccctgaccgaggagagcgtgaaggagagcgccgaggtggaggagatcgtgttccccagacagttcagcaagcacagcggccacctgcagagacagaagagagactgggtgatcccccccatcaacctgcccgagaacagcagaggccccttcccccaggagctggtgagaatcagaagcgacagagacaagaacctgagcctgagatacagcgtgaccggccccggcgccgaccagccccccaccggcatcttcatcatcaaccccatcagcggccagctgagcgtgaccaagcccctggacagagagcagatcgccagattccacctgagagcccacgccgtggacatcaacggcaaccaggtggagaaccccatcgacatcgtgatcaacgtgatcgacatgaacgacaacagacccgagttcctgcaccaggtgtggaacggcaccgtgcccgagggcagcaagcccggcacctacgtgatgaccgtgaccgccatcgacgccgacgaccccaacgccctgaacggcatgctgagatacagaatcgtgagccaggcccccagcacccccagccccaacatgttcaccatcaacaacgagaccggcgacatcatcaccgtggccgccggcctggacagagagaaggtgcagcagtacaccctgatcatccaggccaccgacatggagggcaaccccacctacggcctgagcaacaccgccaccgccgtgatcaccgtgaccgacgtgaacgacaacccccccgagttcaccgccatgaccttctacggcgaggtgcccgagaacagagtggacatcatcgtggccaacctgaccgtgaccgacaaggaccagccccacacccccgcctggaacgccgtgtacagaatcagcggcggcgaccccaccggcagattcgccatccagaccgaccccaacagcaacgacggcctggtgaccgtggtgaagcccatcgacttcgagaccaacagaatgttcgtgctgaccgtggccgccgagaaccaggtgcccctggccaagggcatccagcaccccccccagagcaccgccaccgtgagcgtgaccgtgatcgacgtgaacgagaacccctacttcgcccccaaccccaagatcatcagacaggaggagggcctgcacgccggcaccatgctgaccaccttcaccgcccaggaccccgacagatacatgcagcagaacatcagatacaccaagctgagcgaccccgccaactggctgaagatcgaccccgtgaacggccagatcaccaccatcgccgtgctggacagagagagccccaacgtgaagaacaacatctacaacgccaccttcctggccagcgacaacggcatcccccccatgagcggcaccggcaccctgcagatctacctgctggacatcaacgacaacgccccccaggtgctgccccaggaggccgagacctgcgagacccccgaccccaacagcatcaacatcaccgccctggactacgacatcgaccccaacgccggccccttcgccttcgacctgcccctgagccccgtgaccatcaagagaaactggaccatcaccagactgaacggcgacttcgcccagctgaacctgaagatcaagttcctggaggccggcatctacgaggtgcccatcatcatcaccgacagcggcaacccccccaagagcaacatcagcatcctgagagtgaaggtgtgccagtgcgacagcaacggcgactgcaccgacgtggacagaatcgtgggcgccggcctgggcaccggcgccatcatcgccatcctgctgtgcatcatcatcctgctgatcctggtgctgatgttcgtggtgtggatgaagagaagagacaaggagagacaggccaagcagctgctgatcgaccccgaggacgacgtgagagacaacatcctgaagtacgacgaggagggcggcggcgaggaggaccaggactacgacctgagccagctgcagcagcccgacaccgtggagcccgacgccatcaagcccgtgggcatcagaagaatggacgagagacccatccacgccgagccccagtaccccgtgagaagcgccgccccccaccccggcgacatcggcgacttcatcaacgagggcctgaaggccgccgacaacgaccccaccgcccccccctacgacagcctgctggtgttcgactacgagggcagcggcagcaccgccggcagcctgagcagcctgaacagcagcagcagcggcggcgagcaggactacgactacctgaacgactggggccccagattcaagaagctggccgacatgtacggcggcggcgacgactag

SEQ ID NO: 9723 - DNA, 2355 bp, Artificial Sequence
  Description of Artificial Sequence: Synthetic coding sequence
atgcagagactgatgatgctgctggccaccagcggcgcctgcctgggcctgctggccgtggccgccgtggccgccgccggcgccaaccccgcccagagagacacccacagcctgctgcccacccacagaagacagaagagagactggatctggaaccagatgcacatcgacgaggagaagaacaccagcctgccccaccacgtgggcaagatcaagagcagcgtgagcagaaagaacgccaagtacctgctgaagggcgagtacgtgggcaaggtgttcagagtggacgccgagaccggcgacgtgttcgccatcgagagactggacagagagaacatcagcgagtaccacctgaccgccgtgatcgtggacaaggacaccggcgagaacctggagacccccagcagcttcaccatcaaggtgcacgacgtgaacgacaactggcccgtgttcacccacagactgttcaacgccagcgtgcccgagagcagcgccgtgggcaccagcgtgatcagcgtgaccgccgtggacgccgacgaccccaccgtgggcgaccacgccagcgtgatgtaccagatcctgaagggcaaggagtacttcgccatcgacaacagcggcagaatcatcaccatcaccaagagcctggacagagagaagcaggccagatacgagatcgtggtggaggccagagacgcccagggcctgagaggcgacagcggcaccgccaccgtgctggtgaccctgcaggacatcaacgacaacttccccttcttcacccagaccaagtacaccttcgtggtgcccgaggacaccagagtgggcaccagcgtgggcagcctgttcgtggaggaccccgacgagccccagaacagaatgaccaagtacagcatcctgagaggcgactaccaggacgccttcaccatcgagaccaaccccgcccacaacgagggcatcatcaagcccatgaagcccctggactacgagtacatccagcagtacagcttcatcgtggaggccaccgaccccaccatcgacctgagatacatgagcccccccgccggcaacagagcccaggtgatcatcaacatcaccgacgtggacgagccccccatcttccagcagcccttctaccacttccagctgaaggagaaccagaagaagcccctgatcggcaccgtgctggccatggaccccgacgccgccagacacagcatcggctacagcatcagaagaaccagcgacaagggccagttcttcagagtgaccaagaagggcgacatctacaacgagaaggagctggacagagaggtgtacccctggtacaacctgaccgtggaggccaaggagctggacagcaccggcacccccaccggcaaggagagcatcgtgcaggtgcacatcgaggtgctggacgagaacgacaacgcccccgagttcgccaagccctaccagcccaaggtgtgcgagaacgccgtgcacggccagctggtgctgcagatcagcgccatcgacaaggacatcacccccagaaacgtgaagttcaagttcatcctgaacaccgagaacaacttcaccctgaccgacaaccacgacaacaccgccaacatcaccgtgaagtacggccagttcgacagagagcacaccaaggtgcacttcctgcccgtggtgatcagcgacaacggcatgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9724 - DNA, 2010 bp, Artificial Sequence
  Description of Artificial Sequence: Synthetic coding sequence
atgcagagactgatgatgctgctggccaccagcggcgcctgcctgggcctgctggccgtggccgccgtggccgccgccggcgccaaccccgcccagagagacacccacagcctgctgcccacccacagaagacagaagagagactggatctggaaccagatgcacatcgacgaggagaagaacaccagcctgccccaccacgtgggcaagatcaagagcagcgtgagcagaaagaacgccaagtacctgctgaagggcgagtacgtgggcaaggtgttcagagtggacgccgagaccggcgacgtgttcgccatcgagagactggacagagagaacatcagcgagtaccacctgaccgccgtgatcgtggacaaggacaccggcgagaacctggagacccccagcagcttcaccatcaaggtgcacgacgtgaacgacaactggcccgtgttcacccacagactgttcaacgccagcgtgcccgagagcagcgccgtgggcaccagcgtgatcagcgtgaccgccgtggacgccgacgaccccaccgtgggcgaccacgccagcgtgatgtaccagatcctgaagggcaaggagtacttcgccatcgacaacagcggcagaatcatcaccatcaccaagagcctggacagagagaagcaggccagatacgagatcgtggtggaggccagagacgcccagggcctgagaggcgacagcggcaccgccaccgtgctggtgaccctgcaggacatcaacgacaacttccccttcttcacccagaccaagtacaccttcgtggtgcccgaggacaccagagtgggcaccagcgtgggcagcctgttcgtggaggaccccgacgagccccagaacagaatgaccaagtacagcatcctgagaggcgactaccaggacgccttcaccatcgagaccaaccccgcccacaacgagggcatcatcaagcccatgaagcccctggactacgagtacatccagcagtacagcttcatcgtggaggccaccgaccccaccatcgacctgagatacatgagcccccccgccggcaacagagcccaggtgatcatcaacatcaccgacgtggacgagccccccatcttccagcagcccttctaccacttccagctggtgctgcagatcagcgccatcgacaaggacatcacccccagaaacgtgaagttcaagttcatcctgaacaccgagaacaacttcaccctgaccgacaaccacgacaacaccgccaacatcaccgtgaagtacggccagttcgacagagagcacaccaaggtgcacttcctgcccgtggtgatcagcgacaacggcatgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9725 - DNA, 672 bp, Artificial Sequence
  Description of Artificial Sequence: Synthetic coding sequence
atgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9726 - DNA, 1578 bp, Artificial Sequence
  Description of Artificial Sequence: Synthetic coding sequence
atgcccagcacctgcagcaaggagaacatgtgggccagaagcagcggcagcatgcagagacaggagacctgcagccccctgagagcccagaacagaatgaccaagtacagcatcctgagaggcgactaccaggacgccttcaccatcgagaccaaccccgcccacaacgagggcatcatcaagcccatgaagcccctggactacgagtacatccagcagtacagcttcatcgtggaggccaccgaccccaccatcgacctgagatacatgagcccccccgccggcaacagagcccaggtgatcatcaacatcaccgacgtggacgagccccccatcttccagcagcccttctaccacttccagctgaaggagaaccagaagaagcccctgatcggcaccgtgctggccatggaccccgacgccgccagacacagcatcggctacagcatcagaagaaccagcgacaagggccagttcttcagagtgaccaagaagggcgacatctacaacgagaaggagctggacagagaggtgtacccctggtacaacctgaccgtggaggccaaggagctggacagcaccggcacccccaccggcaaggagagcatcgtgcaggtgcacatcgaggtgctggacgagaacgacaacgcccccgagttcgccaagccctaccagcccaaggtgtgcgagaacgccgtgcacggccagctggtgctgcagatcagcgccatcgacaaggacatcacccccagaaacgtgaagttcaagttcatcctgaacaccgagaacaacttcaccctgaccgacaaccacgacaacaccgccaacatcaccgtgaagtacggccagttcgacagagagcacaccaaggtgcacttcctgcccgtggtgatcagcgacaacggcatgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9727 - DNA, 2373 bp, Artificial Sequence
  Description of Artificial Sequence: Synthetic coding sequence
atgagaacctacagatacttcctgctgctgttctgggtgggccagccctaccccaccctgagcacccccctgagcaagagaaccagcggcttccccgccaagaagagagccctggagctgagcggcaacagcaagaacgagctgaacagaagcaagagaagctggatgtggaaccagttcttcctgctggaggagtacaccggcagcgactaccagtacgtgggcaagctgcacagcgaccaggacagaggcgacggcagcctgaagtacatcctgagcggcgacggcgccggcgacctgttcatcatcaacgagaacaccggcgacatccaggccaccaagagactggacagagaggagaagcccgtgtacatcctgagagcccaggccatcaacagaagaaccggcagacccgtggagcccgagagcgagttcatcatcaagatccacgacatcaacgacaacgagcccatcttcaccaaggaggtgtacaccgccaccgtgcccgagatgagcgacgtgggcaccttcgtggtgcaggtgaccgccaccgacgccgacgaccccacctacggcaacagcgccaaggtggtgtacagcatcctgcagggccagccctacttcagcgtggagagcgagaccggcatcatcaagaccgccctgctgaacatggacagagagaacagagagcagtaccaggtggtgatccaggccaaggacatgggcggccagatgggcggcctgagcggcaccaccaccgtgaacatcaccctgaccgacgtgaacgacaacccccccagattcccccagagcacctaccagttcaagacccccgagagcagcccccccggcacccccatcggcagaatcaaggccagcgacgccgacgtgggcgagaacgccgagatcgagtacagcatcaccgacggcgagggcctggacatgttcgacgtgatcaccgaccaggagacccaggagggcatcatcaccgtgaagaagctgctggacttcgagaagaagaaggtgtacaccctgaaggtggaggccagcaacccctacgtggagcccagattcctgtacctgggccccttcaaggacagcgccaccgtgagaatcgtggtggaggacgtggacgagccccccgtgttcagcaagctggcctacatcctgcagatcagagaggacgcccagatcaacaccaccatcggcagcgtgaccgcccaggaccccgacgccgccagaaaccccgtgaagtacagcgtggacagacacaccgacatggacagaatcttcaacatcgacagcggcaacggcagcatcttcaccagcaagctgctggacagagagaccctgctgtggcacaacatcaccgtgatcgccaccgagatcaacaaccccaagcagagcagcagagtgcccctgtacatcaaggtgctggacgtgaacgacaacgcccccgagttcgccgagttctacgagaccttcgtgtgcgagaaggccaaggccgaccagctgatccagaccctgcacgccgtggacaaggacgacccctacagcggccaccagttcagcttcagcctggcccccgaggccgccagcggcagcaacttcaccatccaggacaacaaggacaacaccgccggcatcctgaccagaaagaacggctacaacagacacgagatgagcacctacctgctgcccgtggtgatcagcgacaacgactaccccgtgcagagcagcaccggcaccgtgaccgtgagagtgtgcgcctgcgaccaccacggcaacatgcagagctgccacgccgaggccctgatccaccccaccggcctgagcaccggcgccctggtggccatcctgctgtgcatcgtgatcctgctggtgaccgtggtgctgttcgccgccctgagaagacagagaaagaaggagcccctgatcatcagcaaggaggacatcagagacaacatcgtgagctacaacgacgagggcggcggcgaggaggacacccaggccttcgacatcggcaccctgagaaaccccgaggccatcgaggacaacaagctgagaagagacatcgtgcccgaggccctgttcctgcccagaagaacccccaccgccagagacaacaccgacgtgagagacttcatcaaccagagactgaaggagaacgacaccgaccccaccgcccccccctacgacagcctggccacctacgcctacgagggcaccggcagcgtggccgacagcctgagcagcctggagagcgtgaccaccgacgccgaccaggactacgactacctgagcgactggggccccagattcaagaagctggccgacatgtacggcggcgtggacagcgacaaggacagctag

SEQ ID NO: 9728 - DNA, 576 bp, Artificial Sequence
  Description of Artificial Sequence: Synthetic coding sequence
atgggcggcagcggcagcagactgagcaaggagctgctggccgagtaccaggacctgaccttcctgaccaagcaggagatcctgctggcccacagaagattctgcgagctgctgccccaggagcagagaagcgtggagagcagcctgagagcccaggtgcccttcgagcagatcctgagcctgcccgagctgaaggccaaccccttcaaggagagaatctgcagagtgttcagcaccagccccgccaaggacagcctgagcttcgaggacttcctggacctgctgagcgtgttcagcgacaccgccacccccgacatcaagagccactacgccttcagaatcttcgacttcgacgacgacggcaccctgaacagagaggacctgagcagactggtgaactgcctgaccggcgagggcgaggacaccagactgagcgccagcgagatgaagcagctgatcgacaacatcctggaggagagcgacatcgacagagacggcaccatcaacctgagcgagttccagcacgtgatcagcagaagccccgacttcgccagcagcttcaagatcgtgctgtag

SEQ ID NO: 9729 - DNA, 237 bp, Artificial Sequence
  Description of Artificial Sequence: Synthetic coding sequence
atgagcgaggtgctgccctacggcgacgagaagctgagcccctacggcgacggcggcgacgtgggccagatcttcagctgcagactgcaggacaccaacaacttcttcggcgccggccagaacaagagaccccccaagctgggccagatcggcagaagcaagagagtggtgatcgaggacgacagaatcgacgacgtgctgaagaacatgaccgacaaggccccccccggcgtgtag

SEQ ID NO: 9730 - DNA, 1563 bp, Artificial Sequence
  Description of Artificial Sequence: Synthetic coding sequence
atggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggccctgcagaaccaggcccagaacatccagctggacagcaccaacatcgccaagccccacagcctgctgcccagcgagcagcaggacagcggcagcacctgggccgccagaagcgtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgtag

SEQ ID NO: 9731 - DNA, 1518 bp, Artificial Sequence
  Description of Artificial Sequence: Synthetic coding sequence
atggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgaaggagggcttcggcgagggcggcaagagccccgagctgcccggcgtgcaggaggacgaggccgccagctag

SEQ ID NO: 9732 - DNA, 1599 bp, Artificial Sequence
  Description of Artificial Sequence: Synthetic coding sequence
atgcagttcggcaagctgtggtgcggctgcagcggcgagttccccaccagactgagaagaagaacccccctgaccgaggccatggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgaaggagggcttcggcgagggcggcaagagccccgagctgcccggcgtgcaggaggacgaggccgccagctag

SEQ ID NO: 9733 - DNA, 1632 bp, Artificial Sequence
  Description of Artificial Sequence: Synthetic coding sequence
atggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggccctgcagaaccaggcccagaacatccagctggacagcaccaacatcgccaagccccacagcctgctgcccagcgagcagcaggacagcggcagcacctgggccgccagaagcgtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgaaggagggcttcggcgagggcggcaagagccccgagctgcccggcgtgcaggaggacgaggccgccagctag

SEQ ID NO: 9734 - DNA, 1695 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9735 - DNA, 2382 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccaggtggaggtgatggtggaggagaagaccaccgagagccaggaggagaccgtggtgatgagcctgaagaacggccagatcagcagcgaggagcccaagcaggaggaggagagagagcagggcagcgacgagatcagccaccacgagaagatggaggaggaggacaaggagagagccgaggccgagagagccagactggaggccgaggagagagagagaatcaaggccgagcaggacaagaagatcgccgacgagagagccagaatcgaggccgaggagaaggccgccgcccaggagagagagagaagagaggccgaggagagagagagaatgagagaggaggagaagagagccgccgaggagagacagagaatcaaggaggaggagaagagagccgccgaggagagacagagaatcaaggaggaggagaagagagccgccgaggagagacagagaatcaaggaggaggagaagagagccgccgaggagagacagagagccagagccgaggaggaggagaaggccaaggtggaggagcagaagagaaacaagcagctggaggagaagaagcacgccatgcaggagaccaagatcaagggcgagaaggtggagcagaagatcgagggcaagtgggtgaacgagaagaaggcccaggaggacaagctgcagaccgccgtgctgaagaagcagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9736 - DNA, 1617 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9737 - DNA, 1677 bp, Artificial Sequence
  Description of Artificial Sequence: Synthetic coding sequence
atgctgggcggcagcggcagccacggcagaagaagcctggccgccctgagccagatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9738 - DNA, 1617 bp, Artificial Sequence; identical to SEQ ID NO: 9736
  Description of Artificial Sequence: Synthetic coding sequence

SEQ ID NO: 9739 - DNA, 1692 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9740 - DNA, 1599 bp, Artificial Sequence
  Description of Artificial Sequence: Synthetic coding sequence
atgctgggcggcagcggcagccacggcagaagaagcctggccgccctgagccagatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9741 - DNA, 528 bp, Artificial Sequence
  Description of Artificial Sequence: Synthetic coding sequence
atgcccgaggacggcctgagcgacgacaagaagcccttcaagtgcttcacccccaagggcagcagcctgaagatcgaggagagagccgagttcctgaacaagagcgtgcagaagagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcctgaccttctgcagcagcctgttcggcctgtggctgatcggcaacctgctgctgctgcccagcttcctgcccctgctgcccgagtgggtgttcctgtag

SEQ ID NO: 9742 - DNA, 219 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaactag

SEQ ID NO: 9743 - DNA, 1380 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagctag

SEQ ID NO: 9744 - DNA, 219 bp, Artificial Sequence; identical to SEQ ID NO: 9742
  Description of Artificial Sequence: Synthetic coding sequence

SEQ ID NO: 9745 - DNA, 1632 bp, Artificial Sequence
  Description of Artificial Sequence: Synthetic coding sequence
atgaccagctacatgaaggtggacagacagtggaacgccgagatcctggagctgatcctgggcaccggccagctgagcaccggccagatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9746 - DNA, 3975 bp, Artificial Sequence
  Description of Artificial Sequence: Synthetic coding sequence
atggccgacagcctgtacaacatcagactgctgagagagttcagcaacgagtacctgaacaagtgcttctacctgaccctggaggacatgctgtacgcccccctggtgctgaagcccaacgtgatggtgttcatcgccgagctgttctggtggttcgagaacgtgaagcccgacttcgtgcagcccagagacgtgcaggagctgaaggacgccaagaccgtgctgcaccagaagagcagcagaccccccgtgcccatcagcaacgccaccaagagaagcttcctgggcagccccgccgccggcaccctggccgagctgcagccccccgtgcagctgcccgccgagggctgccacagacactacctgcaccccgaggagcccgagtacctgggcaagggcaccgccgccttcagccccagccaccccctgctgcccctgagacagaagcagcagaagagcatccagggcgaggacatccccgaccagagacacagaagcaacagcctgaccagagtggacggccagcccagaggcgccgccatcgcctggcccgagaagaagaccagacccgccagccagcccacccccttcgccctgcaccacgccgccagctgcgaggtggaccccagcagcggcgacagcatcagcctggccagaagcatcagcaaggacagcctggccagcaacatcgtgaacctgaccccccagaaccagccccaccccaccgccaccaagagccacggcaagagcctgctgagcaacgtgagcatcgaggacgaggaggaggagctggtggccatcgtgagagccgacgtggtgccccagcaggccgaccccgagttccccagagccagccccagagccctgggcctgaccgccaacgccagaagcccccagggccagctggacaccagcgagagcaagcccgacagcttcttcctggagcccctgatgcccgccgtgctgaagcccgccaaggagaagcaggtgatcaccaaggaggacgagagaggcgagggcagacccagaagcatcgtgagcagaagacccagcgagggcccccagcccctggtgagaagaaagatgaccggcagcagagacctgaacagaaccttcacccccatcccctgcagcgagttccccatgggcatcgaccccaccgagaccggccccctgagcgtggagaccgccggcgaggtgtgcggcggccccctggccctgggcggcttcgaccccttcccccagggccccagcaccgacggcttcttcctgcacgtgggcagagccgacgaggacaccgagggcagactgtacgtgagctgcagcaagagccccaacagccacgacagcgagccctggaccctgctgagacaggacagcgacagcgacgtggtggacatcgaggaggccgagcacgacttcatgggcgaggcccaccccgtggtgttcagcagatacatcggcgaggaggagagcgccaagctgcaggaggacatgaaggtgaaggagcacgaggacaaggacgacgccagcggcagaagcagcccctgcctgagcaccgccagccagatgagcagcgtgagcatggccagcggcagcgtgaagatgaccagcttcgccgagagaaagctgcagagactgaacagctgcgagaccaagagcagcaccagcagcagccagaagaccacccccgacgccagcgagagctgccccgcccccctgaccacctggagacagaagagagagcagagccccagccagcacggcaaggaccccgccagcctgctggccagcgagctggtgcagctgcacatgcagctggaggagaagagaagagccatcgaggcccagaagaagaagatggaggccctgagcgccagacagagactgaagctgggcaaggccgccttcctgcacgtggtgaagaagggcaaggccgaggccgccccccccctgagacccgagcacttcgccaaggagtacagccagcacaacggcgaggactgcggcgacgccgtgagcaagaccgaggacttcctggtgaaggaggagcagagagaggagctgctgcacgagccccaggacgtggacaaggagagcctggccttcgcccagcagcacaaggccaaggaccccgtggccctgcacgagctggagagaaacaaggtgatcagcgccgccctgctggaggacaccgtgggcgaggtggtggacgtgaacgagtgcgacctgagcatcgagaagctgaacgagaccatcagcaccctgcagcaggccatcctgaagatcagccagcagcaggagcagctgctgatgaagagccccaccgtgcccgtgcccggcagcaagaacaacagccaggaccacaaggtgaaggcccccgtgcacttcgtggagcccctgagccccaccggcgtggccggccacagaaaggcccccagactgggccagggcagaaacagcagaagcggcagacccgccgagctgaaggtgcccaaggacagaccccagggcagcagcagaagcaagacccccacccccagcgtggagaccctgccccacctgagacccttccccgccagcagccaccccagaacccccaccgaccccggcctggacagcgccctggagcccagcggcgacccccacggcaagtgcctgttcgacagctacagactgcacgacgagagcaaccagagaaccctgaccctgagcagcagcaaggacgccaacatcctgagcgagcagatgagcctgaaggaggtgctggacgccagcgtgaaggaggtgggcagcagcagcagcgacgtgagcggcaaggagagcgtgcccgtggaggagcccctgagaagcagagccagcctgatcgaggtggacctgagcgacctgaaggcccccgacgaggacggcgagctggtgagcctggacggcagcgccgacctggtgagcgagggcgaccagaagcccggcgtgggcttcttcttcaaggacgagcagaaggccgaggacgagctggccaagaagagagccgccttcctgctgaagcagcagagaaaggccgaggaggccagagtgagaaagcagcagctggaggccgaggtggagctgaagagagacgaggccagaagaaaggccgaggaggacagagtgagaaaggaggaggagaaggccagaagagagctgatcaagcaggagtacctgagaagaaagcagcagcagatcctggaggagcagggcctgggcaagcccaagagcaagcccaagaagcccagacccaagagcgtgcacagagaggagagctgcagcgacagcggcaccaagtgcagcagcacccccgacaacctgagcagaacccagagcggcagcagcctgagcctggccagcgccgccaccaccgagcccgagagcgtgcacagcggcggcacccccagccagagagtggagagcatggaggccctgcccatcctgagcagaaaccccagcagaagcaccgacagagactgggagaccgccagcgccgccagcagcctggccagcgtggccgagtacaccggccccaagctgttcaaggagcccagcagcaagagcaacaagcccatcatccacaacgccatcagccactgctgcctggccggcaaggtgaacgagccccacaagaacagcatcctggaggagctggagaagtgcgacgccaaccactacatcatcctgttcagagacgccggctgccagttcagagccctgtactgctactaccccgacaccgaggagatctacaagctgaccggcaccggccccaagaacatcaccaagaagatgatcgacaagctgtacaagtacagcagcgacagaaagcagttcaacctgatccccgccaagaccatgagcgtgagcgtggacgccctgaccatccacaaccacctgtggcagcccaagagacccgccgtgcccaagaaggcccagaccagaaagtag

SEQ ID NO: 9747 - DNA, 4809 bp, Artificial Sequence
  Description of Artificial Sequence: Synthetic coding sequence
atggtggacgccagcggcagagccgccgccgagggctggagaaagatggaggccccccccgacggcgccgccgacctggtgcccctggacagatacgacgccgccagagccaagatcgccgccaacctgcagtggatctgcgccaaggcctacggcagagacaacatccccgaggacctgagagaccccttctacgtggaccagtacgagcaggagcacatcaagccccccgtgatcaagctgctgctgagcagcgagctgtactgcagagtgtgcagcctgatcctgaagggcgaccaggtggccgccctgcagggccaccagagcgtgatccaggccctgagcagaaagggcatctacgtgatggagagcgacgacacccccgtgaccgagagcgacctgagcagagcccccatcaagatgagcgcccacatggccatggtggacgccctgatgatggcctacaccgtggagatgatcagcatcgagaaggtggtggccagcgtgaagagattcagcaccttcagcgccagcaaggagctgccctacgacctggaggacgccatggtgttctggatcaacaaggtgaacctgaagatgagagagatcaccgagaaggaggtgaagctgaagcagcagctgctggagagccccgcccaccagaaggtgagatacagaagagagcacctgagcgccagacagagcccctacttccccctgctggaggacctgatgagagacggcagcgacggcgccgccctgctggccgtgatccactactactgccccgagcagatgaagctggacgacatctgcctgaaggaggtgaccagcatggccgacagcctgtacaacatcagactgctgagagagttcagcaacgagtacctgaacaagtgcttctacctgaccctggaggacatgctgtacgcccccctggtgctgaagcccaacgtgatggtgttcatcgccgagctgttctggtggttcgagaacgtgaagcccgacttcgtgcagcccagagacgtgcaggagctgaaggacgccaagaccgtgctgcaccagaagagcagcagaccccccgtgcccatcagcaacgccaccaagagaagcttcctgggcagccccgccgccggcaccctggccgagctgcagccccccgtgcagctgcccgccgagggctgccacagacactacctgcaccccgaggagcccgagtacctgggcaagggcaccgccgccttcagccccagccaccccctgctgcccctgagacagaagcagcagaagagcatccagggcgaggacatccccgaccagagacacagaagcaacagcctgaccagagtggacggccagcccagaggcgccgccatcgcctggcccgagaagaagaccagacccgccagccagcccacccccttcgccctgcaccacgccgccagctgcgaggtggaccccagcagcggcgacagcatcagcctggccagaagcatcagcaaggacagcctggccagcaacatcgtgaacctgaccccccagaaccagccccaccccaccgccaccaagagccacggcaagagcctgctgagcaacgtgagcatcgaggacgaggaggaggagctggtggccatcgtgagagccgacgtggtgccccagcaggccgaccccgagttccccagagccagccccagagccctgggcctgaccgccaacgccagaagcccccagggccagctggacaccagcgagagcaagcccgacagcttcttcctggagcccctgatgcccgccgtgctgaagcccgccaaggagaagcaggtgatcaccaaggaggacgagagaggcgagggcagacccagaagcatcgtgagcagaagacccagcgagggcccccagcccctggtgagaagaaagatgaccggcagcagagacctgaacagaaccttcacccccatcccctgcagcgagttccccatgggcatcgaccccaccgagaccggccccctgagcgtggagaccgccggcgaggtgtgcggcggccccctggccctgggcggcttcgaccccttcccccagggccccagcaccgacggcttcttcctgcacgtgggcagagccgacgaggacaccgagggcagactgtacgtgagctgcagcaagagccccaacagccacgacagcgagccctggaccctgctgagacaggacagcgacagcgacgtggtggacatcgaggaggccgagcacgacttcatgggcgaggcccaccccgtggtgttcagcagatacatcggcgaggaggagagcgccaagctgcaggaggacatgaaggtgaaggagcacgaggacaaggacgacgccagcggcagaagcagcccctgcctgagcaccgccagccagatgagcagcgtgagcatggccagcggcagcgtgaagatgaccagcttcgccgagagaaagctgcagagactgaacagctgcgagaccaagagcagcaccagcagcagccagaagaccacccccgacgccagcgagagctgccccgcccccctgaccacctggagacagaagagagagcagagccccagccagcacggcaaggaccccgccagcctgctggccagcgagctggtgcagctgcacatgcagctggaggagaagagaagagccatcgaggcccagaagaagaagatggaggccctgagcgccagacagagactgaagctgggcaaggccgccttcctgcacgtggtgaagaagggcaaggccgaggccgccccccccctgagacccgagcacttcgccaaggagtacagccagcacaacggcgaggactgcggcgacgccgtgagcaagaccgaggacttcctggtgaaggaggagcagagagaggagctgctgcacgagccccaggacgtggacaaggagagcctggccttcgcccagcagcacaaggccaaggaccccgtggccctgcacgagctggagagaaacaaggtgatcagcgccgccctgctggaggacaccgtgggcgaggtggtggacgtgaacgagtgcgacctgagcatcgagaagctgaacgagaccatcagcaccctgcagcaggccatcctgaagatcagccagcagcaggagcagctgctgatgaagagccccaccgtgcccgtgcccggcagcaagaacaacagccaggaccacaaggtgaaggcccccgtgcacttcgtggagcccctgagccccaccggcgtggccggccacagaaaggcccccagactgggccagggcagaaacagcagaagcggcagacccgccgagctgaaggtgcccaaggacagaccccagggcagcagcagaagcaagacccccacccccagcgtggagaccctgccccacctgagacccttccccgccagcagccaccccagaacccccaccgaccccggcctggacagcgccctggagcccagcggcgacccccacggcaagtgcctgttcgacagctacagactgcacgacgagagcaaccagagaaccctgaccctgagcagcagcaaggacgccaacatcctgagcgagcagatgagcctgaaggaggtgctggacgccagcgtgaaggaggtgggcagcagcagcagcgacgtgagcggcaaggagagcgtgcccgtggaggagcccctgagaagcagagccagcctgatcgaggtggacctgagcgacctgaaggcccccgacgaggacggcgagctggtgagcctggacggcagcgccgacctggtgagcgagggcgaccagaagcccggcgtgggcttcttcttcaaggacgagcagaaggccgaggacgagctggccaagaagagagccgccttcctgctgaagcagcagagaaaggccgaggaggccagagtgagaaagcagcagctggaggccgaggtggagctgaagagagacgaggccagaagaaaggccgaggaggacagagtgagaaaggaggaggagaaggccagaagagagctgatcaagcaggagtacctgagaagaaagcagcagcagatcctggaggagcagggcctgggcaagcccaagagcaagcccaagaagcccagacccaagagcgtgcacagagaggagagctgcagcgacagcggcaccaagtgcagcagcacccccgacaacctgagcagaacccagagcggcagcagcctgagcctggccagcgccgccaccaccgagcccgagagcgtgcacagcggcggcacccccagccagagagtggagagcatggaggccctgcccatcctgagcagaaaccccagcagaagcaccgacagagactgggagaccgccagcgccgccagcagcctggccagcgtggccgagtacaccggccccaagctgttcaaggagcccagcagcaagagcaacaagcccatcatccacaacgccatcagccactgctgcctggccggcaaggtgaacgagccccacaagaacagcatcctggaggagctggagaagtgcgacgccaaccactacatcatcctgttcagagacgccggctgccagttcagagccctgtactgctactaccccgacaccgaggagatctacaagctgaccggcaccggccccaagaacatcaccaagaagatgatcgacaagctgtacaagtacagcagcgacagaaagcagttcaacctgatccccgccaagaccatgagcgtgagcgtggacgccctgaccatccacaaccacctgtggcagcccaagagacccgccgtgcccaagaaggcccagaccagaaagtag

SEQ ID NO: 9748 - DNA, 4842 bp, Artificial Sequence
  Description of Artificial Sequence: Synthetic coding sequence
atggtggacgccagcggcagagccgccgccgagggctggagaaagatggaggccccccccgacggcgccgccgacctggtgcccctggacagatacgacgccgccagagccaagatcgccgccaacctgcagtggatctgcgccaaggcctacggcagagacaacatccccgaggacctgagagaccccttctacgtggaccagtacgagcaggagcacatcaagccccccgtgatcaagctgctgctgagcagcgagctgtactgcagagtgtgcagcctgatcctgaagggcgaccaggtggccgccctgcagggccaccagagcgtgatccaggccctgagcagaaagggcatctacgtgatggagagcgacgacacccccgtgaccgagagcgacctgagcagagcccccatcaagatgagcgcccacatggccatggtggacgccctgatgatggcctacaccgtggagatgatcagcatcgagaaggtggtggccagcgtgaagagattcagcaccttcagcgccagcaaggagctgccctacgacctggaggacgccatggtgttctggatcaacaaggtgaacctgaagatgagagagatcaccgagaaggaggtgaagctgaagcagcagctgctggagagccccgcccaccagaagagccccagcaagtggtactggaagctggtgcccgtgagatacagaagagagcacctgagcgccagacagagcccctacttccccctgctggaggacctgatgagagacggcagcgacggcgccgccctgctggccgtgatccactactactgccccgagcagatgaagctggacgacatctgcctgaaggaggtgaccagcatggccgacagcctgtacaacatcagactgctgagagagttcagcaacgagtacctgaacaagtgcttctacctgaccctggaggacatgctgtacgcccccctggtgctgaagcccaacgtgatggtgttcatcgccgagctgttctggtggttcgagaacgtgaagcccgacttcgtgcagcccagagacgtgcaggagctgaaggacgccaagaccgtgctgcaccagaagagcagcagaccccccgtgcccatcagcaacgccaccaagagaagcttcctgggcagccccgccgccggcaccctggccgagctgcagccccccgtgcagctgcccgccgagggctgccacagacactacctgcaccccgaggagcccgagtacctgggcaagggcaccgccgccttcagccccagccaccccctgctgcccctgagacagaagcagcagaagagcatccagggcgaggacatccccgaccagagacacagaagcaacagcctgaccagagtggacggccagcccagaggcgccgccatcgcctggcccgagaagaagaccagacccgccagccagcccacccccttcgccctgcaccacgccgccagctgcgaggtggaccccagcagcggcgacagcatcagcctggccagaagcatcagcaaggacagcctggccagcaacatcgtgaacctgaccccccagaaccagccccaccccaccgccaccaagagccacggcaagagcctgctgagcaacgtgagcatcgaggacgaggaggaggagctggtggccatcgtgagagccgacgtggtgccccagcaggccgaccccgagttccccagagccagccccagagccctgggcctgaccgccaacgccagaagcccccagggccagctggacaccagcgagagcaagcccgacagcttcttcctggagcccctgatgcccgccgtgctgaagcccgccaaggagaagcaggtgatcaccaaggaggacgagagaggcgagggcagacccagaagcatcgtgagcagaagacccagcgagggcccccagcccctggtgagaagaaagatgaccggcagcagagacctgaacagaaccttcacccccatcccctgcagcgagttccccatgggcatcgaccccaccgagaccggccccctgagcgtggagaccgccggcgaggtgtgcggcggccccctggccctgggcggcttcgaccccttcccccagggccccagcaccgacggcttcttcctgcacgtgggcagagccgacgaggacaccgagggcagactgtacgtgagctgcagcaagagccccaacagccacgacagcgagccctggaccctgctgagacaggacagcgacagcgacgtggtggacatcgaggaggccgagcacgacttcatgggcgaggcccaccccgtggtgttcagcagatacatcggcgaggaggagagcgccaagctgcaggaggacatgaaggtgaaggagcacgaggacaaggacgacgccagcggcagaagcagcccctgcctgagcaccgccagccagatgagcagcgtgagcatggccagcggcagcgtgaagatgaccagcttcgccgagagaaagctgcagagactgaacagctgcgagaccaagagcagcaccagcagcagccagaagaccacccccgacgccagcgagagctgccccgcccccctgaccacctggagacagaagagagagcagagccccagccagcacggcaaggaccccgccagcctgctggccagcgagctggtgcagctgcacatgcagctggaggagaagagaagagccatcgaggcccagaagaagaagatggaggccctgagcgccagacagagactgaagctgggcaaggccgccttcctgcacgtggtgaagaagggcaaggccgaggccgccccccccctgagacccgagcacttcgccaaggagtacagccagcacaacggcgaggactgcggcgacgccgtgagcaagaccgaggacttcctggtgaaggaggagcagagagaggagctgctgcacgagccccaggacgtggacaaggagagcctggccttcgcccagcagcacaaggccaaggaccccgtggccctgcacgagctggagagaaacaaggtgatcagcgccgccctgctggaggacaccgtgggcgaggtggtggacgtgaacgagtgcgacctgagcatcgagaagctgaacgagaccatcagcaccctgcagcaggccatcctgaagatcagccagcagcaggagcagctgctgatgaagagccccaccgtgcccgtgcccggcagcaagaacaacagccaggaccacaaggtgaaggcccccgtgcacttcgtggagcccctgagccccaccggcgtggccggccacagaaaggcccccagactgggccagggcagaaacagcagaagcggcagacccgccgagctgaaggtgcccaaggacagaccccagggcagcagcagaagcaagacccccacccccagcgtggagaccctgccccacctgagacccttccccgccagcagccaccccagaacccccaccgaccccggcctggacagcgccctggagcccagcggcgacccccacggcaagtgcctgttcgacagctacagactgcacgacgagagcaaccagagaaccctgaccctgagcagcagcaaggacgccaacatcctgagcgagcagatgagcctgaaggaggtgctggacgccagcgtgaaggaggtgggcagcagcagcagcgacgtgagcggcaaggagagcgtgcccgtggaggagcccctgagaagcagagccagcctgatcgaggtggacctgagcgacctgaaggcccccgacgaggacggcgagctggtgagcctggacggcagcgccgacctggtgagcgagggcgaccagaagcccggcgtgggcttcttcttcaaggacgagcagaaggccgaggacgagctggccaagaagagagccgccttcctgctgaagcagcagagaaaggccgaggaggccagagtgagaaagcagcagctggaggccgaggtggagctgaagagagacgaggccagaagaaaggccgaggaggacagagtgagaaaggaggaggagaaggccagaagagagctgatcaagcaggagtacctgagaagaaagcagcagcagatcctggaggagcagggcctgggcaagcccaagagcaagcccaagaagcccagacccaagagcgtgcacagagaggagagctgcagcgacagcggcaccaagtgcagcagcacccccgacaacctgagcagaacccagagcggcagcagcctgagcctggccagcgccgccaccaccgagcccgagagcgtgcacagcggcggcacccccagccagagagtggagagcatggaggccctgcccatcctgagcagaaaccccagcagaagcaccgacagagactgggagaccgccagcgccgccagcagcctggccagcgtggccgagtacaccggccccaagctgttcaaggagcccagcagcaagagcaacaagcccatcatccacaacgccatcagccactgctgcctggccggcaaggtgaacgagccccacaagaacagcatcctggaggagctggagaagtgcgacgccaaccactacatcatcctgttcagagacgccggctgccagttcagagccctgtactgctactaccccgacaccgaggagatctacaagctgaccggcaccggccccaagaacatcaccaagaagatgatcgacaagctgtacaagtacagcagcgacagaaagcagttcaacctgatccccgccaagaccatgagcgtgagcgtggacgccctgaccatccacaaccacctgtggcagcccaagagacccgccgtgcccaagaaggcccagaccagaaagtag

SEQ ID NO: 9749 - DNA, 1983 bp, Artificial Sequence
  Description of Artificial Sequence: Synthetic coding sequence
atgagaatgcccagcagcacctgggccagaatcatgagcagctgcggctgcgacgcctgcagagtgggccccagcagcgtgatgagacccagccccagataccccagagcctgggtgaccagaacctgggtgcccatcccccccagacccatggccagcagcggcagcgtgcccagagactgctggctgctggccgccatcgccagcctgaccctgaacgacaccctgctgcacagagtggtgccccacggccagagcttccagaacggctacgccggcatcttccacttccagctgtggcagttcggcgagtgggtggacgtggtggtggacgacctgctgcccatcaaggacggcaagctggtgttcgtgcacagcgccgagggcaacgagttctggagcgccctgctggagaaggcctacgccaaggtgaacggcagctacgaggccctgagcggcggcagcaccagcgagggcttcgaggacttcaccggcggcgtgaccgagtggtacgagctgagaaaggcccccagcgacctgtaccagatcatcctgaaggccctggagagaggcagcctgctgggctgcagcatcgacatcagcagcgtgctggacatggaggccatcaccttcaagaagctggtgaagggccacgcctacagcgtgaccggcgccaagcaggtgaactacagaggccaggtggtgagcctgatcagaatgagaaacccctggggcgaggtggagtggaccggcgcctggagcgacagcagcagcgagtggaacaacgtggacccctacgagagagaccagctgagagtgaagatggaggacggcgagttctggatgagcttcagagacttcatgagagagttcaccagactggagatctgcaacctgacccccgacgccctgaagagcagaaccatcagaaagtggaacaccaccctgtacgagggcacctggagaagaggcagcaccgccggcggctgcagaaactaccccgccaccttctgggtgaacccccagttcaagatcagactggacgagaccgacgaccccgacgactacggcgacagagagagcggctgcagcttcgtgctggccctgatgcagaagcacagaagaagagagagaagattcggcagagacatggagaccatcggcttcgccgtgtacgaggtgccccccgagctggtgggccagcccgccgtgcacctgaagagagacttcttcctggccaacgccagcagagccagaagcgagcagttcatcaacctgagagaggtgagcaccagattcagactgccccccggcgagtacgtggtggtgcccagcaccttcgagcccaacaaggagggcgacttcgtgctgagattcttcagcgagaagagcgccggcaccgtggagctggacgaccagatccaggccaacctgcccgacgagcaggtgctgagcgaggaggagatcgacgagaacttcaaggccctgttcagacagctggccggcgaggacatggagatcagcgtgaaggagctgagaaccatcctgaacagaatcatcagcaagcacaaggacctgagaaccaagggcttcagcctggagagctgcagaagcatggtgaacctgatggacagagacggcaacggcaagctgggcctggtggagttcaacatcctgtggaacagaatcagaaactacctgagcatcttcagaaagttcgacctggacaagagcggcagcatgagcgcctacgagatgagaatggccatcgagagcgccggcttcaagctgaacaagaagctgtacgagctgatcatcaccagatacagcgagcccgacctggccgtggacttcgacaacttcgtgtgctgcctggtgagactggagaccatgttcagattcttcaagaccctggacaccgacctggacggcgtggtgaccttcgacctgttcaagtggctgcagctgaccatgttcgcctag

SEQ ID NO: 9750 - DNA, 2145 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatcttccacttccagctgtggcagttcggcgagtgggtggacgtggtggtggacgacctgctgcccatcaaggacggcaagctggtgttcgtgcacagcgccgagggcaacgagttctggagcgccctgctggagaaggcctacgccaaggtgaacggcagctacgaggccctgagcggcggcagcaccagcgagggcttcgaggacttcaccggcggcgtgaccgagtggtacgagctgagaaaggcccccagcgacctgtaccagatcatcctgaaggccctggagagaggcagcctgctgggctgcagcatcgacatcagcagcgtgctggacatggaggccatcaccttcaagaagctggtgaagggccacgcctacagcgtgaccggcgccaagcaggtgaactacagaggccaggtggtgagcctgatcagaatgagaaacccctggggcgaggtggagtggaccggcgcctggagcgacagcagcagcgagtggaacaacgtggacccctacgagagagaccagctgagagtgaagatggaggacggcgagttctggatgagcttcagagacttcatgagagagttcaccagactggagatctgcaacctgacccccgacgccctgaagagcagaaccatcagaaagtggaacaccaccctgtacgagggcacctggagaagaggcagcaccgccggcggctgcagaaactaccccgccaccttctgggtgaacccccagttcaagatcagactggacgagaccgacgaccccgacgactacggcgacagagagagcggctgcagcttcgtgctggccctgatgcagaagcacagaagaagagagagaagattcggcagagacatggagaccatcggcttcgccgtgtacgaggtgccccccgagctggtgggccagcccgccgtgcacctgaagagagacttcttcctggccaacgccagcagagccagaagcgagcagttcatcaacctgagagaggtgagcaccagattcagactgccccccggcgagtacgtggtggtgcccagcaccttcgagcccaacaaggagggcgacttcgtgctgagattcttcagcgagaagagcgccggcaccgtggagctggacgaccagatccaggccaacctgcccgacgagcaggtgctgagcgaggaggagatcgacgagaacttcaaggccctgttcagacagctggccggcgaggacatggagatcagcgtgaaggagctgagaaccatcctgaacagaatcatcagcaagcacaaggacctgagaaccaagggcttcagcctggagagctgcagaagcatggtgaacctgatggacagagacggcaacggcaagctgggcctggtggagttcaacatcctgtggaacagaatcagaaactacctgagcatcttcagaaagttcgacctggacaagagcggcagcatgagcgcctacgagatgagaatggccatcgagagcgccggcttcaagctgaacaagaagctgtacgagctgatcatcaccagatacagcgagcccgacctggccgtggacttcgacaacttcgtgtgctgcctggtgagactggagaccatgttcagattcttcaagaccctggacaccgacctggacggcgtggtgaccttcgacctgttcaagtggctgcagctgaccatgttcgcctag

SEQ ID NO: 9751 - DNA, 2145 bp, Artificial Sequence; identical to SEQ ID NO: 9750
  Description of Artificial Sequence: Synthetic coding sequence

SEQ ID NO: 9752 - DNA, 489 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatcttccacttccagctgtggcagttcggcgagtgggtggacgtgtag

SEQ ID NO: 9753 - DNA, 2145 bp, Artificial Sequence; identical to SEQ ID NO: 9750
  Description of Artificial Sequence: Synthetic coding sequence

SEQ ID NO: 9754 - DNA, 459 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatcttccacttccagtag

SEQ ID NO: 9755 - DNA, 489 bp, Artificial Sequence; identical to SEQ ID NO: 9752
  Description of Artificial Sequence: Synthetic coding sequence

SEQ ID NO: 9756 - DNA, 492 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatcttccacttccagctgtggcagttcggcgagtgggtggacgtggtgtag

SEQ ID NO: 9757 - DNA, 576 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatcttccacttccagctgtggcagttcggcgagtgggtggacgtggtggtggacgacctgctgcccatcaaggacggcaagctggtgttcgtgcacagcgccgagggcaacgagttctggagcgccctgctgtag

SEQ ID NO: 9758 - DNA, 513 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatcttccacttccagctgtggcagttcggcgagtgggtggacgtggtggtggacgacctgctgcccatctag

SEQ ID NO: 9759 - DNA, 369 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgcctag

SEQ ID NO: 9760 - DNA, 192 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttccccccctag

SEQ ID NO: 9761 - DNA, 2145 bp, Artificial Sequence; identical to SEQ ID NO: 9750
  Description of Artificial Sequence: Synthetic coding sequence

SEQ ID NO: 9762 - DNA, 2145 bp, Artificial Sequence; identical to SEQ ID NO: 9750
  Description of Artificial Sequence: Synthetic coding sequence

SEQ ID NO: 9763 - DNA, 447 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccccacggccagagcttccagaacggctacgccggcatctag

SEQ ID NO: 9764 - DNA, 411 bp, Artificial Sequence
  Description of Artificial Sequence: Synthetic coding sequence
atgagcgaggagatcatcacccccgtgtactgcaccggcgtgagcgcccaggtgcagaagcagagagccagagagctgggcctgggcagacacgagaacgccatcaagtacctgggccaggactacgagcagctgagagtgagatgcctgcagagcggcaccctgttcagagacgaggccttcccccccgtgccccagagcctgggctacaaggacctgggccccaacagcagcaagacctacggcatcaagtggaagagacccaccgagctgctgagcaacccccagttcatcgtggacggcgccaccagaaccgacatctgccagggcgccctgggcgactgctggctgctggccgccatcgccagcctgaccctgaacgacaccctgctgcacagagtggtgccctag

SEQ ID NO: 9765 - DNA, 2103 bp, Artificial Sequence
  Description of Artificial Sequence: Synthetic coding sequence
atggccggcatcgccgccaagctggccaaggacagagaggccgccgagggcctgggcagccacgacagagccatcaagtacctgaaccaggactacgaggccctgagaaacgagtgcctggaggccggcaccctgttccaggaccccagcttccccgccatccccagcgccctgggcttcaaggagctgggcccctacagcagcaagaccagaggcatcgagtggaagagacccaccgagatctgcgccgacccccagttcatcatcggcggcgccaccagaaccgacatctgccagggcgccctgggcgactgctggctgctggccgccatcgccagcctgaccctgaacgaggagatcctggccagagtggtgcccctgaaccagagcttccaggagaactacgccggcatcttccacttccagttctggcagtacggcgagtgggtggaggtggtggtggacgacagactgcccaccaaggacggcgagctgctgttcgtgcacagcgccgagggcagcgagttctggagcgccctgctggagaaggcctacgccaagatcaacggctgctacgaggccctgagcggcggcgccaccaccgagggcttcgaggacttcaccggcggcatcgccgagtggtacgagctgaagaagcccccccccaacctgttcaagatcatccagaaggccctgcagaagggcagcctgctgggctgcagcatcgacatcaccagcgccgccgacagcgaggccatcaccttccagaagctggtgaagggccacgcctacagcgtgaccggcgccgaggaggtggagagcaacggcagcctgcagaagctgatcagaatcagaaacccctggggcgaggtggagtggaccggcagatggaacgacaactgccccagctggaacaccatcgaccccgaggagagagagagactgaccagaagacacgaggacggcgagttctggatgagcttcagcgacttcctgagacactacagcagactggagatctgcaacctgacccccgacaccctgaccagcgacacctacaagaagtggaagctgaccaagatggacggcaactggagaagaggcagcaccgccggcggctgcagaaactaccccaacaccttctggatgaacccccagtacctgatcaagctggaggaggaggacgaggacgaggaggacggcgagagcggctgcaccttcctggtgggcctgatccagaagcacagaagaagacagagaaagatgggcgaggacatgcacaccatcggcttcggcatctacgaggtgcccgaggagctgagcggccagaccaacatccacctgagcaagaacttcttcctgaccaacagagccagagagagaagcgacaccttcatcaacctgagagaggtgctgaacagattcaagctgccccccggcgagtacatcctggtgcccagcaccttcgagcccaacaaggacggcgacttctgcatcagagtgttcagcgagaagaaggccgactaccaggccgtggacgacgagatcgaggccaacctggaggagttcgacatcagcgaggacgacatcgacgacggcttcagaagactgttcgcccagctggccggcgaggacgccgagatcagcgccttcgagctgcagaccatcctgagaagagtgctggccaagagacaggacatcaagagcgacggcttcagcatcgagacctgcaagatcatggtggacatgctggacagcgacggcagcggcaagctgggcctgaaggagttctacatcctgtggaccaagatccagaagtaccagaagatctacagagagatcgacgtggacagaagcggcaccatgaacagctacgagatgagaaaggccctggaggaggccggcttcaagatgccctgccagctgcaccaggtgatcgtggccagattcgccgacgaccagctgatcatcgacttcgacaacttcgtgagatgcctggtgagactggagaccctgttcaagatcttcaagcagctggaccccgagaacaccggcaccatcgagctggacctgatcagctggctgtgcttcagcgtgctgtag

SEQ ID NO: 9766 - DNA, 2190 bp, Artificial Sequence
  Description of Artificial Sequence: Synthetic coding sequence
gcccccggccccggcagagcccccgccgagagaagcgccgagagccccagacccttcagcgcccagtacggcagaagagacagaagcatggccggcatcgccgccaagctggccaaggacagagaggccgccgagggcctgggcagccacgacagagccatcaagtacctgaaccaggactacgaggccctgagaaacgagtgcctggaggccggcaccctgttccaggaccccagcttccccgccatccccagcgccctgggcttcaaggagctgggcccctacagcagcaagaccagaggcatcgagtggaagagacccaccgagatctgcgccgacccccagttcatcatcggcggcgccaccagaaccgacatctgccagggcgccctgggcgactgctggctgctggccgccatcgccagcctgaccctgaacgaggagatcctggccagagtggtgcccctgaaccagagcttccaggagaactacgccggcatcttccacttccagttctggcagtacggcgagtgggtggaggtggtggtggacgacagactgcccaccaaggacggcgagctgctgttcgtgcacagcgccgagggcagcgagttctggagcgccctgctggagaaggcctacgccaagatcaacggctgctacgaggccctgagcggcggcgccaccaccgagggcttcgaggacttcaccggcggcatcgccgagtggtacgagctgaagaagcccccccccaacctgttcaagatcatccagaaggccctgcagaagggcagcctgctgggctgcagcatcgacatcaccagcgccgccgacagcgaggccatcaccttccagaagctggtgaagggccacgcctacagcgtgaccggcgccgaggaggtggagagcaacggcagcctgcagaagctgatcagaatcagaaacccctggggcgaggtggagtggaccggcagatggaacgacaactgccccagctggaacaccatcgaccccgaggagagagagagactgaccagaagacacgaggacggcgagttctggatgagcttcagcgacttcctgagacactacagcagactggagatctgcaacctgacccccgacaccctgaccagcgacacctacaagaagtggaagctgaccaagatggacggcaactggagaagaggcagcaccgccggcggctgcagaaactaccccaacaccttctggatgaacccccagtacctgatcaagctggaggaggaggacgaggacgaggaggacggcgagagcggctgcaccttcctggtgggcctgatccagaagcacagaagaagacagagaaagatgggcgaggacatgcacaccatcggcttcggcatctacgaggtgcacccccagctgagcggccagaccaacatccacctgagcaagaacttcttcctgaccaacagagccagagagagaagcgacaccttcatcaacctgagagaggtgctgaacagattcaagctgccccccggcgagtacatcctggtgcccagcaccttcgagcccaacaaggacggcgacttctgcatcagagtgttcagcgagaagaaggccgactaccaggccgtggacgacgagatcgaggccaacctggaggagttcgacatcagcgaggacgacatcgacgacggcttcagaagactgttcgcccagctggccggcgaggacgccgagatcagcgccttcgagctgcagaccatcctgagaagagtgctggccaagagacaggacatcaagagcgacggcttcagcatcgagacctgcaagatcatggtggacatgctggacagcgacggcagcggcaagctgggcctgaaggagttctacatcctgtggaccaagatccagaagtaccagaagatctacagagagatcgacgtggacagaagcggcaccatgaacagctacgagatgagaaaggccctggaggaggccggcttcaagatgccctgccagctgcaccaggtgatcgtggccagattcgccgacgaccagctgatcatcgacttcgacaacttcgtgagatgcctggtgagactggagaccctgttcaagatcttcaagcagctggaccccgagaacaccggcaccatcgagctggacctgatcagctggctgtgcttcagcgtgctgtag

SEQ ID NO: 9767 - DNA, 1869 bp, Artificial Sequence
  Description of Artificial Sequence: Synthetic coding sequence
atggagatctgcgccgacccccagttcatcatcggcggcgccaccagaaccgacatctgccagggcgccctgggcgactgctggctgctggccgccatcgccagcctgaccctgaacgaggagatcctggccagagtggtgcccctgaaccagagcttccaggagaactacgccggcatcttccacttccagttctggcagtacggcgagtgggtggaggtggtggtggacgacagactgcccaccaaggacggcgagctgctgttcgtgcacagcgccgagggcagcgagttctggagcgccctgctggagaaggcctacgccaagatcaacggctgctacgaggccctgagcggcggcgccaccaccgagggcttcgaggacttcaccggcggcatcgccgagtggtacgagctgaagaagcccccccccaacctgttcaagatcatccagaaggccctgcagaagggcagcctgctgggctgcagcatcgacatcaccagcgccgccgacagcgaggccatcaccttccagaagctggtgaagggccacgcctacagcgtgaccggcgccgaggaggtggagagcaacggcagcctgcagaagctgatcagaatcagaaacccctggggcgaggtggagtggaccggcagatggaacgacaactgccccagctggaacaccatcgaccccgaggagagagagagactgaccagaagacacgaggacggcgagttctggatgagcttcagcgacttcctgagacactacagcagactggagatctgcaacctgacccccgacaccctgaccagcgacacctacaagaagtggaagctgaccaagatggacggcaactggagaagaggcagcaccgccggcggctgcagaaactaccccaacaccttctggatgaacccccagtacctgatcaagctggaggaggaggacgaggacgaggaggacggcgagagcggctgcaccttcctggtgggcctgatccagaagcacagaagaagacagagaaagatgggcgaggacatgcacaccatcggcttcggcatctacgaggtgcccgaggagctgagcggccagaccaacatccacctgagcaagaacttcttcctgaccaacagagccagagagagaagcgacaccttcatcaacctgagagaggtgctgaacagattcaagctgccccccggcgagtacatcctggtgcccagcaccttcgagcccaacaaggacggcgacttctgcatcagagtgttcagcgagaagaaggccgactaccaggccgtggacgacgagatcgaggccaacctggaggagttcgacatcagcgaggacgacatcgacgacggcttcagaagactgttcgcccagctggccggcgaggacgccgagatcagcgccttcgagctgcagaccatcctgagaagagtgctggccaagagacaggacatcaagagcgacggcttcagcatcgagacctgcaagatcatggtggacatgctggacagcgacggcagcggcaagctgggcctgaaggagttctacatcctgtggaccaagatccagaagtaccagaagatctacagagagatcgacgtggacagaagcggcaccatgaacagctacgagatgagaaaggccctggaggaggccggcttcaagatgccctgccagctgcaccaggtgatcgtggccagattcgccgacgaccagctgatcatcgacttcgacaacttcgtgagatgcctggtgagactggagaccctgttcaagatcttcaagcagctggaccccgagaacaccggcaccatcgagctggacctgatcagctggctgtgcttcagcgtgctgtag

SEQ ID NO: 9768 - DNA, 396 bp, Artificial Sequence
  Description of Artificial Sequence: Synthetic coding sequence
atggagatctgcgccgacccccagttcatcatcggcggcgccaccagaaccgacatctgccagggcgccctgggcgactgctggctgctggccgccatcgccagcctgaccctgaacgaggagatcctggccagagtggtgcccctgaaccagagcttccaggagaactacgccggcatcttccacttccagttctggcagtacggcgagtgggtggaggtggtggtggacgacagactgcccaccaaggacggcgagctgctgttcgtgcacagcgccgagggcagcgagttctggagcgccctgctggagaaggcctacgccaagatcaacggctgctacgaggccctgagcggcggcgccaccaccgagggcttcgaggacttcaccggctag

SEQ ID NO: 9769 - DNA, 156 bp, Artificial Sequence
  Description of Artificial Sequence: Synthetic coding sequence
atgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaagagcgactag

SEQ ID NO: 9770 - DNA, 984 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagatcagcaccatcgccgagagcgaggacagccaggagagcgtggacagcgtgaccgacagccagaagagaagagagatcctgagcagaagacccagctacagaaagatcctgaacgacctgagcagcgacgcccccggcgtgcccagaatcgaggaggagaagagcgaggaggagaccagcgcccccgccatcaccaccgtgaccgtgcccacccccatctaccagaccagcagcggccagtacatcgccatcacccagggcggcgccatccagctggccaacaacggcaccgacggcgtgcagggcctgcagaccctgaccatgaccaacgccgccgccacccagcccggcaccaccatcctgcagtacgcccagaccaccgacggccagcagatcctggtgcccagcaaccaggtggtggtgcaggccgccagcggcgacgtgcagacctaccagatcagaaccgcccccaccagcaccatcgcccccggcgtggtgatggccagcagccccgccctgcccacccagcccgccgaggaggccgccagaaagagagaggtgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaagagcgactag

SEQ ID NO: 9771 - DNA, 693 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagagcagctgcaaggacctgaagagactgttcagcggcacccagatcagcaccatcgccgagagcgaggacagccaggagagcgtggacagcgtgaccgacagccagaagagaagagagatcctgagcagaagacccagctacagaaagatcctgaacgacctgagcagcgacgcccccggcgtgcccagaatcgaggaggagaagagcgaggaggagaccagcgccctgcccacccagcccgccgaggaggccgccagaaagagagaggtgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaagagcgactag

SEQ ID NO: 9772 - DNA, 240 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagtag

SEQ ID NO: 9773 - DNA, 984 bp, Artificial Sequence; identical to SEQ ID NO: 9770
  Description of Artificial Sequence: Synthetic coding sequence

SEQ ID NO: 9774 - DNA, 1026 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagagcagctgcaaggacctgaagagactgttcagcggcacccagatcagcaccatcgccgagagcgaggacagccaggagagcgtggacagcgtgaccgacagccagaagagaagagagatcctgagcagaagacccagctacagaaagatcctgaacgacctgagcagcgacgcccccggcgtgcccagaatcgaggaggagaagagcgaggaggagaccagcgcccccgccatcaccaccgtgaccgtgcccacccccatctaccagaccagcagcggccagtacatcgccatcacccagggcggcgccatccagctggccaacaacggcaccgacggcgtgcagggcctgcagaccctgaccatgaccaacgccgccgccacccagcccggcaccaccatcctgcagtacgcccagaccaccgacggccagcagatcctggtgcccagcaaccaggtggtggtgcaggccgccagcggcgacgtgcagacctaccagatcagaaccgcccccaccagcaccatcgcccccggcgtggtgatggccagcagccccgccctgcccacccagcccgccgaggaggccgccagaaagagagaggtgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaagagcgactag

SEQ ID NO: 9775 - DNA, 549 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagagcagctgcaaggacctgaagagactgttcagcggcacccagatcagcaccatcgccgagagcgaggacagccaggagagcgtggacagcgtgaccgacagccagaagagaagagagatcctgagcagaagacccagctacagaaagatcctgaacgacctgagcagcgacgcccccggcgtgcccagaatcgaggaggagaagagcgaggaggagaccagcgcccccgccatcaccaccgtgaccgtgcccacccccatctaccagaccagcagcggccagtactag

SEQ ID NO: 9776 - DNA, 399 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagagcagctgcaaggacctgaagagactgttcagcggcacccagatcagcaccatcgccgagagcgaggacagccaggagagcgtggacagcgtgaccgacagccagaagagaagagagatcctgagcagaagaccctag

SEQ ID NO: 9777 - DNA, 705 bp, Artificial Sequence
  Description of Artificial Sequence: Synthetic coding sequence
atgaccatggagagcggcgccgagaaccagcagagcggcgacgccgccgtgaccgaggccgagaaccagcagatgaccgtgcaggcccagccccagatcgccaccctggcccaggtgagcatgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagatcagcaccatcgccgagagcgaggacagccaggagagcgtggacagcgtgaccgacagccagaagagaagagagatcctgagcagaagacccagctacagaaagatcctgaacgacctgagcagcgacgcccccggcgtgcccagaatcgaggaggagaagagcgaggaggagaccagcgcccccgccatcaccaccgtgaccgtgcccacccccatctaccagaccagcagcggccagtacatcgccatcacccagggcggcgccatccagctggccaacaacggcaccgacggcgtgcagggcctgcagaccctgaccatgaccaacgccgccgccacccagcccggcaccaccatcctgcagtacgcccagaccaccgacggccagcagatcctggtgcccagcaaccaggtggtggtgcagggcacccagaagctgtag

SEQ ID NO: 9778 - DNA, 462 bp, Artificial Sequence
  Description of Artificial Sequence: Synthetic coding sequence
atgcccgccgcccacgccaccagcagcgcccccaccgtgaccctggtgcagctgcccaacggccagaccgtgcaggtgcacggcgtgatccaggccgcccagcccagcgtgatccagagcccccaggtgcagaccgtgcagagcagctgcaaggacctgaagagactgttcagcggcacccagatcagcaccatcgccgagagcgaggacagccaggagagcgtggacagcgtgaccgacagccagaagagaagagagatcctgagcagaagacccagctacagaaagatcctgaacgacctgagcagcgacgcccccggcgtgcccagaatcgaggaggagaagagcgaggaggagaccagcgcccccgccatcaccaccgtgaccgtgcccacccccatctaccagaccagcagcggccagtacacctacctgagagacaccacctacagctgccagtag

SEQ ID NO: 9779 - DNA, 1998 bp, Artificial Sequence
  Description of Artificial Sequence: Synthetic coding sequence
atggcccacgagatgatcggcacccagatcgtgaccgagagactggtggccctgctggagagcggcaccgagaaggtgctgctgatcgacagcagacccttcgtggagtacaacaccagccacatcctggaggccatcaacatcaactgcagcaagctgatgaagagaagactgcagcaggacaaggtgctgatcaccgagctgatccagcacagcgccaagcacaaggtggacatcgactgcagccagaaggtggtggtgtacgaccagagcagccaggacgtggccagcctgagcagcgactgcttcctgaccgtgctgctgggcaagctggagaagagcttcaacagcgtgcacctgctggccggcggcttcgccgagttcagcagatgcttccccggcctgtgcgagggcaagagcaccctggtgcccacctgcatcagccagccctgcctgcccgtggccaacatcggccccaccagaatcctgcccaacctgtacctgggctgccagagagacgtgctgaacaaggagctgatgcagcagaacggcatcggctacgtgctgaacgccagcaacacctgccccaagcccgacttcatccccgagagccacttcctgagagtgcccgtgaacgacagcttctgcgagaagatcctgccctggctggacaagagcgtggacttcatcgagaaggccaaggccagcaacggctgcgtgctggtgcactgcctggccggcatcagcagaagcgccaccatcgccatcgcctacatcatgaagagaatggacatgagcctggacgaggcctacagattcgtgaaggagaagagacccaccatcagccccaacttcaacttcctgggccagctgctggactacgagaagaagatcaagaaccagaccggcgccagcggccccaagagcaagctgaagctgctgcacctggagaagcccaacgagcccgtgcccgccgtgagcgagggcggccagaagagcgagacccccctgagccccccctgcgccgacagcgccaccagcgaggccgccggccagagacccgtgcaccccgccagcgtgcccagcgtgcccagcgtgcagcccagcctgctggaggacagccccctggtgcaggccctgagcggcctgcacctgagcgccgacagactggaggacagcaacaagctgaagagaagcttcagcctggacatcaagagcgtgagctacagcgccagcatggccgccagcctgcacggcttcagcagcagcgaggacgccctggagtactacaagcccagcaccaccctggacggcaccaacaagctgtgccagttcagccccgtgcaggagctgagcgagcagacccccgagaccagccccgacaaggaggaggccagcatccccaagaagctgcagaccgccagacccagcgacagccagagcaagagactgcacagcgtgagaaccagcagcagcggcaccgcccagagaagcctgctgagccccctgcacagaagcggcagcgtggaggacaactaccacaccagcttcctgttcggcctgagcaccagccagcagcacctgaccaagagcgccggcctgggcctgaagggctggcacagcgacatcctggccccccagaccagcacccccagcctgaccagcagctggtacttcgccaccgagagcagccacttctacagcgccagcgccatctacggcggcagcgccagctacagcgcctacagctgcagccagctgcccacctgcggcgaccaggtgtacagcgtgagaagaagacagaagcccagcgacagagccgacagcagaagaagctggcacgaggagagccccttcgagaagcagttcaagagaagaagctgccagatggagttcggcgagagcatcatgagcgagaacagaagcagagaggagctgggcaaggtgggcagccagagcagcttcagcggcagcatggagatcatcgaggtgagctag

SEQ ID NO: 9780 - DNA, 939 bp, Artificial Sequence
  Description of Artificial Sequence: Synthetic coding sequence
atgagaatgctgctggccctgctggccctgagcgccgccagacccagcgccagcgccgagagccactggtgctacgaggtgcaggccgagagcagcaactacccctgcctggtgcccgtgaagtggggcggcaactgccagaaggacagacagagccccatcaacatcgtgaccaccaaggccaaggtggacaagaagctgggcagattcttcttcagcggctacgacaagaagcagacctggaccgtgcagaacaacggccacagcgtgatgatgctgctggagaacaaggccagcatcagcggcggcggcctgcccgccccctaccaggccaagcagctgcacctgcactggagcgacctgccctacaagggcagcgagcacagcctggacggcgagcacttcgccatggagatgcacatcgtgcacgagaaggagaagggcaccagcagaaacgtgaaggaggcccaggaccccgaggacgagatcgccgtgctggccttcctggtggaggccggcacccaggtgaacgagggcttccagcccctggtggaggccctgagcaacatccccaagcccgagatgagcaccaccatggccgagagcagcctgctggacctgctgcccaaggaggagaagctgagacactacttcagatacctgggcagcctgaccacccccacctgcgacgagaaggtggtgtggaccgtgttcagagagcccatccagctgcacagagagcagatcctggccttcagccagaagctgtactacgacaaggagcagaccgtgagcatgaaggacaacgtgagacccctgcagcagctgggccagagaaccgtgatcaagagcggcgcccccggcagacccctgccctgggccctgcccgccctgctgggccccatgctggcctgcctgctggccggcttcctgagatag

SEQ ID NO: 9781 - DNA, 1380 bp, Artificial Sequence
  Description of Artificial Sequence: Synthetic coding sequence
atggcccccctgtgccccagcccctggctgcccctgctgatccccgcccccgcccccggcctgaccgtgcagctgctgctgagcctgctgctgctggtgcccgtgcacccccagagactgcccagaatgcaggaggacagccccctgggcggcggcagcagcggcgaggacgaccccctgggcgaggaggacctgcccagcgaggaggacagccccagagaggaggacccccccggcgaggaggacctgcccggcgaggaggacctgcccggcgaggaggacctgcccgaggtgaagcccaagagcgaggaggagggcagcctgaagctggaggacctgcccaccgtggaggcccccggcgacccccaggagccccagaacaacgcccacagagacaaggagggcgacgaccagagccactggagatacggcggcgaccccccctggcccagagtgagccccgcctgcgccggcagattccagagccccgtggacatcagaccccagctggccgccttctgccccgccctgagacccctggagctgctgggcttccagctgccccccctgcccgagctgagactgagaaacaacggccacagcgtgcagctgaccctgccccccggcctggagatggccctgggccccggcagagagtacagagccctgcagctgcacctgcactggggcgccgccggcagacccggcagcgagcacaccgtggagggccacagattccccgccgagatccacgtggtgcacctgagcaccgccttcgccagagtggacgaggccctgggcagacccggcggcctggccgtgctggccgccttcctggaggagggccccgaggagaacagcgcctacgagcagctgctgagcagactggaggagatcgccgaggagggcagcgagacccaggtgcccggcctggacatcagcgccctgctgcccagcgacttcagcagatacttccagtacgagggcagcctgaccacccccccctgcgcccagggcgtgatctggaccgtgttcaaccagaccgtgatgctgagcgccaagcagctgcacaccctgagcgacaccctgtggggccccggcgacagcagactgcagctgaacttcagagccacccagcccctgaacggcagagtgatcgaggccagcttccccgccggcgtggacagcagccccagagccgccgagcccgtgcagctgaacagctgcctggccgccggcgacatcctggccctggtgttcggcctgctgttcgccgtgaccagcgtggccttcctggtgcagatgagaagacagcacagaagaggcaccaagggcggcgtgagctacagacccgccgaggtggccgagaccggcgcctag

SEQ ID NO: 9782 - DNA, 1071 bp, Artificial Sequence
  Description of Artificial Sequence: Synthetic coding sequence
atggcccccctgtgccccagcccctggctgcccctgctgatccccgcccccgcccccggcctgaccgtgcagctgctgctgagcctgctgctgctggtgcccgtgcacccccagagactgcccagaatgcaggaggacagccccctgggcggcggcagcagcggcgaggacgaccccctgggcgaggaggacctgcccagcgaggaggacagccccagagaggaggacccccccggcgaggaggacctgcccggcgaggaggacctgcccggcgaggaggacctgcccgaggtgaagcccaagagcgaggaggagggcagcctgaagctggaggacctgcccaccgtggaggcccccggcgacccccaggagccccagaacaacgcccacagagacaaggagggcgacgaccagagccactggagatacggcggcgaccccccctggcccagagtgagccccgcctgcgccggcagattccagagccccgtggacatcagaccccagctggccgccttctgccccgccctgagacccctggagctgctgggcttccagctgccccccctgcccgagctgagactgagaaacaacggccacagcgtgcagctgaccctgccccccggcctggagatggccctgggccccggcagagagtacagagccctgcagctgcacctgcactggggcgccgccggcagacccggcagcgagcacaccgtggagggccacagattccccgccgagatccacgtggtgcacctgagcaccgccttcgccagagtggacgaggccctgggcagacccggcggcctggccgtgctggccgccttcctggaggagggccccgaggagaacagcgcctacgagcagctgctgagcagactggaggagatcgccgaggagggcagcgagacccaggtgcccggcctggacatcagcgccctgctgcccagcgacttcagcagatacttccagtacgagggcagcctgaccacccccccctgcgcccagggcgtgatctggaccgtgttcaaccagaccgtgatgctgagcgccaagcagagctag

SEQ ID NO: 9783 - DNA, 2775 bp, Artificial Sequence
  Description of Artificial Sequence: Synthetic coding sequence
atgcccggccccagccccggcctgagaagagccctgctgggcctgtgggccgccctgggcctgggcctgttcggcctgagcgccgtgagccaggagcccttctgggccgacctgcagcccagagtggccttcgtggagagaggcggcagcctgtggctgaactgcagcaccaactgccccagacccgagagaggcggcctggagaccagcctgagaagaaacggcacccagagaggcctgagatggctggccagacagctggtggacatcagagagcccgagacccagcccgtgtgcttcttcagatgcgccagaagaaccctgcaggccagaggcctgatcagaaccttccagagacccgacagagtggagctgatgcccctgcccccctggcagcccgtgggcgagaacttcaccctgagctgcagagtgcccggcgccggccccagagccagcctgaccctgaccctgctgagaggcgcccaggagctgatcagaagaagcttcgccggcgagccccccagagccagaggcgccgtgctgaccgccaccgtgctggccagaagagaggaccacggcgccaacttcagctgcagagccgagctggacctgagaccccacggcctgggcctgttcgagaacagcagcgcccccagagagctgagaaccttcagcctgagccccgacgcccccagactggccgcccccagactgctggaggtgggcagcgagagacccgtgagctgcaccctggacggcctgttccccgccagcgaggccagagtgtacctggccctgggcgaccagaacctgagccccgacgtgaccctggagggcgacgccttcgtggccaccgccaccgccaccgccagcgccgagcaggagggcgccagacagctggtgtgcaacgtgaccctgggcggcgagaacagagagaccagagagaacgtgaccatctacagcttccccgcccccctgctgaccctgagcgagcccagcgtgagcgagggccagatggtgaccgtgacctgcgccgccggcgcccaggccctggtgaccctggagggcgtgcccgccgccgtgcccggccagcccgcccagctgcagctgaacgccaccgagaacgacgacagaagaagcttcttctgcgacgccaccctggacgtggacggcgagaccctgatcaagaacagaagcgccgagctgagagtgctgtacgcccccagactggacgacagcgactgccccagaagctggacctggcccgagggccccgagcagaccctgagatgcgaggccagaggcaaccccgagcccagcgtgcactgcgccagaagcgacggcggcgccgtgctggccctgggcctgctgggccccgtgaccagagccctgagcggcacctacagatgcaaggccgccaacgaccagggcgaggccgtgaaggacgtgaccctgaccgtggagtacgcccccgccctggacagcgtgggctgccccgagagaatcacctggctggagggcaccgaggccagcctgagctgcgtggcccacggcgtgcccccccccgacgtgatctgcgtgagaagcggcgagctgggcgccgtgatcgagggcctgctgagagtggccagagagcacgccggcacctacagatgcgaggccaccaaccccagaggcagcgccgccaagaacgtggccgtgaccgtggagtacggccccagattcgaggagcccagctgccccagcaactggacctgggtggagggcagcggcagactgttcagctgcgaggtggacggcaagccccagcccagcgtgaagtgcgtgggcagcggcggcgccaccgagggcgtgctgctgcccctggccccccccgaccccagccccagagcccccagaatccccagagtgctggcccccggcatctacgtgtgcaacgccaccaacagacacggcagcgtggccaagaccgtggtggtgagcgccgagagcccccccgagatggacgagagcacctgccccagccaccagacctggctggagggcgccgaggccagcgccctggcctgcgccgccagaggcagacccagccccggcgtgagatgcagcagagagggcatcccctggcccgagcagcagagagtgagcagagaggacgccggcacctaccactgcgtggccaccaacgcccacggcaccgacagcagaaccgtgaccgtgggcgtggagtacagacccgtggtggccgagctggccgccagcccccccggcggcgtgagacccggcggcaacttcaccctgacctgcagagccgaggcctggccccccgcccagatcagctggagagccccccccggcgccctgaacatcggcctgagcagcaacaacagcaccctgagcgtggccggcgccatgggcagccacggcggcgagtacgagtgcgccgccaccaacgcccacggcagacacgccagaagaatcaccgtgagagtggccggcccctggctgtgggtggccgtgggcggcgccgccggcggcgccgccctgctggccgccggcgccggcctggccttctacgtgcagagcaccgcctgcaagaagggcgagtacaacgtgcaggaggccgagagcagcggcgaggccgtgtgcctgaacggcgccggcggcggcgccggcggcgccgccggcgccgagggcggccccgaggccgccggcggcgccgccgagagccccgccgagggcgaggtgttcgccatccagctgaccagcgcctag

SEQ ID NO: 9784 - DNA, 1263 bp, Artificial Sequence
  Description of Artificial Sequence: Synthetic coding sequence
atggagagccccagcgcccccccccacagatggtgcatcccctggcagagactgctgctgaccgccagcctgctgaccttctggaacccccccaccaccgccaagctgaccatcgagagcacccccttcaacgtggccgagggcaaggaggtgctgctgctggtgcacaacctgccccagcacctgttcggctacagctggtacaagggcgagagagtggacggcaacagacagatcatcggctacgtgatcggcacccagcaggccacccccggccccgcctacagcggcagagagatcatctaccccaacgccagcctgctgatccagaacatcatccagaacaagctgagcgtggaccacagcgaccccgtgatcctgaacgtgctgtacggccccgacgaccccaccatcagccccagctacacctactacagacccggcgtgaacctgagcctgagctgccacgccgccagcaacccccccgcccagtacagctggctgatcgacggcaacatccagcagcacacccaggagctgttcatcagcaacatcaccgagaagaacagcggcctgtacacctgccaggccaacaacagcgccagcggccacagcagaaccaccgtgaagaccatcaccgtgagcgccgagctgcccaagcccagcatcagcagcaacaacagcaagcccgtggaggacaaggacgccgtggccttcacctgcgagcccgaggcccagaacaccacctacctgtggtgggtgaacggccagagcctgcccgtgagccccagactgcagctgagcaacggcaacagaaccctgaccctgttcaacgtgaccagaaacgacgccagagcctacgtgtgcggcatccagaacagcgtgagcgccaacagaagcgaccccgtgaccctggacgtgctgtacggccccgacacccccatcatcagcccccccgacagcagctacctgagcggcgccaacctgaacctgagctgccacagcgccagcaaccccagcccccagtacagctggagaatcaacggcatcccccagcagcacacccaggtgctgttcatcgccaagatcacccccaacaacaacggcacctacgcctgcttcgtgagcaacctggccaccggcagaaacaacagcatcgtgaagagcatcaccgtgagcgccagcggcaccagccccggcctgagcgccggcgccaccgtgggcatcatgatcggcgtgctggtgggcgtggccctgatctag

SEQ ID NO: 9785 - DNA, 2109 bp, Artificial Sequence
  Description of Artificial Sequence: Synthetic coding sequence
atggagagccccagcgcccccccccacagatggtgcatcccctggcagagactgctgctgaccgccagcctgctgaccttctggaacccccccaccaccgccaagctgaccatcgagagcacccccttcaacgtggccgagggcaaggaggtgctgctgctggtgcacaacctgccccagcacctgttcggctacagctggtacaagggcgagagagtggacggcaacagacagatcatcggctacgtgatcggcacccagcaggccacccccggccccgcctacagcggcagagagatcatctaccccaacgccagcctgctgatccagaacatcatccagaacgacaccggcttctacaccctgcacgtgatcaagagcgacctggtgaacgaggaggccaccggccagttcagagtgtaccccgagctgcccaagcccagcatcagcagcaacaacagcaagcccgtggaggacaaggacgccgtggccttcacctgcgagcccgagacccaggacgccacctacctgtggtgggtgaacaaccagagcctgcccgtgagccccagactgcagctgagcaacggcaacagaaccctgaccctgttcaacgtgaccagaaacgacaccgccagctacaagtgcgagacccagaaccccgtgagcgccagaagaagcgacagcgtgatcctgaacgtgctgtacggccccgacgcccccaccatcagccccctgaacaccagctacagaagcggcgagaacctgaacctgagctgccacgccgccagcaacccccccgcccagtacagctggttcgtgaacggcaccttccagcagagcacccaggagctgttcatccccaacatcaccgtgaacaacagcggcagctacacctgccaggcccacaacagcgacaccggcctgaacagaaccaccgtgaccaccatcaccgtgtacgccgagccccccaagcccttcatcaccagcaacaacagcaaccccgtggaggacgaggacgccgtggccctgacctgcgagcccgagatccagaacaccacctacctgtggtgggtgaacaaccagagcctgcccgtgagccccagactgcagctgagcaacgacaacagaaccctgaccctgctgagcgtgaccagaaacgacgtgggcccctacgagtgcggcatccagaacaagctgagcgtggaccacagcgaccccgtgatcctgaacgtgctgtacggccccgacgaccccaccatcagccccagctacacctactacagacccggcgtgaacctgagcctgagctgccacgccgccagcaacccccccgcccagtacagctggctgatcgacggcaacatccagcagcacacccaggagctgttcatcagcaacatcaccgagaagaacagcggcctgtacacctgccaggccaacaacagcgccagcggccacagcagaaccaccgtgaagaccatcaccgtgagcgccgagctgcccaagcccagcatcagcagcaacaacagcaagcccgtggaggacaaggacgccgtggccttcacctgcgagcccgaggcccagaacaccacctacctgtggtgggtgaacggccagagcctgcccgtgagccccagactgcagctgagcaacggcaacagaaccctgaccctgttcaacgtgaccagaaacgacgccagagcctacgtgtgcggcatccagaacagcgtgagcgccaacagaagcgaccccgtgaccctggacgtgctgtacggccccgacacccccatcatcagcccccccgacagcagctacctgagcggcgccaacctgaacctgagctgccacagcgccagcaaccccagcccccagtacagctggagaatcaacggcatcccccagcagcacacccaggtgctgttcatcgccaagatcacccccaacaacaacggcacctacgcctgcttcgtgagcaacctggccaccggcagaaacaacagcatcgtgaagagcatcaccgtgagcgccagcggcaccagccccggcctgagcgccggcgccaccgtgggcatcatgatcggcgtgctggtgggcgtggccctgatctag

SEQ ID NO: 9786 - DNA, 1035 bp, Artificial Sequence
  Description of Artificial Sequence: Synthetic coding sequence
atgggcccccccagcgcccccccctgcagactgcacgtgccctggaaggaggtgctgctgaccgccagcctgctgaccttctggaacccccccaccaccgccaagctgaccatcgagagcacccccttcaacgtggccgagggcaaggaggtgctgctgctggcccacaacctgccccagaacagaatcggctacagctggtacaagggcgagagagtggacggcaacagcctgatcgtgggctacgtgatcggcacccagcaggccacccccggccccgcctacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgaggtgcagaacaccacctacctgtggtgggtgaacggccagagcctgcccgtgagccccagactgcagctgagcaacggcaacatgaccctgaccctgctgagcgtgaagagaaacgacgccggcagctacgagtgcgagatccagaaccccgccagcgccaacagaagcgaccccgtgaccctgaacgtgctgtacggccccgacggccccaccatcagccccagcaaggccaactacagacccggcgagaacctgaacctgagctgccacgccgccagcaacccccccgcccagtacagctggttcatcaacggcaccttccagcagagcacccaggagctgttcatccccaacatcaccgtgaacaacagcggcagctacatgtgccaggcccacaacagcgccaccggcctgaacagaaccaccgtgaccatgatcaccgtgagcggcagcgcccccgtgctgagcgccgtggccaccgtgggcatcaccatcggcgtgctggccagagtggccctgatctag

SEQ ID NO: 9787 - DNA, 1977 bp, Artificial Sequence
  Description of Artificial Sequence: Synthetic coding sequence
atggtgcccagactgctgctgagagcctggcccagaggccccgccgtgggccccggcgcccccagcagacccctgagcgccggcagcggccccggccagtacctgcagagaagcatcgtgcccaccatgcactaccaggacagcctgcccagactgcccatccccaagctggaggacaccatcagaagatacctgagcgcccagaagcccctgctgaacgacggccagttcagaaagaccgagcagttctgcaagagcttcgagaacggcatcggcaaggagctgcacgagcagctggtggccctggacaagcagaacaagcacaccagctacatcagcggcccctggttcgacatgtacctgagcgccagagacagcgtggtgctgaacttcaaccccttcatggccttcaaccccgaccccaagagcgagtacaacgaccagctgaccagagccaccaacatgaccgtgagcgccatcagattcctgaagaccctgagagccggcctgctggagcccgaggtgttccacctgaaccccgccaagagcgacaccatcaccttcaagagactgatcagattcgtgcccagcagcctgagctggtacggcgcctacctggtgaacgcctaccccctggacatgagccagtacttcagactgttcaacagcaccagactgcccaagcccagcagagacgagctgttcaccgacgacaaggccagacacctgctggtgctgagaaagggcaacttctacatcttcgacgtgctggaccaggacggcaacatcgtgagccccagcgagatccaggcccacctgaagtacatcctgagcgacagcagccccgcccccgagttccccctggcctacctgaccagcgagaacagagacatctgggccgagctgagacagaagctgatgagcagcggcaacgaggagagcctgagaaaggtggacagcgccgtgttctgcctgtgcctggacgacttccccatcaaggacctggtgcacctgagccacaacatgctgcacggcgacggcaccaacagatggttcgacaagagcttcaacctgatcatcgccaaggacggcagcaccgccgtgcacttcgagcacagctggggcgacggcgtggccgtgctgagattcttcaacgaggtgttcaaggacagcacccagacccccgccgtgaccccccagagccagcccgccaccaccgacagcaccgtgaccgtgcagaagctgaacttcgagctgaccgacgccctgaagaccggcatcaccgccgccaaggagaagttcgacgccaccatgaagaccctgaccatcgactgcgtgcagttccagagaggcggcaaggagttcctgaagaagcagaagctgagccccgacgccgtggcccagctggccttccagatggccttcctgagacagtacggccagaccgtggccacctacgagagctgcagcaccgccgccttcaagcacggcagaaccgagaccatcagacccgccagcgtgtacaccaagagatgcagcgaggccttcgtgagagagcccagcagacacagcgccggcgagctgcagcagatgatggtggagtgcagcaagtaccacggccagctgaccaaggaggccgccatgggccagggcttcgacagacacctgttcgccctgagacacctggccgccgccaagggcatcatcctgcccgagctgtacctggaccccgcctacggccagatcaaccacaacgtgctgagcaccagcaccctgagcagccccgccgtgaacctgggcggcttcgcccccgtggtgagcgacggcttcggcgtgggctacgccgtgcacgacaactggatcggctgcaacgtgagcagctaccccggcagaaacgccagagagttcctgcagtgcgtggagaaggccctggaggacatgttcgacgccctggagggcaagagcatcaagagctag

SEQ ID NO: 9788 - DNA, 1077 bp, Artificial Sequence
  Description of Artificial Sequence: Synthetic coding sequence
atgagagccacccccctggccgcccccgccggcagcctgagcagaaagaagagactggagctggacgacaacctggacaccgagagacccgtgcagaagagagccagaagcggcccccagcccagactgcccccctgcctgctgcccctgagcccccccaccgcccccgacagagccaccgccgtggccaccgccagcagactgggcccctacgtgctgctggagcccgaggagggcggcagagcctaccaggccctgcactgccccaccggcaccgagtacacctgcaaggtgtaccccgtgcaggaggccctggccgtgctggagccctacgccagactgcccccccacaagcacgtggccagacccaccgaggtgctggccggcacccagctgctgtacgccttcttcaccagaacccacggcgacatgcacagcctggtgagaagcagacacagaatccccgagcccgaggccgccgtgctgttcagacagatggccaccgccctggcccactgccaccagcacggcctggtgctgagagacctgaagctgtgcagattcgtgttcgccgacagagagagaaagaagctggtgctggagaacctggaggacagctgcgtgctgaccggccccgacgacagcctgtgggacaagcacgcctgccccgcctacgtgggccccgagatcctgagcagcagagccagctacagcggcaaggccgccgacgtgtggagcctgggcgtggccctgttcaccatgctggccggccactaccccttccaggacagcgagcccgtgctgctgttcggcaagatcagaagaggcgcctacgccctgcccgccggcctgagcgcccccgccagatgcctggtgagatgcctgctgagaagagagcccgccgagagactgaccgccaccggcatcctgctgcacccctggctgagacaggaccccatgcccctggcccccaccagaagccacctgtgggaggccgcccaggtggtgcccgacggcctgggcctggacgaggccagagaggaggagggcgacagagaggtggtgctgtacggctag

SEQ ID NO: 9789 - DNA, 1176 bp, Artificial Sequence
  Description of Artificial Sequence: Synthetic coding sequence
atgagcggccccgtgcccagcagagccagagtgtacaccgacgtgaacacccacagacccagagagtactgggactacgagagccacgtggtggagtggggcaaccaggacgactaccagctggtgagaaagctgggcagaggcaagtacagcgaggtgttcgaggccatcaacatcaccaacaacgagaaggtggtggtgaagatcctgaagcccgtgaagaagaagaagatcaagagagagatcaagatcctggagaacctgagaggcggccccaacatcatcaccctggccgacatcgtgaaggaccccgtgagcagaacccccgccctggtgttcgagcacgtgaacaacaccgacttcaagcagctgtaccagaccctgaccgactacgacatcagattctacatgtacgagatcctgaaggccctggactactgccacagcatgggcatcatgcacagagacgtgaagccccacaacgtgatgatcgaccacgagcacagaaagctgagactgatcgactggggcctggccgagttctaccaccccggccaggagtacaacgtgagagtggccagcagatacttcaagggccccgagctgctggtggactaccagatgtacgactacagcctggacatgtggagcctgggctgcatgctggccagcatgatcttcagaaaggagcccttcttccacggccacgacaactacgaccagctggtgagaatcgccaaggtgctgggcaccgaggacctgtacgactacatcgacaagtacaacatcgagctggaccccagattcaacgacatcctgggcagacacagcagaaagagatgggagagattcgtgcacagcgagaaccagcacctggtgagccccgaggccctggacttcctggacaagctgctgagatacgaccaccagagcagactgaccgccagagaggccatggagcacccctacttctacaccgtggtgaaggaccaggccagaatgggcagcagcagcatgcccggcggcagcacccccgtgagcagcgccaacatgatgagcggcatcagcagcgtgcccacccccagccccctgggccccctggccggcagccccgtgatcgccgccgccaaccccctgggcatgcccgtgcccgccgccgccggcgcccagcagtag

SEQ ID NO: 9790 - DNA, 1194 bp, Artificial Sequence
  Description of Artificial Sequence: Synthetic coding sequence
atgagcggccccgtgcccagcagagccagagtgtacaccgacgtgaacacccacagacccagagagtactgggactacgagagccacgtggtggagtggggcaaccaggacgactaccagctggtgagaaagctgggcagaggcaagtacagcgaggtgttcgaggccatcaacatcaccaacaacgagaaggtggtggtgaagatcctgaagcccgtgaagaagaagaagatcaagagagagatcaagatcctggagaacctgagaggcggccccaacatcatcaccctggccgacatcgtgaaggaccccgtgagcagaacccccgccctggtgttcgagcacgtgaacaacaccgacttcaagcagctgtaccagaccctgaccgactacgacatcagattctacatgtacgagatcctgaaggccctggactactgccacagcatgggcatcatgcacagagacgtgaagccccacaacgtgatgatcgaccacgagcacagaaagctgagactgatcgactggggcctggccgagttctaccaccccggccaggagtacaacgtgagagtggccagcagatacttcaagggccccgagctgctggtggactaccagatgtacgactacagcctggacatgtggagcctgggctgcatgctggccagcatgatcttcagaaaggagcccttcttccacggccacgacaactacgaccagctggtgagaatcgccaaggtgctgggcaccgaggacctgtacgactacatcgacaagtacaacatcgagctggaccccagattcaacgacatcctgggcagacacagcagaaagagatgggagagattcgtgcacagcgagaaccagcacctggtgagccccgaggccctggacttcctggacaagctgctgagatacgaccaccagagcagactgaccgccagagaggccatggagcacccctacttctacaccgtggtgaaggaccaggccagaatgggcagcagcagcatgcccggcggcagcacccccgtgagcagcgccaacatgatgagcggcatcagcagcgtgcccacccccagccccctgggccccctggccggcagccccgtgatcgccgccgccaaccccctgggctgcctgttccagctgcccctgagaagcgccgtgaccgccctgagcgtgagctag

SEQ ID NO: 9791 - DNA, 768 bp, Artificial Sequence
  Description of Artificial Sequence: Synthetic coding sequence
atgtacgagatcctgaaggccctggactactgccacagcatgggcatcatgcacagagacgtgaagccccacaacgtgatgatcgaccacgagcacagaaagctgagactgatcgactggggcctggccgagttctaccaccccggccaggagtacaacgtgagagtggccagcagatacttcaagggccccgagctgctggtggactaccagatgtacgactacagcctggacatgtggagcctgggctgcatgctggccagcatgatcttcagaaaggagcccttcttccacggccacgacaactacgaccagctggtgagaatcgccaaggtgctgggcaccgaggacctgtacgactacatcgacaagtacaacatcgagctggaccccagattcaacgacatcctgggcagacacagcagaaagagatgggagagattcgtgcacagcgagaaccagcacctggtgagccccgaggccctggacttcctggacaagctgctgagatacgaccaccagagcagactgaccgccagagaggccatggagcacccctacttctacaccgtggtgaaggaccaggccagaatgggcagcagcagcatgcccggcggcagcacccccgtgagcagcgccaacatgatgagcggcatcagcagcgtgcccacccccagccccctgggccccctggccggcagccccgtgatcgccgccgccaaccccctgggcatgcccgtgcccgccgccgccggcgcccagcagtag

SEQ ID NO: 9792 - DNA, 1158 bp, Artificial Sequence
  Description of Artificial Sequence: Synthetic coding sequence
atgagcggccccgtgcccagcagagccagagtgtacaccgacgtgaacacccacagacccagagagtactgggactacgagagccacgtggtggagtggggcaaccaggacgactaccagctggtgagaaagctgggcagaggcaagtacagcgaggtgttcgaggccatcaacatcaccaacaacgagaaggtggtggtgaagatcctgaagcccgtgaagaagaagaagatcaagagagagatcaagatcctggagaacctgagaggcggccccaacatcatcaccctggccgacatcgtgaaggaccccgtgagcagaacccccgccctggtgttcgagcacgtgaacaacaccgacttcaagcagctgtaccagaccctgaccgactacgacatcagattctacatgtacgagatcctgaaggccctggactactgccacagcatgggcatcatgcacagagacgtgaagccccacaacgtgatgatcgaccacgagcacagaaagctgagactgatcgactggggcctggccgagttctaccaccccggccaggagtacaacgtgagagtggccagcagatacttcaagggccccgagctgctggtggactaccagatgtacgactacagcctggacatgtggagcctgggctgcatgctggccagcatgatcttcagaaaggagcccttcttccacggccacgacaactacgaccagctggtgagaatcgccaaggtgctgggcaccgaggacctgtacgactacatcgacaagtacaacatcgagctggaccccagattcaacgacatcctgggcagacacagcagaaagagatgggagagattcgtgcacagcgagaaccagcacctggtgagccccgaggccctggacttcctggacaagctgctgagatacgaccaccagagcagactgaccgccagagaggccatggagcacccctacttctacaccgtggtgaaggaccaggccagaatgggcagcagcagcatgcccggcggcagcacccccgtgagcagcgccaacatgatgagcgagatgaagttctgcagagtggcccaggccggcctggagctgctgagcagcaccgtgtaccccccctggccccccaaggtgctgagactggaggcctag

SEQ ID NO: 9793 - DNA, 1053 bp, Artificial Sequence
  Description of Artificial Sequence: Synthetic coding sequence
atgcccggccccgccgccggcagcagagccagagtgtacgccgaggtgaacagcctgagaagcagagagtactgggactacgaggcccacgtgcccagctggggcaaccaggacgactaccagctggtgagaaagctgggcagaggcaagtacagcgaggtgttcgaggccatcaacatcaccaacaacgagagagtggtggtgaagatcctgaagcccgtgaagaagaagaagatcaagagagaggtgaagatcctggagaacctgagaggcggcaccaacatcatcaagctgatcgacaccgtgaaggaccccgtgagcaagacccccgccctggtgttcgagtacatcaacaacaccgacttcaagcagctgtaccagatcctgaccgacttcgacatcagattctacatgtacgagctgctgaaggccctggactactgccacagcaagggcatcatgcacagagacgtgaagccccacaacgtgatgatcgaccaccagcagaagaagctgagactgatcgactggggcctggccgagttctaccaccccgcccaggagtacaacgtgagagtggccagcagatacttcaagggccccgagctgctggtggactaccagatgtacgactacagcctggacatgtggagcctgggctgcatgctggccagcatgatcttcagaagagagcccttcttccacggccaggacaactacgaccagctggtgagaatcgccaaggtgctgggcaccgaggagctgtacggctacctgaagaagtaccacatcgacctggacccccacttcaacgacatcctgggccagcacagcagaaagagatgggagaacttcatccacagcgagaacagacacctggtgagccccgaggccctggacctgctggacaagctgctgagatacgaccaccagcagagactgaccgccaaggaggccatggagcacccctacttctaccccgtggtgaaggagcagagccagccctgcgccgacaacgccgtgctgagcagcggcctgaccgccgccagatag

SEQ ID NO: 9794 - DNA, 600 bp, Artificial Sequence
  Description of Artificial Sequence: Synthetic coding sequence
atggaggccagagacaagcaggtgctgagaagcctgagactggagctgggcgccgaggtgctggtggagggcctggtgctgcagtacctgtaccaggagggcatcctgaccgagaaccacatccaggagatcaacgcccagaccaccggcctgagaaagaccatgctgctgctggacatcctgcccagcagaggccccaaggccttcgacaccttcctggacagcctgcaggagttcccctgggtgagagagaagctgaagaaggccagagaggaggccatgaccgacctgcccgccggcgacagactgaccggcatccccagccacatcctgaacagcagccccagcgacagacagatcaaccagctggcccagagactgggccccgagtgggagcccatggtgctgagcctgggcctgagccagaccgacatctacagatgcaaggccaaccacccccacaacgtgcagagccaggtggtggaggccttcatcagatggagacagagattcggcaagcaggccaccttccagagcctgcacaacggcctgagagccgtggaggtggaccccagcctgctgctgcacatgctggagtag

SEQ ID NO: 9795 - DNA, 366 bp, Artificial Sequence
  Description of Artificial Sequence: Synthetic coding sequence
atggaggccagagacaagcaggtgctgagaagcctgagactggagctgggcgccgaggtgctggtggagggcctggtgctgcagtacctgtaccaggagggcatcctgaccgagaaccacatccaggagatcaacgcccagaccaccggcctgagaaagaccatgctgctgctggacatcctgcccagcagaggccccaaggccttcgacaccttcctggacagcctgcaggagttcccctgggtgagagagaagctgaagaaggccagagaggaggccatgaccgacctgcccgccgagatgagaaagctgagacccaaggacagcgtgacctgcctggccagccagctgacctggagattctag

SEQ ID NO: 9796 - DNA, 600 bp, Artificial Sequence; identical to SEQ ID NO: 9794
  Description of Artificial Sequence: Synthetic coding sequence

SEQ ID NO: 9797 - DNA, 312 bp, Artificial Sequence
  Description of Artificial Sequence: Synthetic coding sequence
atggaggccagagacaagcaggtgctgagaagcctgagactggagctgggcgccgaggtgctggtggagggcctggtgctgcagtacctgtaccaggagggcatcctgaccgagaaccacatccaggagatcaacgcccagaccaccggcctgagaaagaccatgctgctgctggacatcctgcccagcagaggccccaaggccttcgacaccttcctggacagcctgcaggagttcccctgggtgagagagaagctgaagaaggccagagaggaggccatgaccgacctgcccgccggctgctggccctag

SEQ ID NO: 9798 - DNA, 1443 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagactgcacaacggcagaagcaaggagcagagactgaaggagcagctgggcgcccagcaggagcccgtgaagaagagcatccaggagagcgaggccttcctgccccagagcatccccgaggagagatacaagatgaagagcaagcccctgggcatctgcctgatcatcgactgcatcggcaacgagaccgagctgctgagagacaccttcaccagcctgggctacgaggtgcagaagttcctgcacctgagcatgcacggcatcagccagatcctgggccagttcgcctgcatgcccgagcacagagactacgacagcttcgtgtgcgtgctggtgagcagaggcggcagccagagcgtgtacggcgtggaccagacccacagcggcctgcccctgcaccacatcagaagaatgttcatgggcgacagctgcccctacctggccggcaagcccaagatgttcttcatccagaactacgtggtgagcgagggccagctggaggacagcagcctgctggaggtggacggccccgccatgaagaacgtggagttcaaggcccagaagagaggcctgtgcaccgtgcacagagaggccgacttcttctggagcctgtgcaccgccgacatgagcctgctggagcagagccacagcagccccagcctgtacctgcagtgcctgagccagaagctgagacaggagagaaagagacccctgctggacctgcacatcgagctgaacggctacatgtacgactggaacagcagagtgagcgccaaggagaagtactacgtgtggctgcagcacaccctgagaaagaagctgatcctgagctacacctag

SEQ ID NO: 9799 - DNA, 1389 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagactgcacaacggcagaagcaaggagcagagactgaaggagcagctgggcgcccagcaggagcccgtgaagaagagcatccaggagagcgaggccttcctgccccagagcatccccgaggagagatacaagatgaagagcaagcccctgggcatctgcctgatcatcgactgcatcggcaacgagaccgagctgctgagagacaccttcaccagcctgggctacgaggtgcagaagttcctgcacctgagcatgcacggcatcagccagatcctgggccagttcgcctgcatgcccgagcacagagactacgacagcttcgtgtgcgtgctggtgagcagaggcggcagccagagcgtgtacggcgtggaccagacccacagcggcctgcccctgcaccacatcagaagaatgttcatgggcgacagctgcccctacctggccggcaagcccaagatgttcttcatccagaactacgtggtgagcgagggccagctggaggacagcagcctgctggaggtggacggccccgccatgaagaacgtggagttcaaggcccagaagagaggcctgtgcaccgtgcacagagaggccgacttcttctggagcctgtgcaccgccgacatgagcctgctggagcagagccacagcagccccagcctgtacctgcagtgcctgagccagaagctgagacaggagagaggcaccatccccggcagcggcatcaccgagagcaaggacatgcacttcagcagcctgggctgcatcctgctggacgtgctgtag

SEQ ID NO: 9800 - DNA, 1047 bp, Artificial Sequence
  Description of Artificial Sequence: Synthetic coding sequence
atggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagagaggagcccgtgaagaagagcatccaggagagcgaggccttcctgccccagagcatccccgaggagagatacaagatgaagagcaagcccctgggcatctgcctgatcatcgactgcatcggcaacgagaccgagctgctgagagacaccttcaccagcctgggctacgaggtgcagaagttcctgcacctgagcatgcacggcatcagccagatcctgggccagttcgcctgcatgcccgagcacagagactacgacagcttcgtgtgcgtgctggtgagcagaggcggcagccagagcgtgtacggcgtggaccagacccacagcggcctgcccctgcaccacatcagaagaatgttcatgggcgacagctgcccctacctggccggcaagcccaagatgttcttcatccagaactacgtggtgagcgagggccagctggaggacagcagcctgctggaggtggacggccccgccatgaagaacgtggagttcaaggcccagaagagaggcctgtgcaccgtgcacagagaggccgacttcttctggagcctgtgcaccgccgacatgagcctgctggagcagagccacagcagccccagcctgtacctgcagtgcctgagccagaagctgagacaggagagaggcaccatccccggcagcggcatcaccgagagcaaggacatgcacttcagcagcctgggctgcatcctgctggacgtgctgtag

SEQ ID NO: 9801 - DNA, 903 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagactgcacaacggcagaagcaaggagcagagactgaaggagcagctgggcgcccagcaggagcccgtgaagaagagcatccaggagagcgaggccttcctgccccagagcatccccgaggagagatacaagatgaagagcaagcccctgggcatctgcctgatcatcgactgcatcggcaacgagaccgagaacgcccacagctggatcttcaccctgaacagcatggccacctgcatgatcggcaccgccgagttcctgcccagaagaaacatcatgagcggctgcagcaccctgtag

SEQ ID NO: 9802 - DNA, 753 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcggcggctggaacggcacctggatgaccaaggccagcttcagcctgtggctggagatcgccagcctgtacatcctgcacatccccgacctgcccacccccctgccctgcatcttcatgatcagcgccaagtgctgccaggccgtgctgaacatcagcgtgttcaagaaggagagcggcatctgcaccggctggcagagctacggccacagcggcgtgctgcacgtgtgctag

SEQ ID NO: 9803 - DNA, 357 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactag

SEQ ID NO: 9804 - DNA, 1443 bp, Artificial Sequence; identical to SEQ ID NO: 9798
  Description of Artificial Sequence: Synthetic coding sequence

SEQ ID NO: 9805 - DNA, 189 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgtag

SEQ ID NO: 9806 - DNA, 195 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagatag

SEQ ID NO: 9807 - DNA, 390 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagtag

SEQ ID NO: 9808 - DNA, 1155 bp, Artificial Sequence
  Description of Artificial Sequence: Synthetic coding sequence
atggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagactgcacaacggcagaagcaaggagcagagactgaaggagcagctgggcgcccagcaggagcccgtgaagaagagcatccaggagagcgaggccttcctgccccagagcatccccgaggagagatacaagatgaagagcaagcccctgggcatctgcctgatcatcgactgcatcggcaacgagaccgagctgctgagagacaccttcaccagcctgggctacgaggtgcagaagttcctgcacctgagcatgcacggcatcagccagatcctgggccagttcgcctgcatgcccgagcacagagactacgacagcttcgtgtgcgtgctggtgagcagaggcggcagccagagcgtgtacggcgtggaccagacccacagcggcctgcccctgcaccacatcagaagaatgttcatgggcgacagctgcccctacctggccggcaagcccaagatgttcttcatccagaactacgtggtgagcgagggccagctggaggacagcagcctgctggaggtggacggccccgccatgaagaacgtggagttcaaggcccagaagagaggcctgtgcaccgtgcacagagaggccgacttcttctggagcctgtgcaccgccgacatgagcctgctggagcagagccacagcagccccagcctgtacctgcagtgcctgagccagaagctgagacaggagagaaagagacccctgctggacctgcacatcgagctgaacggctacatgtacgactggaacagcagagtgagcgccaaggagaagtactacgtgtggctgcagcacaccctgagaaagaagctgatcctgagctacacctag

SEQ ID NO: 9809 - DNA, 666 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagaatgatcaccccctacgcccactgccccgacctgaagatcctgggcaactgcagcatgtag

SEQ ID NO: 9810 - DNA, 1338 bp, Artificial Sequence
  Description of Artificial Sequence: Synthetic coding sequence
atgagcgccgaggtgatccaccaggtggaggaggccctggacaccgacgagaaggagatgctgctgttcctgtgcagagacgtggccatcgacgtggtgccccccaacgtgagagacctgctggacatcctgagagagagaggcaagctgagcgtgggcgacctggccgagctgctgtacagagtgagaagattcgacctgctgaagagaatcctgaagatggacagaaaggccgtggagacccacctgctgagaaacccccacctggtgagcgactacagagtgctgatggccgagatcggcgaggacctggacaagagcgacgtgagcagcctgatcttcctgatgaaggactacatgggcagaggcaagatcagcaaggagaagagcttcctggacctggtggtggagctggagaagctgaacctggtggcccccgaccagctggacctgctggagaagtgcctgaagaacatccacagaatcgacctgaagaccaagatccagaagtacaagcagagcgtgcagggcgccggcaccagctacagaaacgtgctgcaggccgccatccagaagagcctgaaggaccccagcaacaacttcagaagcatccccgaggagagatacaagatgaagagcaagcccctgggcatctgcctgatcatcgactgcatcggcaacgagaccgagctgctgagagacaccttcaccagcctgggctacgaggtgcagaagttcctgcacctgagcatgcacggcatcagccagatcctgggccagttcgcctgcatgcccgagcacagagactacgacagcttcgtgtgcgtgctggtgagcagaggcggcagccagagcgtgtacggcgtggaccagacccacagcggcctgcccctgcaccacatcagaagaatgttcatgggcgacagctgcccctacctggccggcaagcccaagatgttcttcatccagaactacgtggtgagcgagggccagctggaggacagcagcctgctggaggtggacggccccgccatgaagaacgtggagttcaaggcccagaagagaggcctgtgcaccgtgcacagagaggccgacttcttctggagcctgtgcaccgccgacatgagcctgctggagcagagccacagcagccccagcctgtacctgcagtgcctgagccagaagctgagacaggagagaaagagacccctgctggacctgcacatcgagctgaacggctacatgtacgactggaacagcagagtgagcgccaaggagaagtactacgtgtggctgcagcacaccctgagaaagaagctgatcctgagctacacctag

SEQ ID NO: 9811 - DNA, 1152 bp, Artificial Sequence
  Description of Artificial Sequence: Synthetic coding sequence
atggccgacaaggtgctgaaggagaagagaaagctgttcatcagaagcatgggcgagggcaccatcaacggcctgctggacgagctgctgcagaccagagtgctgaacaaggaggagatggagaaggtgaagagagagaacgccaccgtgatggacaagaccagagccctgatcgacagcgtgatccccaagggcgcccaggcctgccagatctgcatcacctacatctgcgaggaggacagctacctggccggcaccctgggcctgagcgccgccccccaggccgtgcaggacaaccccgccatgcccaccagcagcggcagcgagggcaacgtgaagctgtgcagcctggaggaggcccagagaatctggaagcagaagagcgccgagatctaccccatcatggacaagagcagcagaaccagactggccctgatcatctgcaacgaggagttcgacagcatccccagaagaaccggcgccgaggtggacatcaccggcatgaccatgctgctgcagaacctgggctacagcgtggacgtgaagaagaacctgaccgccagcgacatgaccaccgagctggaggccttcgcccacagacccgagcacaagaccagcgacagcaccttcctggtgttcatgagccacggcatcagagagggcatctgcggcaagaagcacagcgagcaggtgcccgacatcctgcagctgaacgccatcttcaacatgctgaacaccaagaactgccccagcctgaaggacaagcccaaggtgatcatcatccaggcctgcagaggcgacagccccggcgtggtgtggttcaaggacagcgtgggcgtgagcggcaacctgagcctgcccaccaccgaggagttcgaggacgacgccatcaagaaggcccacatcgagaaggacttcatcgccttctgcagcagcacccccgacaacgtgagctggagacaccccaccatgggcagcgtgttcatcggcagactgatcgagcacatgcaggagtacgcctgcagctgcgacgtggaggagatcttcagaaaggtgagattcagcttcgagcagcccgacggcagagcccagatgcccaccaccgagagagtgaccctgaccagatgcttctacctgttccccggccactag

SEQ ID NO: 9812 - DNA, 792 bp, Artificial Sequence
  Description of Artificial Sequence: Synthetic coding sequence
atggccgacaaggtgctgaaggagaagagaaagctgttcatcagaagcatgggcgaggccccccaggccgtgcaggacaaccccgccatgcccaccagcagcggcagcgagggcaacgtgaagctgtgcagcctggaggaggcccagagaatctggaagcagaagagcgccgagatctaccccatcatggacaagagcagcagaaccagactggccctgatcatctgcaacgaggagttcgacagcatccccagaagaaccggcgccgaggtggacatcaccggcatgaccatgctgctgcagaacctgggctacagcgtggacgtgaagaagaacctgaccgccagcgacatgaccaccgagctggaggccttcgcccacagacccgagcacaagaccagcgacagcaccttcctggtgttcatgagccacggcatcagagagggcatctgcggcaagaagcacagcgagcaggtgcccgacatcctgcagctgaacgccatcttcaacatgctgaacaccaagaactgccccagcctgaaggacaagcccaaggtgatcatcatccaggcctgcagaggcgacaacgtgagctggagacaccccaccatgggcagcgtgttcatcggcagactgatcgagcacatgcaggagtacgcctgcagctgcgacgtggaggagatcttcagaaaggtgagattcagcttcgagcagcccgacggcagagcccagatgcccaccaccgagagagtgaccctgaccagatgcttctacctgttccccggccactag

SEQ ID NO: 9813 - DNA, 267 bp, Artificial Sequence
  Description of Artificial Sequence: Synthetic coding sequence
atggccgacaaggtgctgaaggagaagagaaagctgttcatcagaagcatgggcgaggacaacgtgagctggagacaccccaccatgggcagcgtgttcatcggcagactgatcgagcacatgcaggagtacgcctgcagctgcgacgtggaggagatcttcagaaaggtgagattcagcttcgagcagcccgacggcagagcccagatgcccaccaccgagagagtgaccctgaccagatgcttctacctgttccccggccactag

SEQ ID NO: 9814 - DNA, 1152 bp, Artificial Sequence; identical to SEQ ID NO: 9811
  Description of Artificial Sequence: Synthetic coding sequence

SEQ ID NO: 9815 - DNA, 267 bp, Artificial Sequence; identical to SEQ ID NO: 9813
  Description of Artificial Sequence: Synthetic coding sequence

SEQ ID NO: 9816 - DNA, 1215 bp, Artificial Sequence
  Description of Artificial Sequence: Synthetic coding sequence
atggccgacaaggtgctgaaggagaagagaaagctgttcatcagaagcatgggcgagggcaccatcaacggcctgctggacgagctgctgcagaccagagtgctgaacaaggaggagatggagaaggtgaagagagagaacgccaccgtgatggacaagaccagagccctgatcgacagcgtgatccccaagggcgcccaggcctgccagatctgcatcacctacatctgcgaggaggacagctacctggccggcaccctgggcctgagcgccgaccagaccagcggcaactacctgaacatgcaggacagccagggcgtgctgagcagcttccccgccccccaggccgtgcaggacaaccccgccatgcccaccagcagcggcagcgagggcaacgtgaagctgtgcagcctggaggaggcccagagaatctggaagcagaagagcgccgagatctaccccatcatggacaagagcagcagaaccagactggccctgatcatctgcaacgaggagttcgacagcatccccagaagaaccggcgccgaggtggacatcaccggcatgaccatgctgctgcagaacctgggctacagcgtggacgtgaagaagaacctgaccgccagcgacatgaccaccgagctggaggccttcgcccacagacccgagcacaagaccagcgacagcaccttcctggtgttcatgagccacggcatcagagagggcatctgcggcaagaagcacagcgagcaggtgcccgacatcctgcagctgaacgccatcttcaacatgctgaacaccaagaactgccccagcctgaaggacaagcccaaggtgatcatcatccaggcctgcagaggcgacagccccggcgtggtgtggttcaaggacagcgtgggcgtgagcggcaacctgagcctgcccaccaccgaggagttcgaggacgacgccatcaagaaggcccacatcgagaaggacttcatcgccttctgcagcagcacccccgacaacgtgagctggagacaccccaccatgggcagcgtgttcatcggcagactgatcgagcacatgcaggagtacgcctgcagctgcgacgtggaggagatcttcagaaaggtgagattcagcttcgagcagcccgacggcagagcccagatgcccaccaccgagagagtgaccctgaccagatgcttctacctgttccccggccactag

SEQ ID NO: 9817 - DNA, 792 bp, Artificial Sequence; identical to SEQ ID NO: 9812
  Description of Artificial Sequence: Synthetic coding sequence

SEQ ID NO: 9818 - DNA, 1152 bp, Artificial Sequence; identical to SEQ ID NO: 9811
  Description of Artificial Sequence: Synthetic coding sequence

SEQ ID NO: 9819 - DNA, 936 bp, Artificial Sequence
  Description of Artificial Sequence: Synthetic coding sequence
atggccgacaaggtgctgaaggagaagagaaagctgttcatcagaagcatgggcgaggccccccaggccgtgcaggacaaccccgccatgcccaccagcagcggcagcgagggcaacgtgaagctgtgcagcctggaggaggcccagagaatctggaagcagaagagcgccgagatctaccccatcatggacaagagcagcagaaccagactggccctgatcatctgcaacgaggagttcgacagcatccccagaagaaccggcgccgaggtggacatcaccggcatgaccatgctgctgcagaacctgggctacagcgtggacgtgaagaagaacctgaccgccagcgacatgaccaccgagctggaggccttcgcccacagacccgagcacaagaccagcgacagcaccttcctggtgttcatgagccacggcatcagagagggcatctgcggcaagaagcacagcgagcaggtgcccgacatcctgcagctgaacgccatcttcaacatgctgaacaccaagaactgccccagcctgaaggacaagcccaaggtgatcatcatccaggcctgcagaggcgacagccccggcgtggtgtggttcaaggacagcgtgggcgtgagcggcaacctgagcctgcccaccaccgaggagttcgaggacgacgccatcaagaaggcccacatcgagaaggacttcatcgccttctgcagcagcacccccgacaacgtgagctggagacaccccaccatgggcagcgtgttcatcggcagactgatcgagcacatgcaggagtacgcctgcagctgcgacgtggaggagatcttcagaaaggtgagattcagcttcgagcagcccgacggcagagcccagatgcccaccaccgagagagtgaccctgaccagatgcttctacctgttccccggccactag

SEQ ID NO: 9820 - DNA, 906 bp, Artificial Sequence
  Description of Artificial Sequence: Synthetic coding sequence
atggagaaggtgaagagagagaacgccaccgtgatggacaagaccagagccctgatcgacagcgtgatccccaagggcgcccaggcctgccagatctgcatcacctacatctgcgaggaggacagctacctggccggcaccctgggcctgagcgccgaccagaccagcggcaactacctgaacatgcaggacagccagggcgtgctgagcagcttccccgccccccaggccgtgcaggacaaccccgccatgcccaccagcagcggcagcgagggcaacgtgaagctgtgcagcctggaggaggcccagagaatctggaagcagaagagcgccgagatctaccccatcatggacaagagcagcagaaccagactggccctgatcatctgcaacgaggagttcgacagcatccccagaagaaccggcgccgaggtggacatcaccggcatgaccatgctgctgcagaacctgggctacagcgtggacgtgaagaagaacctgaccgccagcgacatgaccaccgagctggaggccttcgcccacagacccgagcacaagaccagcgacagcaccttcctggtgttcatgagccacggcatcagagagggcatctgcggcaagaagcacagcgagcaggtgcccgacatcctgcagctgaacgccatcttcaacatgctgaacaccaagaactgccccagcctgaaggacaagcccaaggtgatcatcatccaggcctgcagaggcgacagccccggcgtggtgtggttcaaggacagcgtgggcgtgagcggcaacctgagcctgcccaccaccgaggagttcgaggacgacgccatcaagaaggcccacatcgagaaggacttcatcgccttctgcagcagcacccccggcaagagccagagctag

SEQ ID NO: 9821 - DNA, 333 bp, Artificial Sequence
  Description of Artificial Sequence: Synthetic coding sequence
atggccgacaaggtgctgaaggagaagagaaagctgttcatcagaagcatgggcgagggcaccatcaacggcctgctggacgagctgctgcagaccagagtgctgaacaaggaggagatggagaaggtgaagagagagaacgccaccgtgatggacaagaccagagccctgatcgacagcgtgatccccaagggcgcccaggcctgccagatctgcatcacctacatctgcgaggaggacagctacctggccggcaccctgggcctgagcgccgacctgagcaacaacggccaggtgaagccccacaccagctgcagccactacctgcagtag

SEQ ID NO: 9822 - DNA, 267 bp, Artificial Sequence; identical to SEQ ID NO: 9813
  Description of Artificial Sequence: Synthetic coding sequence

SEQ ID NO: 9823 - DNA, 1215 bp, Artificial Sequence; identical to SEQ ID NO: 9816
  Description of Artificial Sequence: Synthetic coding sequence

SEQ ID NO: 9824 - DNA, 792 bp, Artificial Sequence; identical to SEQ ID NO: 9812
  Description of Artificial Sequence: Synthetic coding sequence

SEQ ID NO: 9825 - DNA, 1368 bp, Artificial Sequence
  Description of Artificial Sequence: Synthetic coding sequence
atgaagagccagggccagcactggtacagcagcagcgacaagaactgcaaggtgagcttcagagagaagctgctgatcatcgacagcaacctgggcgtgcaggacgtggagaacctgaagttcctgtgcatcggcctggtgcccaacaagaagctggagaagagcagcagcgccagcgacgtgttcgagcacctgctggccgaggacctgctgagcgaggaggaccccttcttcctggccgagctgctgtacatcatcagacagaagaagctgctgcagcacctgaactgcaccaaggaggaggtggagagactgctgcccaccagacagagagtgagcctgttcagaaacctgctgtacgagctgagcgagggcatcgacagcgagaacctgaaggacatgatcttcctgctgaaggacagcctgcccaagaccgagatgaccagcctgagcttcctggccttcctggagaagcagggcaagatcgacgaggacaacctgacctgcctggaggacctgtgcaagaccgtggtgcccaagctgctgagaaacatcgagaagtacaagagagagaaggccatccagatcgtgaccccccccgtggacaaggaggccgagagctaccagggcgaggaggagctggtgagccagaccgacgtgaagaccttcctggaggccctgccccaggagagctggcagaacaagcacgccggcagcaacgagatcctgagccacgtgttccagtggctgggcttcaccgtgcacatccacaacaacgtgaccaaggtggagatggagatggtgctgcagaagcagaagtgcaaccccgcccacgccgacggcgactgcttcgtgttctgcatcctgacccacggcagattcggcgccgtgtacagcagcgacgaggccctgatccccatcagagagatcatgagccacttcaccgccctgcagtgccccagactggccgagaagcccaagctgttcttcatccaggcctgccagggcgaggagatccagcccagcgtgagcatcgaggccgacgccctgaaccccgagcaggcccccaccagcctgcaggacagcatccccgccgaggccgacttcctgctgggcctggccaccgtgcccggctacgtgagcttcagacacgtggaggagggcagctggtacatccagagcctgtgcaaccacctgaagaagctggtgcccagacacgaggacatcctgagcatcctgaccgccgtgaacgacgacgtgagcagaagagtggacaagcagggcaccaagaagcagatgccccagcccgccttcaccctgagaaagaagctggtgttccccgtgcccctggacgccctgagcctgtag

SEQ ID NO: 9826 - DNA, 1437 bp, Artificial Sequence
  Description of Artificial Sequence: Synthetic coding sequence
atgaagagccagggccagcactggtacagcagcagcgacaagaactgcaaggtgagcttcagagagaagctgctgatcatcgacagcaacctgggcgtgcaggacgtggagaacctgaagttcctgtgcatcggcctggtgcccaacaagaagctggagaagagcagcagcgccagcgacgtgttcgagcacctgctggccgaggacctgctgagcgaggaggaccccttcttcctggccgagctgctgtacatcatcagacagaagaagctgctgcagcacctgaactgcaccaaggaggaggtggagagactgctgcccaccagacagagagtgagcctgttcagaaacctgctgtacgagctgagcgagggcatcgacagcgagaacctgaaggacatgatcttcctgctgaaggacagcctgcccaagaccgagatgaccagcctgagcttcctggccttcctggagaagcagggcaagatcgacgaggacaacctgacctgcctggaggacctgtgcaagaccgtggtgcccaagctgctgagaaacatcgagaagtacaagagagagaaggccatccagatcgtgaccccccccgtggacaaggaggccgagagctaccagggcgaggaggagctggtgagccagaccgacgtgaagaccttcctggaggccctgcccagagccgccgtgtacagaatgaacagaaaccacagaggcctgtgcgtgatcgtgaacaaccacagcttcaccagcctgaaggacagacagggcacccacaaggacgccgagatcctgagccacgtgttccagtggctgggcttcaccgtgcacatccacaacaacgtgaccaaggtggagatggagatggtgctgcagaagcagaagtgcaaccccgcccacgccgacggcgactgcttcgtgttctgcatcctgacccacggcagattcggcgccgtgtacagcagcgacgaggccctgatccccatcagagagatcatgagccacttcaccgccctgcagtgccccagactggccgagaagcccaagctgttcttcatccaggcctgccagggcgaggagatccagcccagcgtgagcatcgaggccgacgccctgaaccccgagcaggcccccaccagcctgcaggacagcatccccgccgaggccgacttcctgctgggcctggccaccgtgcccggctacgtgagcttcagacacgtggaggagggcagctggtacatccagagcctgtgcaaccacctgaagaagctggtgcccagaatgctgaagttcctggagaagaccatggagatcagaggcagaaagagaaccgtgtggggcgccaagcagatcagcgccaccagcctgcccaccgccatcagcgcccagacccccagaccccccatgagaagatggagcagcgtgagctag

SEQ ID NO: 9827 - DNA, 1566 bp, Artificial Sequence
  Description of Artificial Sequence: Synthetic coding sequence
atgaagagccagggccagcactggtacagcagcagcgacaagaactgcaaggtgagcttcagagagaagctgctgatcatcgacagcaacctgggcgtgcaggacgtggagaacctgaagttcctgtgcatcggcctggtgcccaacaagaagctggagaagagcagcagcgccagcgacgtgttcgagcacctgctggccgaggacctgctgagcgaggaggaccccttcttcctggccgagctgctgtacatcatcagacagaagaagctgctgcagcacctgaactgcaccaaggaggaggtggagagactgctgcccaccagacagagagtgagcctgttcagaaacctgctgtacgagctgagcgagggcatcgacagcgagaacctgaaggacatgatcttcctgctgaaggacagcctgcccaagaccgagatgaccagcctgagcttcctggccttcctggagaagcagggcaagatcgacgaggacaacctgacctgcctggaggacctgtgcaagaccgtggtgcccaagctgctgagaaacatcgagaagtacaagagagagaaggccatccagatcgtgaccccccccgtggacaaggaggccgagagctaccagggcgaggaggagctggtgagccagaccgacgtgaagaccttcctggaggccctgccccaggagagctggcagaacaagcacgccggcagcaacggcaacagagccaccaacggcgcccccagcctggtgagcagaggcatgcagggcgccagcgccaacaccctgaacagcgagaccagcaccaagagagccgccgtgtacagaatgaacagaaaccacagaggcctgtgcgtgatcgtgaacaaccacagcttcaccagcctgaaggacagacagggcacccacaaggacgccgagatcctgagccacgtgttccagtggctgggcttcaccgtgcacatccacaacaacgtgaccaaggtggagatggagatggtgctgcagaagcagaagtgcaaccccgcccacgccgacggcgactgcttcgtgttctgcatcctgacccacggcagattcggcgccgtgtacagcagcgacgaggccctgatccccatcagagagatcatgagccacttcaccgccctgcagtgccccagactggccgagaagcccaagctgttcttcatccaggcctgccagggcgaggagatccagcccagcgtgagcatcgaggccgacgccctgaaccccgagcaggcccccaccagcctgcaggacagcatccccgccgaggccgacttcctgctgggcctggccaccgtgcccggctacgtgagcttcagacacgtggaggagggcagctggtacatccagagcctgtgcaaccacctgaagaagctggtgcccagaatgctgaagttcctggagaagaccatggagatcagaggcagaaagagaaccgtgtggggcgccaagcagatcagcgccaccagcctgcccaccgccatcagcgcccagacccccagaccccccatgagaagatggagcagcgtgagctag

SEQ ID NO: 9828 - DNA, 1569 bp, Artificial Sequence
  Description of Artificial Sequence: Synthetic coding sequence
atgaagagccagggccagcactggtacagcagcagcgacaagaactgcaaggtgagcttcagagagaagctgctgatcatcgacagcaacctgggcgtgcaggacgtggagaacctgaagttcctgtgcatcggcctggtgcccaacaagaagctggagaagagcagcagcgccagcgacgtgttcgagcacctgctggccgaggacctgctgagcgaggaggaccccttcttcctggccgagctgctgtacatcatcagacagaagaagctgctgcagcacctgaactgcaccaaggaggaggtggagagactgctgcccaccagacagagagtgagcctgttcagaaacctgctgtacgagctgagcgagggcatcgacagcgagaacctgaaggacatgatcttcctgctgaaggacagcctgcccaagaccgagatgaccagcctgagcttcctggccttcctggagaagcagggcaagatcgacgaggacaacctgacctgcctggaggacctgtgcaagaccgtggtgcccaagctgctgagaaacatcgagaagtacaagagagagaaggccatccagatcgtgaccccccccgtggacaaggaggccgagagctaccagggcgaggaggagctggtgagccagaccgacgtgaagaccttcctggaggccctgccccaggagagctggcagaacaagcacgccggcagcaacggcaacagagccaccaacggcgcccccagcctggtgagcagaggcatgcagggcgccagcgccaacaccctgaacagcgagaccagcaccaagagagccgccgtgtacagaatgaacagaaaccacagaggcctgtgcgtgatcgtgaacaaccacagcttcaccagcctgaaggacagacagggcacccacaaggacgccgagatcctgagccacgtgttccagtggctgggcttcaccgtgcacatccacaacaacgtgaccaaggtggagatggagatggtgctgcagaagcagaagtgcaaccccgcccacgccgacggcgactgcttcgtgttctgcatcctgacccacggcagattcggcgccgtgtacagcagcgacgaggccctgatccccatcagagagatcatgagccacttcaccgccctgcagtgccccagactggccgagaagcccaagctgttcttcatccaggcctgccagggcgaggagatccagcccagcgtgagcatcgaggccgacgccctgaaccccgagcaggcccccaccagcctgcaggacagcatccccgccgaggccgacttcctgctgggcctggccaccgtgcccggctacgtgagcttcagacacgtggaggagggcagctggtacatccagagcctgtgcaaccacctgaagaagctggtgcccagacacgaggacatcctgagcatcctgaccgccgtgaacgacgacgtgagcagaagagtggacaagcagggcaccaagaagcagatgccccagcccgccttcaccctgagaaagaagctggtgttccccgtgcccctggacgccctgagcctgtag

SEQ ID NO: 9829 - DNA, 1440 bp, Artificial Sequence
  Description of Artificial Sequence: Synthetic coding sequence
atgaagagccagggccagcactggtacagcagcagcgacaagaactgcaaggtgagcttcagagagaagctgctgatcatcgacagcaacctgggcgtgcaggacgtggagaacctgaagttcctgtgcatcggcctggtgcccaacaagaagctggagaagagcagcagcgccagcgacgtgttcgagcacctgctggccgaggacctgctgagcgaggaggaccccttcttcctggccgagctgctgtacatcatcagacagaagaagctgctgcagcacctgaactgcaccaaggaggaggtggagagactgctgcccaccagacagagagtgagcctgttcagaaacctgctgtacgagctgagcgagggcatcgacagcgagaacctgaaggacatgatcttcctgctgaaggacagcctgcccaagaccgagatgaccagcctgagcttcctggccttcctggagaagcagggcaagatcgacgaggacaacctgacctgcctggaggacctgtgcaagaccgtggtgcccaagctgctgagaaacatcgagaagtacaagagagagaaggccatccagatcgtgaccccccccgtggacaaggaggccgagagctaccagggcgaggaggagctggtgagccagaccgacgtgaagaccttcctggaggccctgcccagagccgccgtgtacagaatgaacagaaaccacagaggcctgtgcgtgatcgtgaacaaccacagcttcaccagcctgaaggacagacagggcacccacaaggacgccgagatcctgagccacgtgttccagtggctgggcttcaccgtgcacatccacaacaacgtgaccaaggtggagatggagatggtgctgcagaagcagaagtgcaaccccgcccacgccgacggcgactgcttcgtgttctgcatcctgacccacggcagattcggcgccgtgtacagcagcgacgaggccctgatccccatcagagagatcatgagccacttcaccgccctgcagtgccccagactggccgagaagcccaagctgttcttcatccaggcctgccagggcgaggagatccagcccagcgtgagcatcgaggccgacgccctgaaccccgagcaggcccccaccagcctgcaggacagcatccccgccgaggccgacttcctgctgggcctggccaccgtgcccggctacgtgagcttcagacacgtggaggagggcagctggtacatccagagcctgtgcaaccacctgaagaagctggtgcccagacacgaggacatcctgagcatcctgaccgccgtgaacgacgacgtgagcagaagagtggacaagcagggcaccaagaagcagatgccccagcccgccttcaccctgagaaagaagctggtgttccccgtgcccctggacgccctgagcctgtag

SEQ ID NO: 9830 - DNA, 822 bp, Artificial Sequence
  Description of Artificial Sequence: Synthetic coding sequence
atgaagagccagggccagcactggtacagcagcagcgacaagaactgcaaggtgagcttcagagagaagctgctgatcatcgacagcaacctgggcgtgcaggacgtggagaacctgaagttcctgtgcatcggcctggtgcccaacaagaagctggagaagagcagcagcgccagcgacgtgttcgagcacctgctggccgaggacctgctgagcgaggaggaccccttcttcctggccgagctgctgtacatcatcagacagaagaagctgctgcagcacctgaactgcaccaaggaggaggtggagagactgctgcccaccagacagagagtgagcctgttcagaaacctgctgtacgagctgagcgagggcatcgacagcgagaacctgaaggacatgatcttcctgctgaaggacagcctgcccaagaccgagatgaccagcctgagcttcctggccttcctggagaagcagggcaagatcgacgaggacaacctgacctgcctggaggacctgtgcaagaccgtggtgcccaagctgctgagaaacatcgagaagtacaagagagagaaggccatccagatcgtgaccccccccgtggacaaggaggccgagagctaccagggcgaggaggagctggtgagccagaccgacgtgaagaccttcctggaggccctgccccaggagagctggcagaacaagcacgccggcagcaacgagggcagctgcgtgcaggacgagagcgagccccagagacccctgtgccactgccagcagccccagctgtacctgcccgagggccagaccagaaacccctag

SEQ ID NO: 9831 - DNA, 1533 bp, Artificial Sequence
  Description of Artificial Sequence: Synthetic coding sequence
atggccgccgccgccctgagagaccccgcccaggtgcccgtggccgccgacctgctgaccgaccacgaggagggctacgtgaccttcgaggacgtggccgtgtacttcagccaggaggagtggagactgctggacgacgcccagagactgctgtacagaaacgtgatgctggagaacttcaccctgctggccagcctgggcctggccagcagcaagacccacgagatcacccagctggagagctgggaggagcccttcatgcccgcctgggaggtggtgaccagcgccatccccagaggctgctggcacggcgccgaggccgaggaggcccccgagcagatcgccagcgtgggcctgctgagcagcaacatccagcagcaccagaagcagcactgcggcgagaagcccctgaagagacaggagggcagagtgcccgtgctgagaagctgcaaggtgcacctgagcgagaagagcctgcagagcagagaggtgggcaaggccctgctgatcagcagcggcgtgctgaagcaccaggtgacccacaccggcgagaagagccacagaagcagcaagagcagagaggccttccacgccggcaagagacactacaagtgcagcgagtgcggcaaggccttcggccagaagtacctgctggtgcagcaccagagactgcacgccggcaagaagacctacgagtgcagcgagtgcggcaagctgttcagagacatgagcaacctgttcatccaccagatcgtgcacaccggcgagagaccctacggctgcagcaactgcggcaagagcttcagcagaaacgcccacctgatcgagcaccagagagtgcacaccggcgagaagcccttcacctgcagcgagtgcggcaaggccttcagacacaacagcaccctggtgcagcaccacaagatccacaccggcgtgagaccctacgagtgcagcgagtgcggcaagctgttcagcttcaacagcagcctgatgaagcaccagagaatccacaccggcgagagaccctacaagtgcagcgagtgcggcaagttctacagccacaagagcaacctgatcaagcactggagagtgcacaccggcgagagaccctacaagtgcagcgactgcggcaagttcttcacccagtgcagcagcctgatgcagcaccagaaggtgcacaccggcgagaagcccttcaagtgcaacgagtgcggcagattcttcagagagaacagcaccctggtgagacaccagagagtgcacaccggcgccaagccctacgagtgcagagagtgcggcaagttcttcagccagagcagcaccctgatgcagcacagaaaggtgcacatcggcgagaagcccttcaagtgcaacgagtgcggcagactgttcagagagaacagcagcctggtgaagcaccagagagtgcacaccggcgccaagccctacgagtgcagagagtgcggcaagttcttcagacacaacagcagcctgttcaagcacagaagaatccacaccggcgagatgcagtag

SEQ ID NO: 9832 - DNA, 729 bp, Artificial Sequence
  Description of Artificial Sequence: Synthetic coding sequence
atgagcaaccccagaagcctggaggaggagaagtacgacatgagcggcgccagactggccctgatcctgtgcgtgaccaaggccagagagggcagcgaggaggacctggacgccctggagcacatgttcagacagctgagattcgagagcaccatgaagagagaccccaccgccgagcagttccaggaggagctggagaagttccagcaggccatcgacagcagagaggaccccgtgagctgcgccttcgtggtgctgatggcccacggcagagagggcttcctgaagggcgaggacggcgagatggtgaagctggagaacctgttcgaggccctgaacaacaagaactgccaggccctgagagccaagcccaaggtgtacatcatccaggcctgcagaggcgagcagagagaccccggcgagaccgtgggcggcgacgagatcgtgatggtgatcaaggacagcccccagaccatccccacctacaccgacgccctgcacgtgtacagcaccgtggagggctacatcgcctacagacacgaccagaagggcagctgcttcatccagaccctggtggacgtgttcaccaagagaaagggccacatcctggagctgctgaccgaggtgaccagaagaatggccgaggccgagctggtgcaggagggcaaggccagaaagaccaaccccgagatccagagcaccctgagaaagagactgtacctgcagtag

SEQ ID NO: 9833 - DNA, 1359 bp, Artificial Sequence
  Description of Artificial Sequence: Synthetic coding sequence
atggccgcccccagcgccggcagctggagcaccttccagcacaaggagctgatggccgccgacagaggcagaagaatcctgggcgtgtgcggcatgcacccccaccaccaggagaccctgaagaagaacagagtggtgctggccaagcagctgctgctgagcgagctgctggagcacctgctggagaaggacatcatcaccctggagatgagagagctgatccaggccaaggtgggcagcttcagccagaacgtggagctgctgaacctgctgcccaagagaggcccccaggccttcgacgccttctgcgaggccctgagagagaccaagcagggccacctggaggacatgctgctgaccaccctgagcggcctgcagcacgtgctgccccccctgagctgcgactacgacctgagcctgcccttccccgtgtgcgagagctgccccctgtacaagaagctgagactgagcaccgacaccgtggagcacagcctggacaacaaggacggccccgtgtgcctgcaggtgaagccctgcacccccgagttctaccagacccacttccagctggcctacagactgcagagcagacccagaggcctggccctggtgctgagcaacgtgcacttcaccggcgagaaggagctggagttcagaagcggcggcgacgtggaccacagcaccctggtgaccctgttcaagctgctgggctacgacgtgcacgtgctgtgcgaccagaccgcccaggagatgcaggagaagctgcagaacttcgcccagctgcccgcccacagagtgaccgacagctgcatcgtggccctgctgagccacggcgtggagggcgccatctacggcgtggacggcaagctgctgcagctgcaggaggtgttccagctgttcgacaacgccaactgccccagcctgcagaacaagcccaagatgttcttcatccaggcctgcagaggcgacgagaccgacagaggcgtggaccagcaggacggcaagaaccacgccggcagccccggctgcgaggagagcgacgccggcaaggagaagctgcccaagatgagactgcccaccagaagcgacatgatctgcggctacgcctgcctgaagggcaccgccgccatgagaaacaccaagagaggcagctggtacatcgaggccctggcccaggtgttcagcgagagagcctgcgacatgcacgtggccgacatgctggtgaaggtgaacgccctgatcaaggacagagagggctacgcccccggcaccgagttccacagatgcaaggagatgagcgagtactgcagcaccctgtgcagacacctgtacctgttccccggccacccccccacctag

SEQ ID NO: 9834 - DNA, 327 bp, Artificial Sequence
  Description of Artificial Sequence: Synthetic coding sequence
atggccgcccccagcgccggcagctggagcaccttccagcacaaggagctgatggccgccgacagaggcagaagaatcctgggcgtgtgcggcatgcacccccaccaccaggagaccctgaagaagaacagagtggtgctggccaagcagctgctgctgagcgagctgctggagcacctgctggagaaggacatcatcaccctggagatgagagagctgatccaggccaaggtgggcagcttcagccagaacgtggagctgctgaacctgctgcccaagagaggcccccaggccttcgacgccttctgcgaggccctgcacagctag

SEQ ID NO: 9835 - DNA, 942 bp, Artificial Sequence
  Description of Artificial Sequence: Synthetic coding sequence
atgcacccccaccaccaggagaccctgaagaagaacagagtggtgctggccaagcagctgctgctgagcgagctgctggagcacctgctggagaaggacatcatcaccctggagatgagagagctgatccaggccaaggtgggcagcttcagccagaacgtggagctgctgaacctgctgcccaagagaggcccccaggccttcgacgccttctgcgaggccctgagagagaccaagcagggccacctggaggacatgctgctgaccaccctgagcggcctgcagcacgtgctgccccccctgagctgcgactacgacctgagcctgcccttccccgtgtgcgagagctgccccctgtacaagaagctgagactgagcaccgacaccgtggagcacagcctggacaacaaggacggccccgtgtgcctgcaggtgaagccctgcacccccgagttctaccagacccacttccagctggcctacagactgcagagcagacccagaggcctggccctggtgctgagcaacgtgcacttcaccggcgagaaggagctggagttcagaagcggcggcgacgtggaccacagcaccctggtgaccctgttcaagctgctgggctacgacgtgcacgtgctgtgcgaccagaccgcccaggagatgcaggagaagctgcagaacttcgcccagctgcccgcccacagagtgaccgacagctgcatcgtggccctgctgagccacggcgtggagggcgccatctacggcgtggacggcaagctgctgcagctgcaggaggtgttccagctgttcgacaacgccaactgccccagcctgcagaacaagcccaagatgttcttcatccaggcctgcagaggcgccggcgccatcggcagcctgggccacctgctgctgttcaccgccgccaccgccagcctggccctgtag

SEQ ID NO: 9836 - DNA, 993 bp, Artificial Sequence
  Description of Artificial Sequence: Synthetic coding sequence
atgctgaagctgaagaccaagttcggcagctggcagaccctgtgcaagagaagcaacgtgtggcaggacaagtgcttcttcaagcccttcaacatcgaccagatcagccccaacaagaaggcccaccccaacatggaggccggcccccccgagagcggcgagagcaccgacgccctgaagctgtgcccccacgaggagttcctgagactgtgcaaggagagagccgaggagatctaccccatcaaggagagaaacaacagaaccagactggccctgatcatctgcaacaccgagttcgaccacctgccccccagaaacggcgccgacttcgacatcaccggcatgaaggagctgctggagggcctggactacagcgtggacgtggaggagaacctgaccgccagagacatggagagcgccctgagagccttcgccaccagacccgagcacaagagcagcgacagcaccttcctggtgctgatgagccacggcatcctggagggcatctgcggcaccgtgcacgacgagaagaagcccgacgtgctgctgtacgacaccatcttccagatcttcaacaacagaaactgcctgagcctgaaggacaagcccaaggtgatcatcgtgcaggcctgcagaggcgccaacagaggcgagctgtgggtgagagacagccccgccagcctggaggtggccagcagccagagcagcgagaacctggaggaggacgccgtgtacaagacccacgtggagaaggacttcatcgccttctgcagcagcaccccccacaacgtgagctggagagacagcaccatgggcagcatcttcatcacccagctgatcacctgcttccagaagtacagctggtgctgccacctggaggaggtgttcagaaaggtgcagcagagcttcgagacccccagagccaaggcccagatgcccaccatcgagagactgagcatgaccagatacttctacctgttccccggcaactag

SEQ ID NO: 9837 - DNA, 444 bp, Artificial Sequence
  Description of Artificial Sequence: Synthetic coding sequence
atggccgagggcaaccacagaaagaagcccctgaaggtgctggagagcctgggcaaggacttcctgaccggcgtgctggacaacctggtggagcagaacgtgctgaactggaaggaggaggagaagaagaagtactacgacgccaagaccgaggacaaggtgagagtgatggccgacagcatgcaggagaagcagagaatggccggccagatgctgctgcagaccttcttcaacatcgaccagatcagccccaacaagaaggcccaccccaacatggaggccggcccccccgagagcggcgagagcaccgacgccctgaagctgtgcccccacgaggagttcctgagactgtgcaaggagagagccgaggagatctaccccatcaaggagagaaacaacagaaccagactggccctgatcatctgcaacaccgagttcgactag

SEQ ID NO: 9838 - DNA, 1134 bp, Artificial Sequence
  Description of Artificial Sequence: Synthetic coding sequence
atggccgagggcaaccacagaaagaagcccctgaaggtgctggagagcctgggcaaggacttcctgaccggcgtgctggacaacctggtggagcagaacgtgctgaactggaaggaggaggagaagaagaagtactacgacgccaagaccgaggacaaggtgagagtgatggccgacagcatgcaggagaagcagagaatggccggccagatgctgctgcagaccttcttcaacatcgaccagatcagccccaacaagaaggcccaccccaacatggaggccggcccccccgagagcggcgagagcaccgacgccctgaagctgtgcccccacgaggagttcctgagactgtgcaaggagagagccgaggagatctaccccatcaaggagagaaacaacagaaccagactggccctgatcatctgcaacaccgagttcgaccacctgccccccagaaacggcgccgacttcgacatcaccggcatgaaggagctgctggagggcctggactacagcgtggacgtggaggagaacctgaccgccagagacatggagagcgccctgagagccttcgccaccagacccgagcacaagagcagcgacagcaccttcctggtgctgatgagccacggcatcctggagggcatctgcggcaccgtgcacgacgagaagaagcccgacgtgctgctgtacgacaccatcttccagatcttcaacaacagaaactgcctgagcctgaaggacaagcccaaggtgatcatcgtgcaggcctgcagaggcgccaacagaggcgagctgtgggtgagagacagccccgccagcctggaggtggccagcagccagagcagcgagaacctggaggaggacgccgtgtacaagacccacgtggagaaggacttcatcgccttctgcagcagcaccccccacaacgtgagctggagagacagcaccatgggcagcatcttcatcacccagctgatcacctgcttccagaagtacagctggtgctgccacctggaggaggtgttcagaaaggtgcagcagagcttcgagacccccagagccaaggcccagatgcccaccatcgagagactgagcatgaccagatacttctacctgttccccggcaactag

SEQ ID NO: 9839 - DNA, 1305 bp, Artificial Sequence
  Description of Artificial Sequence: Synthetic coding sequence
atggccgaggacagcggcaagaagaagagaagaaagaacttcgaggccatgttcaagggcatcctgcagagcggcctggacaacttcgtgatcaaccacatgctgaagaacaacgtggccggccagaccagcatccagaccctggtgcccaacaccgaccagaagagcaccagcgtgaagaaggacaaccacaagaagaagaccgtgaagatgctggagtacctgggcaaggacgtgctgcacggcgtgttcaactacctggccaagcacgacgtgctgaccctgaaggaggaggagaagaagaagtactacgacaccaagatcgaggacaaggccctgatcctggtggacagcctgagaaagaacagagtggcccaccagatgttcacccagaccctgctgaacatggaccagaagatcaccagcgtgaagcccctgctgcagatcgaggccggcccccccgagagcgccgagagcaccaacatcctgaagctgtgccccagagaggagttcctgagactgtgcaagaagaaccacgacgagatctaccccatcaagaagagagaggacagaagaagactggccctgatcatctgcaacaccaagttcgaccacctgcccgccagaaacggcgcccactacgacatcgtgggcatgaagagactgctgcagggcctgggctacaccgtggtggacgagaagaacctgaccgccagagacatggagagcgtgctgagagccttcgccgccagacccgagcacaagagcagcgacagcaccttcctggtgctgatgagccacggcatcctggagggcatctgcggcaccgcccacaagaagaagaagcccgacgtgctgctgtacgacaccatcttccagatcttcaacaacagaaactgcctgagcctgaaggacaagcccaaggtgatcatcgtgcaggcctgcagaggcgagaagcacggcgagctgtgggtgagagacagccccgccagcctggccctgatcagcagccagagcagcgagaacctggaggccgacagcgtgtgcaagatccacgaggagaaggacttcatcgccttctgcagcagcaccccccacaacgtgagctggagagacagaaccagaggcagcatcttcatcaccgagctgatcacctgcttccagaagtacagctgctgctgccacctgatggagatcttcagaaaggtgcagaagagcttcgaggtgccccaggccaaggcccagatgcccaccatcgagagagccaccctgaccagagacttctacctgttccccggcaactag

SEQ ID NO: 9840 - DNA, 402 bp, Artificial Sequence
  Description of Artificial Sequence: Synthetic coding sequence
atgctgaagaacaacgtggccggccagaccagcatccagaccctggtgcccaacaccgaccagaagagcaccagcgtgaagaaggacaaccacaagaagaagaccgtgaagatgctggagtacctgggcaaggacgtgctgcacggcgtgttcaactacctggccaagcacgacgtgctgaccctgaaggaggaggagaagaagaagtactacgacaccaagatcgaggacaaggccctgatcctggtggacagcctgagaaagaacagagtggcccaccagatgttcacccagaccctgctgaacatggaccagaagatcaccagcgtgaagcacctgagcaacaagaaggagagaggcccccagacccccggcagccaccacatgcagtacaaggtgtag

SEQ ID NO: 9841 - DNA, 1344 bp, Artificial Sequence
  Description of Artificial Sequence: Synthetic coding sequence
atggccgccgtgcccagagtggagggcgtgttcatcttcctgatcgaggacagcggcaagaagaagagaagaaagaacttcgaggccatgttcaagggcatcctgcagagcggcctggacaacttcgtgatcaaccacatgctgaagaacaacgtggccggccagaccagcatccagaccctggtgcccaacaccgaccagaagagcaccagcgtgaagaaggacaaccacaagaagaagaccgtgaagatgctggagtacctgggcaaggacgtgctgcacggcgtgttcaactacctggccaagcacgacgtgctgaccctgaaggaggaggagaagaagaagtactacgacaccaagatcgaggacaaggccctgatcctggtggacagcctgagaaagaacagagtggcccaccagatgttcacccagaccctgctgaacatggaccagaagatcaccagcgtgaagcccctgctgcagatcgaggccggcccccccgagagcgccgagagcaccaacatcctgaagctgtgccccagagaggagttcctgagactgtgcaagaagaaccacgacgagatctaccccatcaagaagagagaggacagaagaagactggccctgatcatctgcaacaccaagttcgaccacctgcccgccagaaacggcgcccactacgacatcgtgggcatgaagagactgctgcagggcctgggctacaccgtggtggacgagaagaacctgaccgccagagacatggagagcgtgctgagagccttcgccgccagacccgagcacaagagcagcgacagcaccttcctggtgctgatgagccacggcatcctggagggcatctgcggcaccgcccacaagaagaagaagcccgacgtgctgctgtacgacaccatcttccagatcttcaacaacagaaactgcctgagcctgaaggacaagcccaaggtgatcatcgtgcaggcctgcagaggcgagaagcacggcgagctgtgggtgagagacagccccgccagcctggccctgatcagcagccagagcagcgagaacctggaggccgacagcgtgtgcaagatccacgaggagaaggacttcatcgccttctgcagcagcaccccccacaacgtgagctggagagacagaaccagaggcagcatcttcatcaccgagctgatcacctgcttccagaagtacagctgctgctgccacctgatggagatcttcagaaaggtgcagaagagcttcgaggtgccccaggccaaggcccagatgcccaccatcgagagagccaccctgaccagagacttctacctgttccccggcaactag

SEQ ID NO: 9842 - DNA, 879 bp, Artificial Sequence
  Description of Artificial Sequence: Synthetic coding sequence
atggccgccctgctgcagatcgaggccggcccccccgagagcgccgagagcaccaacatcctgaagctgtgccccagagaggagttcctgagactgtgcaagaagaaccacgacgagatctaccccatcaagaagagagaggacagaagaagactggccctgatcatctgcaacaccaagttcgaccacctgcccgccagaaacggcgcccactacgacatcgtgggcatgaagagactgctgcagggcctgggctacaccgtggtggacgagaagaacctgaccgccagagacatggagagcgtgctgagagccttcgccgccagacccgagcacaagagcagcgacagcaccttcctggtgctgatgagccacggcatcctggagggcatctgcggcaccgcccacaagaagaagaagcccgacgtgctgctgtacgacaccatcttccagatcttcaacaacagaaactgcctgagcctgaaggacaagcccaaggtgatcatcgtgcaggcctgcagaggcgagaagcacggcgagctgtgggtgagagacagccccgccagcctggccctgatcagcagccagagcagcgagaacctggaggccgacagcgtgtgcaagatccacgaggagaaggacttcatcgccttctgcagcagcaccccccacaacgtgagctggagagacagaaccagaggcagcatcttcatcaccgagctgatcacctgcttccagaagtacagctgctgctgccacctgatggagatcttcagaaaggtgcagaagagcttcgaggtgccccaggccaaggcccagatgcccaccatcgagagagccaccctgaccagagacttctacctgttccccggcaactag

SEQ ID NO: 9843 - DNA, 1131 bp, Artificial Sequence
  Description of Artificial Sequence: Synthetic coding sequence
atggccgaggacaaccacaagaagaagaccgtgaagatgctggagtacctgggcaaggacgtgctgcacggcgtgttcaactacctggccaagcacgacgtgctgaccctgaaggaggaggagaagaagaagtactacgacaccaagatcgaggacaaggccctgatcctggtggacagcctgagaaagaacagagtggcccaccagatgttcacccagaccctgctgaacatggaccagaagatcaccagcgtgaagcccctgctgcagatcgaggccggcccccccgagagcgccgagagcaccaacatcctgaagctgtgccccagagaggagttcctgagactgtgcaagaagaaccacgacgagatctaccccatcaagaagagagaggacagaagaagactggccctgatcatctgcaacaccaagttcgaccacctgcccgccagaaacggcgcccactacgacatcgtgggcatgaagagactgctgcagggcctgggctacaccgtggtggacgagaagaacctgaccgccagagacatggagagcgtgctgagagccttcgccgccagacccgagcacaagagcagcgacagcaccttcctggtgctgatgagccacggcatcctggagggcatctgcggcaccgcccacaagaagaagaagcccgacgtgctgctgtacgacaccatcttccagatcttcaacaacagaaactgcctgagcctgaaggacaagcccaaggtgatcatcgtgcaggcctgcagaggcgagaagcacggcgagctgtgggtgagagacagccccgccagcctggccctgatcagcagccagagcagcgagaacctggaggccgacagcgtgtgcaagatccacgaggagaaggacttcatcgccttctgcagcagcaccccccacaacgtgagctggagagacagaaccagaggcagcatcttcatcaccgagctgatcacctgcttccagaagtacagctgctgctgccacctgatggagatcttcagaaaggtgcagaagagcttcgaggtgccccaggccaaggcccagatgcccaccatcgagagagccaccctgaccagagacttctacctgttccccggcaactag

SEQ ID NO: 9844 - DNA, 1344 bp, Artificial Sequence; identical to SEQ ID NO: 9841
  Description of Artificial Sequence: Synthetic coding sequence

SEQ ID NO: 9845 - DNA, 879 bp, Artificial Sequence; identical to SEQ ID NO: 9842
  Description of Artificial Sequence: Synthetic coding sequence

SEQ ID NO: 9846 - DNA, 882 bp, Artificial Sequence
  Description of Artificial Sequence: Synthetic coding sequence
atgagcagcgccagcggcctgagaagaggccaccccgccggcggcgaggagaacatgaccgagaccgacgccttctacaagagagagatgttcgaccccgccgagaagtacaagatggaccacagaagaagaggcatcgccctgatcttcaaccacgagagattcttctggcacctgaccctgcccgagagaagaggcacctgcgccgacagagacaacctgaccagaagattcagcgacctgggcttcgaggtgaagtgcttcaacgacctgaaggccgaggagctgctgctgaagatccacgaggtgagcaccgtgagccacgccgacgccgactgcttcgtgtgcgtgttcctgagccacggcgagggcaaccacatctacgcctacgacgccaagatcgagatccagaccctgaccggcctgttcaagggcgacaagtgccacagcctggtgggcaagcccaagatcttcatcatccaggcctgcagaggcaaccagcacgacgtgcccgtgatccccctggacgtggtggacaaccagaccgagaagctggacaccaacatcaccgaggtggacgccgccagcgtgtacaccctgcccgccggcgccgacttcctgatgtgctacagcgtggccgagggctactacagccacagagagaccgtgaacggcagctggtacatccaggacctgtgcgagatgctgggcaagtacggcagcagcctggagttcaccgagctgctgaccctggtgaacagaaaggtgagccagagaagagtggacttctgcaaggaccccagcgccatcggcaagaagcaggtgccctgcttcgccagcatgctgaccaagaagctgcacttcttccccaagagcaactag

SEQ ID NO: 9847 - DNA, 615 bp, Artificial Sequence
  Description of Artificial Sequence: Synthetic coding sequence
atgagcagcgccagcggcctgagaagaggccaccccgccgtgagcaccgtgagccacgccgacgccgactgcttcgtgtgcgtgttcctgagccacggcgagggcaaccacatctacgcctacgacgccaagatcgagatccagaccctgaccggcctgttcaagggcgacaagtgccacagcctggtgggcaagcccaagatcttcatcatccaggcctgcagaggcaaccagcacgacgtgcccgtgatccccctggacgtggtggacaaccagaccgagaagctggacaccaacatcaccgaggtggacgccgccagcgtgtacaccctgcccgccggcgccgacttcctgatgtgctacagcgtggccgagggctactacagccacagagagaccgtgaacggcagctggtacatccaggacctgtgcgagatgctgggcaagtacggcagcagcctggagttcaccgagctgctgaccctggtgaacagaaaggtgagccagagaagagtggacttctgcaaggaccccagcgccatcggcaagaagcaggtgccctgcttcgccagcatgctgaccaagaagctgcacttcttccccaagagcaactag

SEQ ID NO: 9848 - DNA, 912 bp, Artificial Sequence
  Description of Artificial Sequence: Synthetic coding sequence
atggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagctgcgccaagatgcaggacctgctgaagaaggccagcgaggaggaccacaccaacgccgcctgcttcgcctgcatcctgctgagccacggcgaggagaacgtgatctacggcaaggacggcgtgacccccatcaaggacctgaccgcccacttcagaggcgacagatgcaagaccctgctggagaagcccaagctgttcttcatccaggcctgcagaggcaccgagctggacgacggcatccaggccgacagcggccccatcaacgacaccgacgccaaccccagatacaagatccccgtggaggccgacttcctgttcgcctacagcaccgtgcccggctactacagctggagaagccccggcagaggcagctggttcgtgcaggccctgtgcagcatcctggaggagcacggcaaggacctggagatcatgcagatcctgaccagagtgaacgacagagtggccagacacttcgagagccagagcgacgacccccacttccacgagaagaagcagatcccctgcgtggtgagcatgctgaccaaggagctgtacttcagccagtag

SEQ ID NO: 9849 - DNA, 912 bp, Artificial Sequence; identical to SEQ ID NO: 9848
  Description of Artificial Sequence: Synthetic coding sequence

SEQ ID NO: 9850 - DNA, 663 bp, Artificial Sequence
  Description of Artificial Sequence: Synthetic coding sequence
atggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagcgtgacccaggccggcgtgcagagaagagacctgggcagactgcagccccccccccccagattcaagcagtacagctgcctgagcctgctgagcagctgggactacagacacgccccccccagactggccaacttctgcatcttcagaagagagggcttcagacacgtgggccaggccggcctgaagctgctggccagcagcgacccccccaccagcggcagccagagcgccggcatcaccggcgtgagcctgcacacccagccccagatcatgaaggtgagcctgagacactgcaacaccttcatctgcttcgcctag

SEQ ID NO: 9851 - DNA, 912 bp, Artificial Sequence; identical to SEQ ID NO: 9848
  Description of Artificial Sequence: Synthetic coding sequence

SEQ ID NO: 9852 - DNA, 663 bp, Artificial Sequence
  Description of Artificial Sequence: Synthetic coding sequence
atggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagcttcacccaggccggcgtgcagagaagagacctgggcagactgcagccccccccccccagattcaagcagtacagctgcctgagcctgctgagcagctgggactacagacacgccccccccagactggccaacttctgcatcttcagaagagagggcttcagacacgtgggccaggccggcctgaagctgctggccagcagcgacccccccaccagcggcagccagagcgccggcatcaccggcgtgagcctgcacacccagccccagatcatgaaggtgagcctgagacactgcaacaccttcatctgcttcgcctag

SEQ ID NO: 9853 - DNA, 1011 bp, Artificial Sequence
  Description of Artificial Sequence: Synthetic coding sequence
atggactgcgtgggctggccccccggcagaaagtggcacctggagaagaacaccagctgcggcggcagcagcggcatctgcgccagctacgtgacccagatggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagctgcgccaagatgcaggacctgctgaagaaggccagcgaggaggaccacaccaacgccgcctgcttcgcctgcatcctgctgagccacggcgaggagaacgtgatctacggcaaggacggcgtgacccccatcaaggacctgaccgcccacttcagaggcgacagatgcaagaccctgctggagaagcccaagctgttcttcatccaggcctgcagaggcaccgagctggacgacggcatccaggccgacagcggccccatcaacgacaccgacgccaaccccagatacaagatccccgtggaggccgacttcctgttcgcctacagcaccgtgcccggctactacagctggagaagccccggcagaggcagctggttcgtgcaggccctgtgcagcatcctggaggagcacggcaaggacctggagatcatgcagatcctgaccagagtgaacgacagagtggccagacacttcgagagccagagcgacgacccccacttccacgagaagaagcagatcccctgcgtggtgagcatgctgaccaaggagctgtacttcagccagtag

SEQ ID NO: 9854 - DNA, 762 bp, Artificial Sequence
  Description of Artificial Sequence: Synthetic coding sequence
atggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagctgcgccaagatgcaggacctgctgaagaaggccagcgaggaggaccacaccaacgccgcctgcttcgcctgcatcctgctgagccacggcgaggagaacatggagagctgcagcgtgacccaggccggcgtgcagagaagagacctgggcagactgcagccccccccccccagactggccgagggccccagcctgatgatggccagcagacccaccagaggccccagcatgacccagatgctgatcctggacaccagaagccagtggaagctgaccagcagcagccccatccccagattccaggccatcaccagaggcggcgcccaggaggaggcccccggcctgtgcaagcccagcgcccccagctggagaagcaccgagaagacctggaagagctgcagaagcagccccggctag

SEQ ID NO: 9855 - DNA, 669 bp, Artificial Sequence
  Description of Artificial Sequence: Synthetic coding sequence
atggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagctgcgccaagatgcaggacctgctgaagaaggccagcgaggaggaccacaccaacgccgcctgcttcgcctgcatcctgctgagccacggcgaggagaacgtgatctacggcaaggacggcgtgacccccatcaaggacctgaccgcccacttcagaggcgacagatgcaagaccctgctggagaagcccaagctgttcttcatccaggcctgcagaggcaccgagctggacgacggcatccaggccgacagcggccccatcaacgacaccgacgccaaccccagatacaagatccccgtggaggccgacttcctgttcgcctag

SEQ ID NO: 9856 - DNA, 795 bp, Artificial Sequence
  Description of Artificial Sequence: Synthetic coding sequence
atggccgacgaccagggctgcatcgaggagcagggcgtggaggacagcgccaacgaggacagcgtggacgccaagcccgacagaagcagcttcgtgcccagcctgttcagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagctgcgccaagatgcaggacctgctgaagaaggccagcgaggaggaccacaccaacgccgcctgcttcgcctgcatcctgttcttcatccaggcctgcagaggcaccgagctggacgacggcatccaggccgacagcggccccatcaacgacaccgacgccaaccccagatacaagatccccgtggaggccgacttcctgttcgcctacagcaccgtgcccggctactacagctggagaagccccggcagaggcagctggttcgtgcaggccctgtgcagcatcctggaggagcacggcaaggacctggagatcatgcagatcctgaccagagtgaacgacagagtggccagacacttcgagagccagagcgacgacccccacttccacgagaagaagcagatcccctgcgtggtgagcatgctgaccaaggagctgtacttcagccagtag

SEQ ID NO: 9857 - DNA, 837 bp, Artificial Sequence
  Description of Artificial Sequence: Synthetic coding sequence
atgcagagaggcctgttcagcgacggcgacaccagcaagaagaagaagaacgtgaccatgagaagcatcaagaccaccagagacagagtgcccacctaccagtacaacatgaacttcgagaagctgggcaagtgcatcatcatcaacaacaagaacttcgacaaggtgaccggcatgggcgtgagaaacggcaccgacaaggacgccgaggccctgttcaagtgcttcagaagcctgggcttcgacgtgatcgtgtacaacgactgcagctgcgccaagatgcaggacctgctgaagaaggccagcgaggaggaccacaccaacgccgcctgcttcgcctgcatcctgctgagccacggcgaggagaacgtgatctacggcaaggacggcgtgacccccatcaaggacctgaccgcccacttcagaggcgacagatgcaagaccctgctggagaagcccaagctgttcttcatccaggcctgcagaggcaccgagctggacgacggcatccaggccgacagcggccccatcaacgacaccgacgccaaccccagatacaagatccccgtggaggccgacttcctgttcgcctacagcaccgtgcccggctactacagctggagaagccccggcagaggcagctggttcgtgcaggccctgtgcagcatcctggaggagcacggcaaggacctggagatcatgcagatcctgaccagagtgaacgacagagtggccagacacttcgagagccagagcgacgacccccacttccacgagaagaagcagatcccctgcgtggtgagcatgctgaccaaggagctgtacttcagccagtag

SEQ ID NO: 9858 - DNA, 1188 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaagggcgccctgaccaccaccttcgaggagctgcacttcgagatcaagccccacgacgactgcaccgtggagcagatctacgagatcctgaagatctaccagctgatggaccacagcaacatggactgcttcatctgctgcatcctgagccacggcgacaagggcatcatctacggcaccgacggccaggaggcccccatctacgagctgaccagccagttcaccggcctgaagtgccccagcctggccggcaagcccaaggtgttcttcatccaggcctgccagggcgacaactaccagaagggcatccccgtggagaccgacagcgaggagcagccctacctggagatggacctgagcagcccccagaccagatacatccccgacgaggccgacttcctgctgggcatggccaccgtgaacaactgcgtgagctacagaaaccccgccgagggcacctggtacatccagagcctgtgccagagcctgagagagagatgccccagaggcgacgacatcctgaccatcctgaccgaggtgaactacgaggtgagcaacaaggacgacaagaagaacatgggcaagcagatgccccagcccaccttcaccctgagaaagaagctggtgttccccagcgactag

SEQ ID NO: 9859 - DNA, 1491 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagattccacttctgcagaatgagctgggccgaggccaacagccagtgccagacccagagcgtgcccttctggagaagagtggaccacctgctgatcagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaagggcgaggagctgtgcggcgtgatgaccatcagcgacagccccagagagcaggacagcgagagccagaccctggacaaggtgtaccagatgaagagcaagcccagaggctactgcctgatcatcaacaaccacaacttcgccaaggccagagagaaggtgcccaagctgcacagcatcagagacagaaacggcacccacctggacgccggcgccctgaccaccaccttcgaggagctgcacttcgagatcaagccccacgacgactgcaccgtggagcagatctacgagatcctgaagatctaccagctgatggaccacagcaacatggactgcttcatctgctgcatcctgagccacggcgacaagggcatcatctacggcaccgacggccaggaggcccccatctacgagctgaccagccagttcaccggcctgaagtgccccagcctggccggcaagcccaaggtgttcttcatccaggcctgccagggcgacaactaccagaagggcatccccgtggagaccgacagcgaggagcagccctacctggagatggacctgagcagcccccagaccagatacatccccgacgaggccgacttcctgctgggcatggccaccgtgaacaactgcgtgagctacagaaaccccgccgagggcacctggtacatccagagcctgtgccagagcctgagagagagatgccccagaggcgacgacatcctgaccatcctgaccgaggtgaactacgaggtgagcaacaaggacgacaagaagaacatgggcaagcagatgccccagcccaccttcaccctgagaaagaagctggtgttccccagcgactag

SEQ ID NO: 9860 - DNA, 1395 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaagggcgaggagctgtgcggcgtgatgaccatcagcgacagccccagagagcaggacagcgagagccagaccctggacaaggtgtaccagatgaagagcaagcccagaggctactgcctgatcatcaacaaccacaacttcgccaaggccagagagaaggtgcccaagctgcacagcatcagagacagaaacggcacccacctggacgccggcgccctgaccaccaccttcgaggagctgcacttcgagatcaagccccacgacgactgcaccgtggagcagatctacgagatcctgaagatctaccagctgatggaccacagcaacatggactgcttcatctgctgcatcctgagccacggcgacaagggcatcatctacggcaccgacggccaggaggcccccatctacgagctgaccagccagttcaccggcctgaagtgccccagcctggccggcaagcccaaggtgttcttcatccaggcctgccagggcgacaactaccagaagggcatccccgtggagaccgacagcgaggagcagccctacctggagatggacctgagcagcccccagaccagatacatccccgacgaggccgacttcctgctgggcatggccaccgtgaacaactgcgtgagctacagaaaccccgccgagggcacctggtacatccagagcctgtgccagagcctgagagagagatgccccagaggcgacgacatcctgaccatcctgaccgaggtgaactacgaggtgagcaacaaggacgacaagaagaacatgggcaagcagatgccccagcccaccttcaccctgagaaagaagctggtgttccccagcgactag

SEQ ID NO: 9861 - DNA, 1617 bp, Artificial Sequence
  Description of Artificial Sequence: Synthetic coding sequence
atggagggcggcagaagagccagagtggtgatcgagagcaagagaaacttcttcctgggcgccttccccacccccttccccgccgagcacgtggagctgggcagactgggcgacagcgagaccgccatggtgcccggcaagggcggcgccgactacatcctgctgcccttcaagaagatggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaaggagagaagcagcagcctggagggcagccccgacgagttcagcaacggcgaggagctgtgcggcgtgatgaccatcagcgacagccccagagagcaggacagcgagagccagaccctggacaaggtgtaccagatgaagagcaagcccagaggctactgcctgatcatcaacaaccacaacttcgccaaggccagagagaaggtgcccaagctgcacagcatcagagacagaaacggcacccacctggacgccggcgccctgaccaccaccttcgaggagctgcacttcgagatcaagccccacgacgactgcaccgtggagcagatctacgagatcctgaagatctaccagctgatggaccacagcaacatggactgcttcatctgctgcatcctgagccacggcgacaagggcatcatctacggcaccgacggccaggaggcccccatctacgagctgaccagccagttcaccggcctgaagtgccccagcctggccggcaagcccaaggtgttcttcatccaggcctgccagggcgacaactaccagaagggcatccccgtggagaccgacagcgaggagcagccctacctggagatggacctgagcagcccccagaccagatacatccccgacgaggccgacttcctgctgggcatggccaccgtgaacaactgcgtgagctacagaaaccccgccgagggcacctggtacatccagagcctgtgccagagcctgagagagagatgccccagaggcgacgacatcctgaccatcctgaccgaggtgaactacgaggtgagcaacaaggacgacaagaagaacatgggcaagcagatgccccagcccaccttcaccctgagaaagaagctggtgttccccagcgactag

SEQ ID NO: 9862 - DNA, 708 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaaggagagaagcagcagcctggagggcagccccgacgagttcagcaacgacttcggccagagcctgcccaacgagaagcagaccagcggcatcctgagcgaccaccagcagagccagttctgcaagagcaccggcgagagcgcccagaccagccagcactag

SEQ ID NO: 9863 - DNA, 708 bp, Artificial Sequence; identical to SEQ ID NO: 9862
  Description of Artificial Sequence: Synthetic coding sequence

SEQ ID NO: 9864 - DNA, 837 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaagggcgaggagctgtgcggcgtgatgaccatcagcgacagccccagagagcaggacagcgagagccagaccctggacaaggtgtaccagatgaagagcaagcccagaggctactgcctgatcatcaacaaccacaacttcgccaaggccagagagaaggtgcccaagctgcacagcatcagagacagaaacggcacccacctggacgccggcagccacagcgtggcccaggccggcgtgcagtggtgcgacctgagcagcctgcagcccccccccccctggttcaagtag

SEQ ID NO: 9865 - DNA, 1395 bp, Artificial Sequence; identical to SEQ ID NO: 9860
  Description of Artificial Sequence: Synthetic coding sequence

SEQ ID NO: 9866 - DNA, 663 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaaggacttcggccagagcctgcccaacgagaagcagaccagcggcatcctgagcgaccaccagcagagccagttctgcaagagcaccggcgagagcgcccagaccagccagcactag

SEQ ID NO: 9867 - DNA, 597 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaaggagagaagcagcagcctggagggcagccccgacgagttcagcaactag

SEQ ID NO: 9868 - DNA, 351 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagtag

SEQ ID NO: 9869 - DNA, 1440 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaaggagagaagcagcagcctggagggcagccccgacgagttcagcaacggcgaggagctgtgcggcgtgatgaccatcagcgacagccccagagagcaggacagcgagagccagaccctggacaaggtgtaccagatgaagagcaagcccagaggctactgcctgatcatcaacaaccacaacttcgccaaggccagagagaaggtgcccaagctgcacagcatcagagacagaaacggcacccacctggacgccggcgccctgaccaccaccttcgaggagctgcacttcgagatcaagccccacgacgactgcaccgtggagcagatctacgagatcctgaagatctaccagctgatggaccacagcaacatggactgcttcatctgctgcatcctgagccacggcgacaagggcatcatctacggcaccgacggccaggaggcccccatctacgagctgaccagccagttcaccggcctgaagtgccccagcctggccggcaagcccaaggtgttcttcatccaggcctgccagggcgacaactaccagaagggcatccccgtggagaccgacagcgaggagcagccctacctggagatggacctgagcagcccccagaccagatacatccccgacgaggccgacttcctgctgggcatggccaccgtgaacaactgcgtgagctacagaaaccccgccgagggcacctggtacatccagagcctgtgccagagcctgagagagagatgccccagaggcgacgacatcctgaccatcctgaccgaggtgaactacgaggtgagcaacaaggacgacaagaagaacatgggcaagcagatgccccagcccaccttcaccctgagaaagaagctggtgttccccagcgactag

SEQ ID NO: 9870 - DNA, 375 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgtag

SEQ ID NO: 9871 - DNA, 630 bp, Artificial Sequence
  Description of Artificial Sequence: Synthetic coding sequence
atggacttcagcagaaacctgtacgacatcggcgagcagctggacagcgaggacctggccagcctgaagttcctgagcctggactacatcccccagagaaagcaggagcccatcaaggacgccctgatgctgttccagagactgcaggagaagagaatgctggaggagagcaacctgagcttcctgaaggagctgctgttcagaatcaacagactggacctgctgatcacctacctgaacaccagaaaggaggagatggagagagagctgcagacccccggcagagcccagatcagcgcctacagagtgatgctgtaccagatcagcgaggaggtgagcagaagcgagctgagaagcttcaagttcctgctgcaggaggagatcagcaagtgcaagctggacgacgacatgaacctgctggacatcttcatcgagatggagaagagagtgatcctgggcgagggcaagctggacatcctgaagagagtgtgcgcccagatcaacaagagcctgctgaagatcatcaacgactacgaggagttcagcaaggacttcggccagagcctgcccaacgagaagcagaccagcggcatcctgagcgaccaccagcagagccagttctgcaagtag

SEQ ID NO: 9872 - DNA, 1251 bp, Artificial Sequence
  Description of Artificial Sequence: Synthetic coding sequence
atggacgaggccgacagaagactgctgagaagatgcagactgagactggtggaggagctgcaggtggaccagctgtgggacgccctgctgagcagagagctgttcagaccccacatgatcgaggacatccagagagccggcagcggcagcagaagagaccaggccagacagctgatcatcgacctggagaccagaggcagccaggccctgcccctgttcatcagctgcctggaggacaccggccaggacatgctggccagcttcctgagaaccaacagacaggccgccaagctgagcaagcccaccctggagaacctgacccccgtggtgctgagacccgagatcagaaagcccgaggtgctgagacccgagacccccagacccgtggacatcggcagcggcggcttcggcgacgtgggcgccctggagagcctgagaggcaacgccgacctggcctacatcctgagcatggagccctgcggccactgcctgatcatcaacaacgtgaacttctgcagagagagcggcctgagaaccagaaccggcagcaacatcgactgcgagaagctgagaagaagattcagcagcctgcacttcatggtggaggtgaagggcgacctgaccgccaagaagatggtgctggccctgctggagctggcccagcaggaccacggcgccctggactgctgcgtggtggtgatcctgagccacggctgccaggccagccacctgcagttccccggcgccgtgtacggcaccgacggctgccccgtgagcgtggagaagatcgtgaacatcttcaacggcaccagctgccccagcctgggcggcaagcccaagctgttcttcatccaggcctgcggcggcgagcagaaggaccacggcttcgaggtggccagcaccagccccgaggacgagagccccggcagcaaccccgagcccgacgccacccccttccaggagggcctgagaaccttcgaccagctggacgccatcagcagcctgcccacccccagcgacatcttcgtgagctacagcaccttccccggcttcgtgagctggagagaccccaagagcggcagctggtacgtggagaccctggacgacatcttcgagcagtgggcccacagcgaggacctgcagagcctgctgctgagagtggccaacgccgtgagcgtgaagggcatctacaagcagatgcccggctgcttcaacttcctgagaaagaagctgttcttcaagaccagctag

SEQ ID NO: 9873 - DNA, 801 bp, Artificial Sequence
  Description of Artificial Sequence: Synthetic coding sequence
atggacgaggccgacagaagactgctgagaagatgcagactgagactggtggaggagctgcaggtggaccagctgtgggacgccctgctgagcagagagctgttcagaccccacatgatcgaggacatccagagagccggcagcggcagcagaagagaccaggccagacagctgatcatcgacctggagaccagaggcagccaggccctgcccctgttcatcagctgcctggaggacaccggccaggacatgctggccagcttcctgagaaccaacagacaggccgccaagctgagcaagcccaccctggagaacctgacccccgtggtgctgagacccgagatcagaaagcccgaggtgctgagacccgagacccccagacccgtggacatcggcagcggcggcttcggcgacgtggagcagaaggaccacggcttcgaggtggccagcaccagccccgaggacgagagccccggcagcaaccccgagcccgacgccacccccttccaggagggcctgagaaccttcgaccagctggacgccatcagcagcctgcccacccccagcgacatcttcgtgagctacagcaccttccccggcttcgtgagctggagagaccccaagagcggcagctggtacgtggagaccctggacgacatcttcgagcagtgggcccacagcgaggacctgcagagcctgctgctgagagtggccaacgccgtgagcgtgaagggcatctacaagcagatgcccggctgcttcaacttcctgagaaagaagctgttcttcaagaccagctag

SEQ ID NO: 9874 - DNA, 603 bp, Artificial Sequence
  Description of Artificial Sequence: Synthetic coding sequence
atggagccctgcggccactgcctgatcatcaacaacgtgaacttctgcagagagagcggcctgagaaccagaaccggcagcaacatcgactgcgagaagctgagaagaagattcagcagcctgcacttcatggtggaggtgaagggcgacctgaccgccaagaagatggtgctggccctgctggagctggcccagcaggaccacggcgccctggactgctgcgtggtggtgatcctgagccacggctgccaggccagccacctgcagttccccggcgccgtgtacggcaccgacggctgccccgtgagcgtggagaagatcgtgaacatcttcaacggcaccagctgccccagcctgggcggcaagcccaagctgttcttcatccaggcctgcggcggcggcttcgtgagctggagagaccccaagagcggcagctggtacgtggagaccctggacgacatcttcgagcagtgggcccacagcgaggacctgcagagcctgctgctgagagtggccaacgccgtgagcgtgaagggcatctacaagcagatgcccggctgcttcaacttcctgagaaagaagctgttcttcaagaccagctag

SEQ ID NO: 9875 - DNA, 1002 bp, Artificial Sequence
  Description of Artificial Sequence: Synthetic coding sequence
atgctggccagcttcctgagaaccaacagacaggccgccaagctgagcaagcccaccctggagaacctgacccccgtggtgctgagacccgagatcagaaagcccgaggtgctgagacccgagacccccagacccgtggacatcggcagcggcggcttcggcgacgtgggcgccctggagagcctgagaggcaacgccgacctggcctacatcctgagcatggagccctgcggccactgcctgatcatcaacaacgtgaacttctgcagagagagcggcctgagaaccagaaccggcagcaacatcgactgcgagaagctgagaagaagattcagcagcctgcacttcatggtggaggtgaagggcgacctgaccgccaagaagatggtgctggccctgctggagctggcccagcaggaccacggcgccctggactgctgcgtggtggtgatcctgagccacggctgccaggccagccacctgcagttccccggcgccgtgtacggcaccgacggctgccccgtgagcgtggagaagatcgtgaacatcttcaacggcaccagctgccccagcctgggcggcaagcccaagctgttcttcatccaggcctgcggcggcgagcagaaggaccacggcttcgaggtggccagcaccagccccgaggacgagagccccggcagcaaccccgagcccgacgccacccccttccaggagggcctgagaaccttcgaccagctggacgccatcagcagcctgcccacccccagcgacatcttcgtgagctacagcaccttccccggcttcgtgagctggagagaccccaagagcggcagctggtacgtggagaccctggacgacatcttcgagcagtgggcccacagcgaggacctgcagagcctgctgctgagagtggccaacgccgtgagcgtgaagggcatctacaagcagatgcccggctgcttcaacttcctgagaaagaagctgttcttcaagaccagctag

SEQ ID NO: 9876 - DNA, 765 bp, Artificial Sequence
  Description of Artificial Sequence: Synthetic coding sequence
atggacgaggccgacagaagactgctgagaagatgcagactgagactggtggaggagctgcaggtggaccagctgtgggacgccctgctgagcagagagctgttcagaccccacatgatcgaggacatccagagagccggcagcggcagcagaagagaccaggccagacagctgatcatcgacctggagaccagaggcagccaggccctgcccctgttcatcagctgcctggaggacaccggccaggacatgctggccagcttcctgagaaccaacagacaggccgccaagctgagcaagcccaccctggagaacctgacccccgtggtgctgagacccgagatcagaaagcccgaggtgctgagacccgagacccccagacccgtggacatcggcagcggcggcttcggcgacgtgggcgccctggagagcctgagaggcaacgccgacctggcctacatcctgagcatggagccctgcggccactgcctgatcatcaacaacgtgaacttctgcagagagagcggcctgagaaccagaaccggcagcaacatcgactgcgagaagctgagaagaagattcagcagcctgcacttcatggtggaggtgaagggcgacctgaccgccaaggccagccacctgcagttccccggcgccgtgtacggcaccgacggctgccccgtgagcgtggagaagatcgtgaacatcttcaacggcaccagctgccccagcctgggcggcaagcccaagctgttcttcatctag

SEQ ID NO: 9877 - DNA, 801 bp, Artificial Sequence
  Description of Artificial Sequence: Synthetic coding sequence
atgctggccagcttcctgagaaccaacagacaggccgccaagctgagcaagcccaccctggagaacctgacccccgtggtgctgagacccgagatcagaaagcccgaggtgctgagacccgagacccccagacccgtggacatcggcagcggcggcttcggcgacgtgggcgccctggagagcctgagaggcaacgccgacctggcctacatcctgagcatggagccctgcggccactgcctgatcatcaacaacgtgaacttctgcagagagagcggcctgagaaccagaaccggcagcaacatcgactgcgagaagctgagaagaagattcagcagcctgcacttcatggtggaggtgaagggcgacctgaccgccaagaagatggtgctggccctgctggagctggcccagcaggaccacggcgccctggactgctgcgtggtggtgatcctgagccacggctgccaggccagccacctgcagttccccggcgccgtgtacggcaccgacggctgccccgtgagcgtggagaagatcgtgaacatcttcaacggcaccagctgccccagcctgggcggcaagcccaagctgttcttcatccaggcctgcggcggcgagcagaaggaccacggcttcgaggtggccagcaccagccccgaggacgagagccccggcagcaaccccgagcccgacgccacccccttccaggagggcctgagaaccttcgaccagctggacgccatcagcagcctgcccacccccagcgacatcttcgtgagctacagcaccttcccctag

SEQ ID NO: 9878 - DNA, 1266 bp, Artificial Sequence
  Description of Artificial Sequence: Synthetic coding sequence
atggacgaggccgacagaagactgctgagaagatgcagactgagactggtggaggagctgcaggtggaccagctgtgggacgccctgctgagcagagagctgttcagaccccacatgatcgaggacatccagagagccggcagcggcagcagaagagaccaggccagacagctgatcatcgacctggagaccagaggcagccaggccctgcccctgttcatcagctgcctggaggacaccggccaggacatgctggccagcttcctgagaaccaacagacaggccgccaagctgagcaagcccaccctggagaacctgacccccgtggtgctgagacccgagatcagaaagcccgaggtgctgagacccgagacccccagacccgtggacatcggcagcggcggcttcggcgacgtgggcgccctggagagcctgagaggcaacgccgacctggcctacatcctgagcatggagccctgcggccactgcctgatcatcaacaacgtgaacttctgcagagagagcggcctgagaaccagaaccggcagcaacatcgactgcgagaagctgagaagaagattcagcagcctgcacttcatggtggaggtgaagggcgacctgaccgccaagaagatggtgctggccctgctggagctggcccagcaggaccacggcgccctggactgctgcgtggtggtgatcctgagccacggctgccaggccagccacctgcagttccccggcgccgtgtacggcaccgacggctgccccgtgagcgtggagaagatcgtgaacatcttcaacggcaccagctgccccagcctgggcggcaagcccaagctgttcttcatccaggcctgcggcggcgagcagaaggaccacggcttcgaggtggccagcaccagccccgaggacgagagccccggcagcaaccccgagcccgacgccacccccttccaggagggcctgagaaccttcgaccagctggacgccatcagcagcctgcccacccccagcgacatcttcgtgagctacagcaccttccccggcttcgtgagctggagagaccccaagagcggcagctggtacgtggagaccctggacgacatcttcgagcagtgggcccacagcgaggacctgcagagcctgctgctgagagtgagcgccgccttcctgtgcaagggcgagggcagactgctgagaggcagcgtgagcagctggggctggggcttcggcgtgagcagagccggccccaaccagggctag

SEQ ID NO: 9879 - DNA, 2721 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaacatggtgagagccgccagagccctgctgagcgccgtgaccagactgctgatcctggccgacatggccgacgtgtacaagctgctggtgcagctgaaggtggtggaggacggcatcctgaagctgagaaacgccggcaacgagcaggacctgggcatccagtacaaggccctgaagcccgaggtggacaagctgaacatcatggccgccaagagacagcaggagctgaaggacgtgggccacagagaccagatggccgccgccagaggcatcctgcagaagaacgtgcccatcctgtacaccgccagccaggcctgcctgcagcaccccgacgtggccgcctacaaggccaacagagacctgatctacaagcagctgcagcaggccgtgaccggcatcagcaacgccgcccaggccaccgccagcgacgacgccagccagcaccagggcggcggcggcggcgagctggcctacgccctgaacaacttcgacaagcagatcatcgtggaccccctgagcttcagcgaggagagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgggcaacgccggcagaaaggagagaagcgacgccctgaacagcgccatcgacaagatgaccaagaagaccagagacctgagaagacagctgagaaaggccgtgatggaccacgtgagcgacagcttcctggagaccaacgtgcccctgctggtgctgatcgaggccgccaagaacggcaacgagaaggaggtgaaggagtacgcccaggtgttcagagagcacgccaacaagctgatcgaggtggccaacctggcctgcagcatcagcaacaacgaggagggcgtgaagctggtgagaatgagcgccagccagctggaggccctgtgcccccaggtgatcaacgccgccctggccctggccgccaagccccagagcaagctggcccaggagaacatggacctgttcaaggagcagtgggagaagcaggtgagagtgctgaccgacgccgtggacgacatcaccagcatcgacgacttcctggccgtgagcgagaaccacatcctggaggacgtgaacaagtgcgtgatcgccctgcaggagaaggacgtggacggcctggacagaaccgccggcgccatcagaggcagagccgccagagtgatccacgtggtgaccagcgagatggacaactacgagcccggcgtgtacaccgagaaggtgctggaggccaccaagctgctgagcaacaccgtgatgcccagattcaccgagcaggtggaggccgccgtggaggccctgagcagcgaccccgcccagcccatggacgagaacgagttcatcgacgccagcagactggtgtacgacggcatcagagacatcagaaaggccgtgctgatgatcagaacccccgaggagctggacgacagcgacttcgagaccgaggacttcgacgtgagaagcagaaccagcgtgcagaccgaggacgaccagctgatcgccggccagagcgccagagccatcatggcccagctgccccaggagcagaaggccaagatcgccgagcaggtggccagcttccaggaggagaagagcaagctggacgccgaggtgagcaagtgggacgacagcggcaacgacatcatcgtgctggccaagcagatgtgcatgatcatgatggagatgaccgacttcaccagaggcaagggccccctgaagaacaccagcgacgtgatcagcgccgccaagaagatcgccgaggccggcagcagaatggacaagctgggcagaaccatcgccgaccactgccccgacagcgcctgcaagcaggacctgctggcctacctgcagagaatcgccctgtactgccaccagctgaacatctgcagcaaggtgaaggccgaggtgcagaacctgggcggcgagctggtggtgagcggcgtggacagcgccatgagcctgatccaggccgccaagaacctgatgaacgccgtggtgcagaccgtgaaggccagctacgtggccagcaccaagtaccagaagagccagggcatggccagcctgaacctgcccgccgtgagctggaagatgaaggcccccgagaagaagcccctggtgaagagagagaagcaggacgagacccagaccaagatcaagagagccagccagaagaagcacgtgaaccccgtgcaggccctgagcgagttcaaggccatggacagcatctag

SEQ ID NO: 9880 - DNA, 2412 bp, Artificial Sequence
  Description of Artificial Sequence: Synthetic coding sequence
atgaaggccgccgccggcgagttcgccgacgacccctgcagcagcgtgaagagaggcaacatggtgagagccgccagagccctgctgagcgccgtgaccagactgctgatcctggccgacatggccgacgtgtacaagctgctggtgcagctgaaggtggtggaggacggcatcctgaagctgagaaacgccggcaacgagcaggacctgggcatccagtacaaggccctgaagcccgaggtggacaagctgaacatcatggccgccaagagacagcaggagctgaaggacgtgggccacagagaccagatggccgccgccagaggcatcctgcagaagaacgtgcccatcctgtacaccgccagccaggcctgcctgcagcaccccgacgtggccgcctacaaggccaacagagacctgatctacaagcagctgcagcaggccgtgaccggcatcagcaacgccgcccaggccaccgccagcgacgacgccagccagcaccagggcggcggcggcggcgagctggcctacgccctgaacaacttcgacaagcagatcatcgtggaccccctgagcttcagcgaggagagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgggcaacgccggcagaaaggagagaagcgacgccctgaacagcgccatcgacaagatgaccaagaagaccagagacctgagaagacagctgagaaaggccgtgatggaccacgtgagcgacagcttcctggagaccaacgtgcccctgctggtgctgatcgaggccgccaagaacggcaacgagaaggaggtgaaggagtacgcccaggtgttcagagagcacgccaacaagctgatcgaggtggccaacctggcctgcagcatcagcaacaacgaggagggcgtgaagctggtgagaatgagcgccagccagctggaggccctgtgcccccaggtgatcaacgccgccctggccctggccgccaagccccagagcaagctggcccaggagaacatggacctgttcaaggagcagtgggagaagcaggtgagagtgctgaccgacgccgtggacgacatcaccagcatcgacgacttcctggccgtgagcgagaaccacatcctggaggacgtgaacaagtgcgtgatcgccctgcaggagaaggacgtggacggcctggacagaaccgccggcgccatcagaggcagagccgccagagtgatccacgtggtgaccagcgagatggacaactacgagcccggcgtgtacaccgagaaggtgctggaggccaccaagctgctgagcaacaccgtgatgcccagattcaccgagcaggtggaggccgccgtggaggccctgagcagcgaccccgcccagcccatggacgagaacgagttcatcgacgccagcagactggtgtacgacggcatcagagacatcagaaaggccgtgctgatgatcagaacccccgaggagctggacgacagcgacttcgagaccgaggacttcgacgtgagaagcagaaccagcgtgcagaccgaggacgaccagctgatcgccggccagagcgccagagccatcatggcccagctgccccaggagcagaaggccaagatcgccgagcaggtggccagcttccaggaggagaagagcaagctggacgccgaggtgagcaagtgggacgacagcggcaacgacatcatcgtgctggccaagcagatgtgcatgatcatgatggagatgaccgacttcaccagaggcaagggccccctgaagaacaccagcgacgtgatcagcgccgccaagaagatcgccgaggccggcagcagaatggacaagctgggcagaaccatcgccgaccactgccccgacagcgcctgcaagcaggacctgctggcctacctgcagagaatcgccctgtactgccaccagctgaacatctgcagcaaggtgaaggccgaggtgcagaacctgggcggcgagctggtggtgagcggcgtggacagcgccatgagcctgatccaggccgccaagaacctgatgaacgccgtggtgcagaccgtgaaggccagctacgtggccagcaccaagtaccagaagagccagggcatggccagcctgaacctgcccgccgtgagctggaagatgaaggcccccgagaagaagcccctggtgaagagagagaagcaggacgagacccagaccaagatcaagagagccagccagaagaagcacgtgaaccccgtgcaggccctgagcgagttcaaggccatggacagcatctag

SEQ ID NO: 9881 - DNA, 357 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagctag

SEQ ID NO: 9882 - DNA, 420 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaacatggtgagagccgccagagccctgctgagcgccgtgaccagactgctgtag

SEQ ID NO: 9883 - DNA, 648 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaacatggtgagagccgccagagccctgctgagcgccgtgaccagactgctgatcctggccgacatggccgacgtgtacaagctgctggtgcagctgaaggtggtggaggacggcatcctgaagctgagaaacgccggcaacgagcaggacctgggcatccagtacaaggccctgaagcccgaggtggacaagctgaacatcatggccgccaagagacagcaggagctgaaggacgtgggccacagagaccagatggccgccgccagaggcatcctgcagtag

SEQ ID NO: 9884 - DNA, 306 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggctag

SEQ ID NO: 9885 - DNA, 372 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaactag

SEQ ID NO: 9886 - DNA, 471 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaacatggtgagagccgccagagccctgctgagcgccgtgaccagactgctgatcctggccgacatggccgacgtgtacaagctgctggtgcagctgaaggtgtag

SEQ ID NO: 9887 - DNA, 285 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtgtag

SEQ ID NO: 9888 - DNA, 2790 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaacatggtgagagccgccagagccctgctgagcgccgtgaccagactgctgatcctggccgacatggccgacgtgtacaagctgctggtgcagctgaaggtggtggaggacggcatcctgaagctgagaaacgccggcaacgagcaggacctgggcatccagtacaaggccctgaagcccgaggtggacaagctgaacatcatggccgccaagagacagcaggagctgaaggacgtgggccacagagaccagatggccgccgccagaggcatcctgcagaagaacgtgcccatcctgtacaccgccagccaggcctgcctgcagcaccccgacgtggccgcctacaaggccaacagagacctgatctacaagcagctgcagcaggccgtgaccggcatcagcaacgccgcccaggccaccgccagcgacgacgccagccagcaccagggcggcggcggcggcgagctggcctacgccctgaacaacttcgacaagcagatcatcgtggaccccctgagcttcagcgaggagagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgggcaacgccggcagaaaggagagaagcgacgccctgaacagcgccatcgacaagatgaccaagaagaccagagacctgagaagacagctgagaaaggccgtgatggaccacgtgagcgacagcttcctggagaccaacgtgcccctgctggtgctgatcgaggccgccaagaacggcaacgagaaggaggtgaaggagtacgcccaggtgttcagagagcacgccaacaagctgatcgaggtggccaacctggcctgcagcatcagcaacaacgaggagggcgtgaagctggtgagaatgagcgccagccagctggaggccctgtgcccccaggtgatcaacgccgccctggccctggccgccaagccccagagcaagctggcccaggagaacatggacctgttcaaggagcagtgggagaagcaggtgagagtgctgaccgacgccgtggacgacatcaccagcatcgacgacttcctggccgtgagcgagaaccacatcctggaggacgtgaacaagtgcgtgatcgccctgcaggagaaggacgtggacggcctggacagaaccgccggcgccatcagaggcagagccgccagagtgatccacgtggtgaccagcgagatggacaactacgagcccggcgtgtacaccgagaaggtgctggaggccaccaagctgctgagcaacaccgtgatgcccagattcaccgagcaggtggaggccgccgtggaggccctgagcagcgaccccgcccagcccatggacgagaacgagttcatcgacgccagcagactggtgtacgacggcatcagagacatcagaaaggccgtgctgatgatcagaacccccgaggagctggacgacagcgacttcgagaccgaggacttcgacgtgagaagcagaaccagcgtgcagaccgaggacgaccagctgatcgccggccagagcgccagagccatcatggcccagctgccccaggagcagaaggccaagatcgccgagcaggtggccagcttccaggaggagaagagcaagctggacgccgaggtgagcaagtgggacgacagcggcaacgacatcatcgtgctggccaagcagatgtgcatgatcatgatggagatgaccgacttcaccagaggcaagggccccctgaagaacaccagcgacgtgatcagcgccgccaagaagatcgccgaggccggcagcagaatggacaagctgggcagaaccatcgccgaccactgccccgacagcgcctgcaagcaggacctgctggcctacctgcagagaatcgccctgtactgccaccagctgaacatctgcagcaaggtgaaggccgaggtgcagaacctgggcggcgagctggtggtgagcggcaactgcgacacctgcggcgccctgcagggcctgaagggctggcccccccccctgtgcgccacccactgggtggacagcgccatgagcctgatccaggccgccaagaacctgatgaacgccgtggtgcagaccgtgaaggccagctacgtggccagcaccaagtaccagaagagccagggcatggccagcctgaacctgcccgccgtgagctggaagatgaaggcccccgagaagaagcccctggtgaagagagagaagcaggacgagacccagaccaagatcaagagagccagccagaagaagcacgtgaaccccgtgcaggccctgagcgagttcaaggccatggacagcatctag

SEQ ID NO: 9889 - DNA, 1611 bp, Artificial Sequence
  Description of Artificial Sequence: Synthetic coding sequence
atgaccaagaagaccagagacctgagaagacagctgagaaaggccgtgatggaccacgtgagcgacagcttcctggagaccaacgtgcccctgctggtgctgatcgaggccgccaagaacggcaacgagaaggaggtgaaggagtacgcccaggtgttcagagagcacgccaacaagctgatcgaggtggccaacctggcctgcagcatcagcaacaacgaggagggcgtgaagctggtgagaatgagcgccagccagctggaggccctgtgcccccaggtgatcaacgccgccctggccctggccgccaagccccagagcaagctggcccaggagaacatggacctgttcaaggagcagtgggagaagcaggtgagagtgctgaccgacgccgtggacgacatcaccagcatcgacgacttcctggccgtgagcgagaaccacatcctggaggacgtgaacaagtgcgtgatcgccctgcaggagaaggacgtggacggcctggacagaaccgccggcgccatcagaggcagagccgccagagtgatccacgtggtgaccagcgagatggacaactacgagcccggcgtgtacaccgagaaggtgctggaggccaccaagctgctgagcaacaccgtgatgcccagattcaccgagcaggtggaggccgccgtggaggccctgagcagcgaccccgcccagcccatggacgagaacgagttcatcgacgccagcagactggtgtacgacggcatcagagacatcagaaaggccgtgctgatgatcagaacccccgaggagctggacgacagcgacttcgagaccgaggacttcgacgtgagaagcagaaccagcgtgcagaccgaggacgaccagctgatcgccggccagagcgccagagccatcatggcccagctgccccaggagcagaaggccaagatcgccgagcaggtggccagcttccaggaggagaagagcaagctggacgccgaggtgagcaagtgggacgacagcggcaacgacatcatcgtgctggccaagcagatgtgcatgatcatgatggagatgaccgacttcaccagaggcaagggccccctgaagaacaccagcgacgtgatcagcgccgccaagaagatcgccgaggccggcagcagaatggacaagctgggcagaaccatcgccgaccactgccccgacagcgcctgcaagcaggacctgctggcctacctgcagagaatcgccctgtactgccaccagctgaacatctgcagcaaggtgaaggccgaggtgcagaacctgggcggcgagctggtggtgagcggcgtggacagcgccatgagcctgatccaggccgccaagaacctgatgaacgccgtggtgcagaccgtgaaggccagctacgtggccagcaccaagtaccagaagagccagggcatggccagcctgaacctgcccgccgtgagctggaagatgaaggcccccgagaagaagcccctggtgaagagagagaagcaggacgagacccagaccaagatcaagagagccagccagaagaagcacgtgaaccccgtgcaggccctgagcgagttcaaggccatggacagcatctag

SEQ ID NO: 9890 - DNA, 2676 bp, Artificial Sequence
  Description of Artificial Sequence: Synthetic coding sequence
atgaccgccgtgcacgccggcaacatcaacttcaagtgggaccccaagagcctggagatcagaaccctggccgtggagagactgctggagcccctggtgacccaggtgaccaccctggtgaacaccaacagcaagggccccagcaacaagaagagaggcagaagcaagaaggcccacgtgctggccgccagcgtggagcaggccaccgagaacttcctggagaagggcgacaagatcgccaaggagagccagttcctgaaggaggagctggtggccgccgtggaggacgtgagaaagcagggcgacctgatgaaggccgccgccggcgagttcgccgacgacccctgcagcagcgtgaagagaggcaacatggtgagagccgccagagccctgctgagcgccgtgaccagactgctgaaggtggtggaggacggcatcctgaagctgagaaacgccggcaacgagcaggacctgggcatccagtacaaggccctgaagcccgaggtggacaagctgaacatcatggccgccaagagacagcaggagctgaaggacgtgggccacagagaccagatggccgccgccagaggcatcctgcagaagaacgtgcccatcctgtacaccgccagccaggcctgcctgcagcaccccgacgtggccgcctacaaggccaacagagacctgatctacaagcagctgcagcaggccgtgaccggcatcagcaacgccgcccaggccaccgccagcgacgacgccagccagcaccagggcggcggcggcggcgagctggcctacgccctgaacaacttcgacaagcagatcatcgtggaccccctgagcttcagcgaggagagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgggcaacgccggcagaaaggagagaagcgacgccctgaacagcgccatcgacaagatgaccaagaagaccagagacctgagaagacagctgagaaaggccgtgatggaccacgtgagcgacagcttcctggagaccaacgtgcccctgctggtgctgatcgaggccgccaagaacggcaacgagaaggaggtgaaggagtacgcccaggtgttcagagagcacgccaacaagctgatcgaggtggccaacctggcctgcagcatcagcaacaacgaggagggcgtgaagctggtgagaatgagcgccagccagctggaggccctgtgcccccaggtgatcaacgccgccctggccctggccgccaagccccagagcaagctggcccaggagaacatggacctgttcaaggagcagtgggagaagcaggtgagagtgctgaccgacgccgtggacgacatcaccagcatcgacgacttcctggccgtgagcgagaaccacatcctggaggacgtgaacaagtgcgtgatcgccctgcaggagaaggacgtggacggcctggacagaaccgccggcgccatcagaggcagagccgccagagtgatccacgtggtgaccagcgagatggacaactacgagcccggcgtgtacaccgagaaggtgctggaggccaccaagctgctgagcaacaccgtgatgcccagattcaccgagcaggtggaggccgccgtggaggccctgagcagcgaccccgcccagcccatggacgagaacgagttcatcgacgccagcagactggtgtacgacggcatcagagacatcagaaaggccgtgctgatgatcagaacccccgaggagctggacgacagcgacttcgagaccgaggacttcgacgtgagaagcagaaccagcgtgcagaccgaggacgaccagctgatcgccggccagagcgccagagccatcatggcccagctgccccaggagcagaaggccaagatcgccgagcaggtggccagcttccaggaggagaagagcaagctggacgccgaggtgagcaagtgggacgacagcggcaacgacatcatcgtgctggccaagcagatgtgcatgatcatgatggagatgaccgacttcaccagaggcaagggccccctgaagaacaccagcgacgtgatcagcgccgccaagaagatcgccgaggccggcagcagaatggacaagctgggcagaaccatcgccgaccactgccccgacagcgcctgcaagcaggacctgctggcctacctgcagagaatcgccctgtactgccaccagctgaacatctgcagcaaggtgaaggccgaggtgcagaacctgggcggcgagctggtggtgagcggcgtggacagcgccatgagcctgatccaggccgccaagaacctgatgaacgccgtggtgcagaccgtgaaggccagctacgtggccagcaccaagtaccagaagagccagggcatggccagcctgaacctgcccgccgtgagctggaagatgaaggcccccgagaagaagcccctggtgaagagagagaagcaggacgagacccagaccaagatcaagagagccagccagaagaagcacgtgaaccccgtgcaggccctgagcgagttcaaggccatggacagcatctag

SEQ ID NO: 9891 - DNA, 2346 bp, Artificial Sequence
  Description of Artificial Sequence: Synthetic coding sequence
atggccacccaggccgacctgatggagctggacatggccatggagcccgacagaaaggccgccgtgagccactggcagcagcagagctacctggacagcggcatccacagcggcgccaccaccaccgcccccagcctgagcggcaagggcaaccccgaggaggaggacgtggacaccagccaggtgctgtacgagtgggagcagggcttcagccagagcttcacccaggagcaggtggccgacatcgacggccagtacgccatgaccagagcccagagagtgagagccgccatgttccccgagaccctggacgagggcatgcagatccccagcacccagttcgacgccgcccaccccaccaacgtgcagagactggccgagcccagccagatgctgaagcacgccgtggtgaacctgatcaactaccaggacgacgccgagctggccaccagagccatccccgagctgaccaagctgctgaacgacgaggaccaggtggtggtgaacaaggccgccgtgatggtgcaccagctgagcaagaaggaggccagcagacacgccatcatgagaagcccccagatggtgagcgccatcgtgagaaccatgcagaacaccaacgacgtggagaccgccagatgcaccgccggcaccctgcacaacctgagccaccacagagagggcctgctggccatcttcaagagcggcggcatccccgccctggtgaagatgctgggcagccccgtggacagcgtgctgttctacgccatcaccaccctgcacaacctgctgctgcaccaggagggcgccaagatggccgtgagactggccggcggcctgcagaagatggtggccctgctgaacaagaccaacgtgaagttcctggccatcaccaccgactgcctgcagatcctggcctacggcaaccaggagagcaagctgatcatcctggccagcggcggcccccaggccctggtgaacatcatgagaacctacacctacgagaagctgctgtggaccaccagcagagtgctgaaggtgctgagcgtgtgcagcagcaacaagcccgccatcgtggaggccggcggcatgcaggccctgggcctgcacctgaccgaccccagccagagactggtgcagaactgcctgtggaccctgagaaacctgagcgacgccgccaccaagcaggagggcatggagggcctgctgggcaccctggtgcagctgctgggcagcgacgacatcaacgtggtgacctgcgccgccggcatcctgagcaacctgacctgcaacaactacaagaacaagatgatggtgtgccaggtgggcggcatcgaggccctggtgagaaccgtgctgagagccggcgacagagaggacatcaccgagcccgccatctgcgccctgagacacctgaccagcagacaccaggaggccgagatggcccagaacgccgtgagactgcactacggcctgcccgtggtggtgaagctgctgcacccccccagccactggcccctgatcaaggccaccgtgggcctgatcagaaacctggccctgtgccccgccaaccacgcccccctgagagagcagggcgccatccccagactggtgcagctgctggtgagagcccaccaggacacccagagaagaaccagcatgggcggcacccagcagcagttcgtggagggcgtgagaatggaggagatcgtggagggctgcaccggcgccctgcacatcctggccagagacgtgcacaacagaatcgtgatcagaggcctgaacaccatccccctgttcgtgcagctgctgtacagccccatcgagaacatccagagagtggccgccggcgtgctgtgcgagctggcccaggacaaggaggccgccgaggccatcgaggccgagggcgccaccgcccccctgaccgagctgctgcacagcagaaacgagggcgtggccacctacgccgccgccgtgctgttcagaatgagcgaggacaagccccaggactacaagaagagactgagcgtggagctgaccagcagcctgttcagaaccgagcccatggcctggaacgagaccgccgacctgggcctggacatcggcgcccagggcgagcccctgggctacagacaggacgaccccagctacagaagcttccacagcggcggctacggccaggacgccctgggcatggaccccatgatggagcacgagatgggcggccaccaccccggcgccgactaccccgtggacggcctgcccgacctgggccacgcccaggacctgatggacggcctgccccccggcgacagcaaccagctggcctggttcgacaccgacctgtag

SEQ ID NO: 9892 - DNA, 2346 bp, Artificial Sequence; identical to SEQ ID NO: 9891
  Description of Artificial Sequence: Synthetic coding sequence

SEQ ID NO: 9893 - DNA, 2346 bp, Artificial Sequence; identical to SEQ ID NO: 9891
  Description of Artificial Sequence: Synthetic coding sequence

SEQ ID NO: 9894 - DNA, 2346 bp, Artificial Sequence; identical to SEQ ID NO: 9891
  Description of Artificial Sequence: Synthetic coding sequence

SEQ ID NO: 9895 - DNA, 453 bp, Artificial Sequence
  Description of Artificial Sequence: Synthetic coding sequence
atggccacccaggccgacctgatggagctggacatggccatggagcccgacagaaaggccgccgtgagccactggcagcagcagagctacctggacagcggcatccacagcggcgccaccaccaccgcccccagcctgagcggcaagggcaaccccgaggaggaggacgtggacaccagccaggtgctgtacgagtgggagcagggcttcagccagagcttcacccaggagcaggtggccgacatcgacggccagtacgccatgaccagagcccagagagtgagagccgccatgttccccgagaccctggacgagggcatgcagatccccagcacccagttcgacgccgcccaccccaccaacgtgcagagactggccgagcccagccagatgctgaagcacgccgtggtgaacctgatcaactaccaggacgacgccgagctggccacctag

SEQ ID NO: 9896 - DNA, 42 bp, Artificial Sequence
  Description of Artificial Sequence: Synthetic coding sequence
atggccacccaggccgacctgatggagctggacatggcctag

SEQ ID NO: 9897 - DNA, 303 bp, Artificial Sequence
  Description of Artificial Sequence: Synthetic coding sequence
atggccacccaggccgacctgatggagctggacatggccatggagcccgacagaaaggccgccgtgagccactggcagcagcagagctacctggacagcggcatccacagcggcgccaccaccaccgcccccagcctgagcggcaagggcaaccccgaggaggaggacgtggacaccagccaggtgctgtacgagtgggagcagggcttcagccagagcttcacccaggagcaggtggccgacatcgacggccagtacgccatgaccagagcccagagagtgagagccgccatgttcccctag

SEQ ID NO: 9898 - DNA, 327 bp, Artificial Sequence
  Description of Artificial Sequence: Synthetic coding sequence
atggccacccaggccgacctgatggagctggacatggccatggagcccgacagaaaggccgccgtgagccactggcagcagcagagctacctggacagcggcatccacagcggcgccaccaccaccgcccccagcctgagcggcaagggcaaccccgaggaggaggacgtggacaccagccaggtgctgtacgagtgggagcagggcttcagccagagcttcacccaggagcaggtggccgacatcgacggccagtacgccatgaccagagcccagagagtgagagccgccatgttccccgagaccctggacgagggcatgcagtag

SEQ ID NO: 9899 - DNA, 2325 bp, Artificial Sequence
  Description of Artificial Sequence: Synthetic coding sequence
atggagctggacatggccatggagcccgacagaaaggccgccgtgagccactggcagcagcagagctacctggacagcggcatccacagcggcgccaccaccaccgcccccagcctgagcggcaagggcaaccccgaggaggaggacgtggacaccagccaggtgctgtacgagtgggagcagggcttcagccagagcttcacccaggagcaggtggccgacatcgacggccagtacgccatgaccagagcccagagagtgagagccgccatgttccccgagaccctggacgagggcatgcagatccccagcacccagttcgacgccgcccaccccaccaacgtgcagagactggccgagcccagccagatgctgaagcacgccgtggtgaacctgatcaactaccaggacgacgccgagctggccaccagagccatccccgagctgaccaagctgctgaacgacgaggaccaggtggtggtgaacaaggccgccgtgatggtgcaccagctgagcaagaaggaggccagcagacacgccatcatgagaagcccccagatggtgagcgccatcgtgagaaccatgcagaacaccaacgacgtggagaccgccagatgcaccgccggcaccctgcacaacctgagccaccacagagagggcctgctggccatcttcaagagcggcggcatccccgccctggtgaagatgctgggcagccccgtggacagcgtgctgttctacgccatcaccaccctgcacaacctgctgctgcaccaggagggcgccaagatggccgtgagactggccggcggcctgcagaagatggtggccctgctgaacaagaccaacgtgaagttcctggccatcaccaccgactgcctgcagatcctggcctacggcaaccaggagagcaagctgatcatcctggccagcggcggcccccaggccctggtgaacatcatgagaacctacacctacgagaagctgctgtggaccaccagcagagtgctgaaggtgctgagcgtgtgcagcagcaacaagcccgccatcgtggaggccggcggcatgcaggccctgggcctgcacctgaccgaccccagccagagactggtgcagaactgcctgtggaccctgagaaacctgagcgacgccgccaccaagcaggagggcatggagggcctgctgggcaccctggtgcagctgctgggcagcgacgacatcaacgtggtgacctgcgccgccggcatcctgagcaacctgacctgcaacaactacaagaacaagatgatggtgtgccaggtgggcggcatcgaggccctggtgagaaccgtgctgagagccggcgacagagaggacatcaccgagcccgccatctgcgccctgagacacctgaccagcagacaccaggaggccgagatggcccagaacgccgtgagactgcactacggcctgcccgtggtggtgaagctgctgcacccccccagccactggcccctgatcaaggccaccgtgggcctgatcagaaacctggccctgtgccccgccaaccacgcccccctgagagagcagggcgccatccccagactggtgcagctgctggtgagagcccaccaggacacccagagaagaaccagcatgggcggcacccagcagcagttcgtggagggcgtgagaatggaggagatcgtggagggctgcaccggcgccctgcacatcctggccagagacgtgcacaacagaatcgtgatcagaggcctgaacaccatccccctgttcgtgcagctgctgtacagccccatcgagaacatccagagagtggccgccggcgtgctgtgcgagctggcccaggacaaggaggccgccgaggccatcgaggccgagggcgccaccgcccccctgaccgagctgctgcacagcagaaacgagggcgtggccacctacgccgccgccgtgctgttcagaatgagcgaggacaagccccaggactacaagaagagactgagcgtggagctgaccagcagcctgttcagaaccgagcccatggcctggaacgagaccgccgacctgggcctggacatcggcgcccagggcgagcccctgggctacagacaggacgaccccagctacagaagcttccacagcggcggctacggccaggacgccctgggcatggaccccatgatggagcacgagatgggcggccaccaccccggcgccgactaccccgtggacggcctgcccgacctgggccacgcccaggacctgatggacggcctgccccccggcgacagcaaccagctggcctggttcgacaccgacctgtag

SEQ ID NO: 9900 - DNA, 1020 bp, Artificial Sequence
  Description of Artificial Sequence: Synthetic coding sequence
atgtggcagctgtgggccagcctgtgctgcctgctggtgctggccaacgccagaagcagacccagcttccaccccctgagcgacgagctggtgaactacgtgaacaagagaaacaccacctggcaggccggccacaacttctacaacgtggacatgagctacctgaagagactgtgcggcaccttcctgggcggccccaagcccccccagagagtgatgttcaccgaggacctgaagctgcccgccagcttcgacgccagagagcagtggccccagtgccccaccatcaaggagatcagagaccagggcagctgcggcagctgctgggccttcggcgccgtggaggccatcagcgacagaatctgcatccacaccaacgcccacgtgagcgtggaggtgagcgccgaggacctgctgacctgctgcggcagcatgtgcggcgacggctgcaacggcggctaccccgccgaggcctggaacttctggaccagaaagggcctggtgagcggcggcctgtacgagagccacgtgggctgcagaccctacagcatccccccctgcgagcaccacgtgaacggcagcagacccccctgcaccggcgagggcgacacccccaagtgcagcaagatctgcgagcccggctacagccccacctacaagcaggacaagcactacggctacaacagctacagcgtgagcaacagcgagaaggacatcatggccgagatctacaagaacggccccgtggagggcgccttcagcgtgtacagcgacttcctgctgtacaagagcggcgtgtaccagcacgtgaccggcgagatgatgggcggccacgccatcagaatcctgggctggggcgtggagaacggcaccccctactggctggtggccaacagctggaacaccgactggggcgacaacggcttcttcaagatcctgagaggccaggaccactgcggcatcgagagcgaggtggtggccggcatccccagaaccgaccagtactgggagaagatctag

SEQ ID NO: 9901 - DNA, 1020 bp, Artificial Sequence; identical to SEQ ID NO: 9900
  Description of Artificial Sequence: Synthetic coding sequence

SEQ ID NO: 9902 - DNA, 333 bp, Artificial Sequence
  Description of Artificial Sequence: Synthetic coding sequence
atgtggcagctgtgggccagcctgtgctgcctgctggtgctggccaacgccagaagcagacccagcttccaccccctgagcgacgagctggtgaactacgtgaacaagagaaacaccacctggcaggccggccacaacttctacaacgtggacatgagctacctgaagagactgtgcggcaccttcctgggcggccccaagcccccccagagagtgatgttcaccgaggacctgaagctgcccgccagcttcgacgccagagagcagtggccccagtgccccaccatcaaggagatcagagaccagggcagctgcggcagctgctggctgtag

SEQ ID NO: 9903 - DNA, 1020 bp, Artificial Sequence; identical to SEQ ID NO: 9900
  Description of Artificial Sequence: Synthetic coding sequence

SEQ ID NO: 9904 - DNA, 1020 bp, Artificial Sequence; identical to SEQ ID NO: 9900
  Description of Artificial Sequence: Synthetic coding sequence

SEQ ID NO: 9905 - DNA, 1020 bp, Artificial Sequence; identical to SEQ ID NO: 9900
  Description of Artificial Sequence: Synthetic coding sequence

SEQ ID NO: 9906 - DNA, 1020 bp, Artificial Sequence; identical to SEQ ID NO: 9900
  Description of Artificial Sequence: Synthetic coding sequence

SEQ ID NO: 9907 - DNA, 1020 bp, Artificial Sequence; identical to SEQ ID NO: 9900
  Description of Artificial Sequence: Synthetic coding sequence

SEQ ID NO: 9908 - DNA, 1020 bp, Artificial Sequence; identical to SEQ ID NO: 9900
  Description of Artificial Sequence: Synthetic coding sequence

SEQ ID NO: 9909 - DNA, 831 bp, Artificial Sequence
  Description of Artificial Sequence: Synthetic coding sequence
atggacatgaacagaagagccagctgcctgctgcccgacctgtgcggccagggctggggctggagactgttccccgccagctgcgcctacctgggcagcgtgccctggagagtgtggggcctgggcggcctgctggcccccctggccgccgccggcggcggcagcaccagcggcctgggccacctgggcagcacccagtggagcggcgagctggtggtgctgctgagcgaggtgttcatcagaggctgcctgttcagctgcaacggcggctaccccgccgaggcctggaacttctggaccagaaagggcctggtgagcggcggcctgtacgagagccacgtgggctgcagaccctacagcatccccccctgcgagcaccacgtgaacggcagcagacccccctgcaccggcgagggcgacacccccaagtgcagcaagatctgcgagcccggctacagccccacctacaagcaggacaagcactacggctacaacagctacagcgtgagcaacagcgagaaggacatcatggccgagatctacaagaacggccccgtggagggcgccttcagcgtgtacagcgacttcctgctgtacaagagcggcgtgtaccagcacgtgaccggcgagatgatgggcggccacgccatcagaatcctgggctggggcgtggagaacggcaccccctactggctggtggccaacagctggaacaccgactggggcgacaacggcttcttcaagatcctgagaggccaggaccactgcggcatcgagagcgaggtggtggccggcatccccagaaccgaccagtactgggagaagatctag

SEQ ID NO: 9910 - DNA, 738 bp, Artificial Sequence
  Description of Artificial Sequence: Synthetic coding sequence
atgcccggcgccggccccctgagcatcccctgcagaatgagctgggccttcggcgccgtggaggccatcagcgacagaatctgcatccacaccaacgcccacgtgagcgtggaggtgagcgccgaggacctgctgacctgctgcggcagcatgtgcggcgacggctgcaacggcggctaccccgccgaggcctggaacttctggaccagaaagggcctggtgagcggcggcctgtacgagagccacgtgggctgcagaccctacagcatccccccctgcgagcaccacgtgaacggcagcagacccccctgcaccggcgagggcgacacccccaagtgcagcaagatctgcgagcccggctacagccccacctacaagcaggacaagcactacggctacaacagctacagcgtgagcaacagcgagaaggacatcatggccgagatctacaagaacggccccgtggagggcgccttcagcgtgtacagcgacttcctgctgtacaagagcggcgtgtaccagcacgtgaccggcgagatgatgggcggccacgccatcagaatcctgggctggggcgtggagaacggcaccccctactggctggtggccaacagctggaacaccgactggggcgacaacggcttcttcaagatcctgagaggccaggaccactgcggcatcgagagcgaggtggtggccggcatccccagaaccgaccagtactgggagaagatctag

SEQ ID NO: 9911 - DNA, 1239 bp, Artificial Sequence
  Description of Artificial Sequence: Synthetic coding sequence
atgcagcccagcagcctgctgcccctggccctgtgcctgctggccgcccccgccagcgccctggtgagaatccccctgcacaagttcaccagcatcagaagaaccatgagcgaggtgggcggcagcgtggaggacctgatcgccaagggccccgtgagcaagtacagccaggccgtgcccgccgtgaccgagggccccatccccgaggtgctgaagaactacatggacgcccagtactacggcgagatcggcatcggcacccccccccagtgcttcaccgtggtgttcgacaccggcagcagcaacctgtgggtgcccagcatccactgcaagctgctggacatcgcctgctggatccaccacaagtacaacagcgacaagagcagcacctacgtgaagaacggcaccagcttcgacatccactacggcagcggcagcctgagcggctacctgagccaggacaccgtgagcgtgccctgccagagcgccagcagcgccagcgccctgggcggcgtgaaggtggagagacaggtgttcggcgaggccaccaagcagcccggcatcaccttcatcgccgccaagttcgacggcatcctgggcatggcctaccccagaatcagcgtgaacaacgtgctgcccgtgttcgacaacctgatgcagcagaagctggtggaccagaacatcttcagcttctacctgagcagagaccccgacgcccagcccggcggcgagctgatgctgggcggcaccgacagcaagtactacaagggcagcctgagctacctgaacgtgaccagaaaggcctactggcaggtgcacctggaccaggtggaggtggccagcggcctgaccctgtgcaaggagggctgcgaggccatcgtggacaccggcaccagcctgatggtgggccccgtggacgaggtgagagagctgcagaaggccatcggcgccgtgcccctgatccagggcgagtacatgatcccctgcgagaaggtgagcaccctgcccgccatcaccctgaagctgggcggcaagggctacaagctgagccccgaggactacaccctgaaggtgagccaggccggcaagaccctgtgcctgagcggcttcatgggcatggacatccccccccccagcggccccctgtggatcctgggcgacgtgttcatcggcagatactacaccgtgttcgacagagacaacaacagagtgggcttcgccgaggccgccagactgtag

SEQ ID NO: 9912 - DNA, 1002 bp, Artificial Sequence
  Description of Artificial Sequence: Synthetic coding sequence
atgaaccccaccctgatcctggccgccttctgcctgggcatcgccagcgccaccctgaccttcgaccacagcctggaggcccagtggaccaagtggaaggccatgcacaacagactgtacggcatgaacgaggagggctggagaagagccgtgtgggagaagaacatgaagatgatcgagctgcacaaccaggagtacagagagggcaagcacagcttcaccatggccatgaacgccttcggcgacatgaccagcgaggagttcagacaggtgatgaacggcttccagaacagaaagcccagaaagggcaaggtgttccaggagcccctgttctacgaggcccccagaagcgtggactggagagagaagggctacgtgacccccgtgaagaaccagggccagtgcggcagctgctgggccttcagcgccaccggcgccctggagggccagatgttcagaaagaccggcagactgatcagcctgagcgagcagaacctggtggactgcagcggcccccagggcaacgagggctgcaacggcggcctgatggactacgccttccagtacgtgcaggacaacggcggcctggacagcgaggagagctacccctacgaggccaccgaggagagctgcaagtacaaccccaagtacagcgtggccaacgacaccggcttcgtggacatccccaagcaggagaaggccctgatgaaggccgtggccaccgtgggccccatcagcgtggccatcgacgccggccacgagagcttcctgttctacaaggagggcatctacttcgagcccgactgcagcagcgaggacatggaccacggcgtgctggtggtgggctacggcttcgagagcaccgagagcgacaacaacaagtactggctggtgaagaacagctggggcgaggagtggggcatgggcggctacgtgaagatggccaaggacagaagaaaccactgcggcatcgccagcgccgccagctaccccaccgtgtag

SEQ ID NO: 9913 - DNA, 678 bp, Artificial Sequence
  Description of Artificial Sequence: Synthetic coding sequence
atgaaccccaccctgatcctggccgccttctgcctgggcatcgccagcgccaccctgaccttcgaccacagcctggaggcccagtggaccaagtggaaggccatgcacaacagactgtacggcatgaacgaggagggctggagaagagccgtgtgggagaagaacatgaagatgatcgagctgcacaaccaggagtacagagagggcaagcacagcttcaccatggccatgaacgccttcggcgacatgaccagcgaggagttcagacaggtgatgaacggcttccagaacagaaagcccagaaagggcaaggtgttccaggagcccctgttctacgaggcccccagaagcgtggactggagagagaagggctacgtgacccccgtgaagaaccagggccagtgcggcagctgctgggccttcagcgccaccggcgccctggagggccagatgttcagaaagaccggcagactgatcagcctgagcgagcagaacctggtggactgcagcggcccccagggcaacgagggctgcaacggcggcctgatggactacgccttccagtacgtgcaggacaacggcggcctggacagcgaggagagctacccctacgaggccaccgtgagcggcgccccctgccaccacagcagcagcgccttcggcagatggaccctgtag

SEQ ID NO: 9914 - DNA, 1002 bp, Artificial Sequence; identical to SEQ ID NO: 9912
  Description of Artificial Sequence: Synthetic coding sequence

SEQ ID NO: 9915 - DNA, 120 bp, Artificial Sequence
  Description of Artificial Sequence: Synthetic coding sequence
atgaaccccaccctgatcctggccgccttctgcctgggcatcgccagcgccaccctgaccttcgaccacagcctggaggcccagtggaccaagtggaaggccatgcacaacagactgtag

SEQ ID NO: 9916 - DNA, 444 bp, Artificial Sequence
  Description of Artificial Sequence: Synthetic coding sequence
atggccgacgagctgagcgagaagcaggtgtacgacgcccacaccaaggagatcgacctggtgaacagagaccccaagcacctgaacgacgacgtggtgaagatcgacttcgaggacgtgatcgccgagcccgagggcacccacagcttcgacggcatctggaaggccagcttcaccaccttcaccgtgaccaagtactggttctacagactgctgagcgccctgttcggcatccccatggccctgatctggggcatctacttcgccatcctgagcttcctgcacatctgggccgtggtgccctgcatcaagagcttcctgatcgagatccagtgcatcagcagagtgtacagcatctacgtgcacaccgtgtgcgaccccctgttcgaggccgtgggcaagatcttcagcaacgtgagaatcaacctgcagaaggagatctag

SEQ ID NO: 9917 - DNA, 444 bp, Artificial Sequence; identical to SEQ ID NO: 9916
  Description of Artificial Sequence: Synthetic coding sequence

SEQ ID NO: 9918 - DNA, 537 bp, Artificial Sequence
  Description of Artificial Sequence: Synthetic coding sequence
atgagcggcggcaagtacgtggacagcgagggccacctgtacaccgtgcccatcagagagcagggcaacatctacaagcccaacaacaaggccatggccgacgagctgagcgagaagcaggtgtacgacgcccacaccaaggagatcgacctggtgaacagagaccccaagcacctgaacgacgacgtggtgaagatcgacttcgaggacgtgatcgccgagcccgagggcacccacagcttcgacggcatctggaaggccagcttcaccaccttcaccgtgaccaagtactggttctacagactgctgagcgccctgttcggcatccccatggccctgatctggggcatctacttcgccatcctgagcttcctgcacatctgggccgtggtgccctgcatcaagagcttcctgatcgagatccagtgcatcagcagagtgtacagcatctacgtgcacaccgtgtgcgaccccctgttcgaggccgtgggcaagatcttcagcaacgtgagaatcaacctgcagaaggagatctag

SEQ ID NO: 9919 - DNA, 345 bp, Artificial Sequence
  Description of Artificial Sequence: Synthetic coding sequence
atggccggcggcaaggccggcaaggacagcggcaaggccaaggccaaggccgtgagcagaagccagagagccggcctgcagttccccgtgggcagaatccacagacacctgaagaccagaaccaccagccacggcagagtgggcgccaccgccgccgtgtacagcgccgccatcctggagtacctgaccgccgaggtgctggagctggccggcaacgccagcaaggacctgaaggtgaagagaatcacccccagacacctgcagctggccatcagaggcgacgaggagctggacagcctgatcaaggccaccatcgccggcggcgagaagagaagatgcagctag

SEQ ID NO: 9920 - DNA, 339 bp, Artificial Sequence
  Description of Artificial Sequence: Synthetic coding sequence
atgggcctggagaccgagaaggccgacgtgcagctgttcatggacgacgacagctacagccaccacagcggcctggagtacgccgaccccgagaagttcgccgacagcgaccaggacagagacccccacagactgaacagccacctgaaggacttcaacgccttctgcaaggacctgcccaacggcagcgccttcagcgccgacaacatggaggagtgcgacagatgctaccactgcagcatcgtgtacgagagaagaaccatgctgctgttctgccagcccgccaccgagcccggcctgaacacctggacccccggcctggagatcggcatcctgtag

SEQ ID NO: 9921 - DNA, 342 bp, Artificial Sequence
  Description of Artificial Sequence: Synthetic coding sequence
atgggcctggagaccgagaaggccgacgtgcagctgttcatggacgacgacagctacagccaccacagcggcctggagtacgccgaccccgagaagttcgccgacagcgaccaggacagagacccccacagactgaacagccacctgaagctgggcttcgaggacgtgatcgccgagcccgtgaccacccacagcttcgacaaggtgtggatctgcagccacgccctgttcgagatcagcaagtacgtgatgtacaagttcctgaccgtgttcctggccatccccctggccttcatcgccggcatcctgttcgccaccctgagctgcctgcacatctggtag

SEQ ID NO: 9922 - DNA, 1038 bp, Artificial Sequence
  Description of Artificial Sequence: Synthetic coding sequence
atgcagagactggtggcctgggaccccgcctgcctgcccctgcccccccccccccccgccttcaagagcatggaggtggccaacttctactacgaggccgactgcctggccgccgcctacggcggcaaggccgcccccgccgccccccccgccgccagacccggccccagaccccccgccggcgagctgggcagcatcggcgaccacgagagagccatcgacttcagcccctacctggagcccctgggcgccccccaggcccccgcccccgccaccgccaccgacaccttcgaggccgccccccccgcccccgcccccgcccccgccagcagcggccagcaccacgacttcctgagcgacctgttcagcgacgactacggcggcaagaactgcaagaagcccgccgagtacggctacgtgagcctgggcagactgggcgccgccaagggcgccctgcaccccggctgcttcgcccccctgcaccccccccccccccccccccccccccccgccgagctgaaggccgagcccggcttcgagcccgccgactgcaagagaaaggaggaggccggcgcccccggcggcggcgccggcatggccgccggcttcccctacgccctgagagcctacctgggctaccaggccgtgcccagcggcagcagcggcagcctgagcaccagcagcagcagcagcccccccggcacccccagccccgccgacgccaaggccccccccaccgcctgctacgccggcgccgcccccgcccccagccaggtgaagagcaaggccaagaagaccgtggacaagcacagcgacgagtacaagatcagaagagagagaaacaacatcgccgtgagaaagagcagagacaaggccaagatgagaaacctggagacccagcacaaggtgctggagctgaccgccgagaacgagagactgcagaagaaggtggagcagctgagcagagagctgagcaccctgagaaacctgttcaagcagctgcccgagcccctgctggccagcagcggccactgctag

SEQ ID NO: 9923 - DNA, 2184 bp, Artificial Sequence
  Description of Artificial Sequence: Synthetic coding sequence
atggagggcgacgccgtggaggccatcgtggaggagagcgagaccttcatcaagggcaaggagagaaagacctaccagagaagaagagagggcggccaggaggaggacgcctgccacctgccccagaaccagaccgacggcggcgaggtggtgcaggacgtgaacagcagcgtgcagatggtgatgatggagcagctggaccccaccctgctgcagatgaagaccgaggtgatggagggcaccgtggcccccgaggccgaggccgccgtggacgacacccagatcatcaccctgcaggtggtgaacatggaggagcagcccatcaacatcggcgagctgcagctggtgcaggtgcccgtgcccgtgaccgtgcccgtggccaccaccagcgtggaggagctgcagggcgcctacgagaacgaggtgagcaaggagggcctggccgagagcgagcccatgatctgccacaccctgcccctgcccgagggcttccaggtggtgaaggtgggcgccaacggcgaggtggagaccctggagcagggcgagctgcccccccaggaggaccccagctggcagaaggaccccgactaccagccccccgccaagaagaccaagaagaccaagaagagcaagctgagatacaccgaggagggcaaggacgtggacgtgagcgtgtacgacttcgaggaggagcagcaggagggcctgctgagcgaggtgaacgccgagaaggtggtgggcaacatgaagccccccaagcccaccaagatcaagaagaagggcgtgaagaagaccttccagtgcgagctgtgcagctacacctgccccagaagaagcaacctggacagacacatgaagagccacaccgacgagagaccccacaagtgccacctgtgcggcagagccttcagaaccgtgaccctgctgagaaaccacctgaacacccacaccggcaccagaccccacaagtgccccgactgcgacatggccttcgtgaccagcggcgagctggtgagacacagaagatacaagcacacccacgagaagcccttcaagtgcagcatgtgcgactacgccagcgtggaggtgagcaagctgaagagacacatcagaagccacaccggcgagagacccttccagtgcagcctgtgcagctacgccagcagagacacctacaagctgaagagacacatgagaacccacagcggcgagaagccctacgagtgctacatctgccacgccagattcacccagagcggcaccatgaagatgcacatcctgcagaagcacaccgagaacgtggccaagttccactgcccccactgcgacaccgtgatcgccagaaagagcgacctgggcgtgcacctgagaaagcagcacagctacatcgagcagggcaagaagtgcagatactgcgacgccgtgttccacgagagatacgccctgatccagcaccagaagagccacaagaacgagaagagattcaagtgcgaccagtgcgactacgcctgcagacaggagagacacatgatcatgcacaagagaacccacaccggcgagaagccctacgcctgcagccactgcgacaagaccttcagacagaagcagctgctggacatgcacttcaagagataccacgaccccaacttcgtgcccgccgccttcgtgtgcagcaagtgcggcaagaccttcaccagaagaaacaccatggccagacacgccgacaactgcgccggccccgacggcgtggagggcgagaacggcggcgagaccaagaagagcaagagaggcagaaagagaaagatgagaagcaagaaggaggacagcagcgacagcgagaacgccgagcccgacctggacgacaacgaggacgaggaggagcccgccgtggagatcgagcccgagcccgagccccagcccgtgacccccgcccccccccccgccaagaagagaagaggcagaccccccggcagaaccaaccagcccaagcagaaccagcccaccgccatcatccaggtggaggaccagaacaccggcgccatcgagaacatcatcgtggaggtgaagaaggagcccgacgccgagcccgccgagggcgaggaggaggaggcccagcccgccgccaccgacgcccccaacggcgacctgacccccgagatgatcctgagcatgatggacagatag

SEQ ID NO: 9924 - DNA, 1200 bp, Artificial Sequence
  Description of Artificial Sequence: Synthetic coding sequence
atggccttcgtgaccagcggcgagctggtgagacacagaagatacaagcacacccacgagaagcccttcaagtgcagcatgtgcgactacgccagcgtggaggtgagcaagctgaagagacacatcagaagccacaccggcgagagacccttccagtgcagcctgtgcagctacgccagcagagacacctacaagctgaagagacacatgagaacccacagcggcgagaagccctacgagtgctacatctgccacgccagattcacccagagcggcaccatgaagatgcacatcctgcagaagcacaccgagaacgtggccaagttccactgcccccactgcgacaccgtgatcgccagaaagagcgacctgggcgtgcacctgagaaagcagcacagctacatcgagcagggcaagaagtgcagatactgcgacgccgtgttccacgagagatacgccctgatccagcaccagaagagccacaagaacgagaagagattcaagtgcgaccagtgcgactacgcctgcagacaggagagacacatgatcatgcacaagagaacccacaccggcgagaagccctacgcctgcagccactgcgacaagaccttcagacagaagcagctgctggacatgcacttcaagagataccacgaccccaacttcgtgcccgccgccttcgtgtgcagcaagtgcggcaagaccttcaccagaagaaacaccatggccagacacgccgacaactgcgccggccccgacggcgtggagggcgagaacggcggcgagaccaagaagagcaagagaggcagaaagagaaagatgagaagcaagaaggaggacagcagcgacagcgagaacgccgagcccgacctggacgacaacgaggacgaggaggagcccgccgtggagatcgagcccgagcccgagccccagcccgtgacccccgcccccccccccgccaagaagagaagaggcagaccccccggcagaaccaaccagcccaagcagaaccagcccaccgccatcatccaggtggaggaccagaacaccggcgccatcgagaacatcatcgtggaggtgaagaaggagcccgacgccgagcccgccgagggcgaggaggaggaggcccagcccgccgccaccgacgcccccaacggcgacctgacccccgagatgatcctgagcatgatggacagatag

SEQ ID NO: 9925 - DNA, 1128 bp, Artificial Sequence
  Description of Artificial Sequence: Synthetic coding sequence
atggagagagccagctgcctgctgctgctgctgctgcccctggtgcacgtgagcgccaccacccccgagccctgcgagctggacgacgaggacttcagatgcgtgtgcaacttcagcgagccccagcccgactggagcgaggccttccagtgcgtgagcgccgtggaggtggagatccacgccggcggcctgaacctggagcccttcctgaagagagtggacgccgacgccgaccccagacagtacgccgacaccgtgaaggccctgagagtgagaagactgaccgtgggcgccgcccaggtgcccgcccagctgctggtgggcgccctgagagtgctggcctacagcagactgaaggagctgaccctggaggacctgaagatcaccggcaccatgccccccctgcccctggaggccaccggcctggccctgagcagcctgagactgagaaacgtgagctgggccaccggcagaagctggctggccgagctgcagcagtggctgaagcccggcctgaaggtgctgagcatcgcccaggcccacagccccgccttcagctgcgagcaggtgagagccttccccgccctgaccagcctggacctgagcgacaaccccggcctgggcgagagaggcctgatggccgccctgtgcccccacaagttccccgccatccagaacctggccctgagaaacaccggcatggagacccccaccggcgtgtgcgccgccctggccgccgccggcgtgcagccccacagcctggacctgagccacaacagcctgagagccaccgtgaaccccagcgcccccagatgcatgtggagcagcgccctgaacagcctgaacctgagcttcgccggcctggagcaggtgcccaagggcctgcccgccaagctgagagtgctggacctgagctgcaacagactgaacagagccccccagcccgacgagctgcccgaggtggacaacctgaccctggacggcaaccccttcctggtgcccggcaccgccctgccccacgagggcagcatgaacagcggcgtggtgcccgcctgcgccagaagcaccctgagcgtgggcgtgagcggcaccctggtgctgctgcagggcgccagaggcttcgcctag

SEQ ID NO: 9926 - DNA, 1128 bp, Artificial Sequence; identical to SEQ ID NO: 9925
  Description of Artificial Sequence: Synthetic coding sequence

SEQ ID NO: 9927 - DNA, 402 bp, Artificial Sequence
  Description of Artificial Sequence: Synthetic coding sequence
atgagcttcccctgcaagttcgtggccagcttcctgctgatcttcaacgtgagcagcaagggcgccgtgagcaaggagatcaccaacgccctggagacctggggcgccctgggccaggacatcaacctggacatccccagcttccagatgagcgacgacatcgacgacatcaagtgggagaagaccagcgacaagaagaagatcgcccagttcagaaaggagaaggagaccttcaaggagaaggacacctacaagctgttcaagaacggcaccctgaagatcaagcacctgaagaccgacgaccaggacatctacaaggtgagcatctacgacaccaagggcaagaacgtgctggagaagatcttcgacctgaagatccagggcaagtgcagcttcccctag

SEQ ID NO: 9928 - DNA, 1056 bp, Artificial Sequence
  Description of Artificial Sequence: Synthetic coding sequence
atgagcttcccctgcaagttcgtggccagcttcctgctgatcttcaacgtgagcagcaagggcgccgtgagcaaggagatcaccaacgccctggagacctggggcgccctgggccaggacatcaacctggacatccccagcttccagatgagcgacgacatcgacgacatcaagtgggagaagaccagcgacaagaagaagatcgcccagttcagaaaggagaaggagaccttcaaggagaaggacacctacaagctgttcaagaacggcaccctgaagatcaagcacctgaagaccgacgaccaggacatctacaaggtgagcatctacgacaccaagggcaagaacgtgctggagaagatcttcgacctgaagatccaggagagagtgagcaagcccaagatcagctggacctgcatcaacaccaccctgacctgcgaggtgatgaacggcaccgaccccgagctgaacctgtaccaggacggcaagcacctgaagctgagccagagagtgatcacccacaagtggaccaccagcctgagcgccaagttcaagtgcaccgccggcaacaaggtgagcaaggagagcagcgtggagcccgtgagctgccccgagaagggcctggacatctacctgatcatcggcatctgcggcggcggcagcctgctgatggtgttcgtggccctgctggtgttctacatcaccaagagaaagaagcagagaagcagaagaaacgacgaggagctggagaccagagcccacagagtggccaccgaggagagaggcagaaagccccaccagatccccgccagcaccccccagaaccccgccaccagccagcaccccccccccccccccggccacagaagccaggcccccagccacagaccccccccccccggccacagagtgcagcaccagccccagaagagaccccccgcccccagcggcacccaggtgcaccagcagaagggcccccccctgcccagacccagagtgcagcccaagcccccccacggcgccgccgagaacagcctgagccccagcagcaactag

SEQ ID NO: 9929 - DNA, 2544 bp, Artificial Sequence
  Description of Artificial Sequence: Synthetic coding sequence
atgcacctgctgggcccctggctgctgctgctggtgctggagtacctggccttcagcgacagcagcaagtgggtgttcgagcaccccgagaccctgtacgcctgggagggcgcctgcgtgtggatcccctgcacctacagagccctggacggcgacctggagagcttcatcctgttccacaaccccgagtacaacaagaacaccagcaagttcgacggcaccagactgtacgagagcaccaaggacggcaaggtgcccagcgagcagaagagagtgcagttcctgggcgacaagaacaagaactgcaccctgagcatccaccccgtgcacctgaacgacagcggccagctgggcctgagaatggagagcaagaccgagaagtggatggagagaatccacctgaacgtgagcgagagacccttccccccccacatccagctgccccccgagatccaggagagccaggaggtgaccctgacctgcctgctgaacttcagctgctacggctaccccatccagctgcagtggctgctggagggcgtgcccatgagacaggccgccgtgaccagcaccagcctgaccatcaagagcgtgttcaccagaagcgagctgaagttcagcccccagtggagccaccacggcaagatcgtgacctgccagctgcaggacgccgacggcaagttcctgagcaacgacaccgtgcagctgaacgtgaagcacacccccaagctggagatcaaggtgacccccagcgacgccatcgtgagagagggcgacagcgtgaccatgacctgcgaggtgagcagcagcaaccccgagtacaccaccgtgagctggctgaaggacggcaccagcctgaagaagcagaacaccttcaccctgaacctgagagaggtgaccaaggaccagagcggcaagtactgctgccaggtgagcaacgacgtgggccccggcagaagcgaggaggtgttcctgcaggtgcagtacgcccccgagcccagcaccgtgcagatcctgcacagccccgccgtggagggcagccaggtggagttcctgtgcatgagcctggccaaccccctgcccaccaactacacctggtaccacaacggcaaggagatgcagggcagaaccgaggagaaggtgcacatccccaagatcctgccctggcacgccggcacctacagctgcgtggccgagaacatcctgggcaccggccagagaggccccggcgccgagctggacgtgcagtacccccccaagaaggtgaccaccgtgatccagaaccccatgcccatcagagagggcgacaccgtgaccctgagctgcaactacaacagcagcaaccccagcgtgaccagatacgagtggaagccccacggcgcctgggaggagcccagcctgggcgtgctgaagatccagaacgtgggctgggacaacaccaccatcgcctgcgccgcctgcaacagctggtgcagctgggccagccccgtggccctgaacgtgcagtacgcccccagagacgtgagagtgagaaagatcaagcccctgagcgagatccacagcggcaacagcgtgagcctgcagtgcgacttcagcagcagccaccccaaggaggtgcagttcttctgggagaagaacggcagactgctgggcaaggagagccagctgaacttcgacagcatcagccccgaggacgccggcagctacagctgctgggtgaacaacagcatcggccagaccgccagcaaggcctggaccctggaggtgctgtacgcccccagaagactgagagtgagcatgagccccggcgaccaggtgatggagggcaagagcgccaccctgacctgcgagagcgacgccaacccccccgtgagccactacacctggttcgactggaacaaccagagcctgccctaccacagccagaagctgagactggagcccgtgaaggtgcagcacagcggcgcctactggtgccagggcaccaacagcgtgggcaagggcagaagccccctgagcaccctgaccgtgtactacagccccgagaccatcggcagaagagtggccgtgggcctgggcagctgcctggccatcctgatcctggccatctgcggcctgaagctgcagagaagatggaagagaacccagagccagcagggcctgcaggagaacagcagcggccagagcttcttcgtgagaaacaagaaggtgagaagagcccccctgagcgagggcccccacagcctgggctgctacaaccccatgatggaggacggcatcagctacaccaccctgagattccccgagatgaacatccccagaaccggcgacgccgagagcagcgagatgcagagacccccccccgactgcgacgacaccgtgacctacagcgccctgcacaagagacaggtgggcgactacgagaacgtgatccccgacttccccgaggacgagggcatccactacagcgagctgatccagttcggcgtgggcgagagaccccaggcccaggagaacgtggactacgtgatcctgaagcactag

SEQ ID NO: 9930 - DNA, 1989 bp, Artificial Sequence
  Description of Artificial Sequence: Synthetic coding sequence
atggagagcaagaccgagaagtggatggagagaatccacctgaacgtgagcgagagacccttccccccccacatccagctgccccccgagatccaggagagccaggaggtgaccctgacctgcctgctgaacttcagctgctacggctaccccatccagctgcagtggctgctggagggcgtgcccatgagacaggccgccgtgaccagcaccagcctgaccatcaagagcgtgttcaccagaagcgagctgaagttcagcccccagtggagccaccacggcaagatcgtgacctgccagctgcaggacgccgacggcaagttcctgagcaacgacaccgtgcagctgaacgtgaagcacacccccaagctggagatcaaggtgacccccagcgacgccatcgtgagagagggcgacagcgtgaccatgacctgcgaggtgagcagcagcaaccccgagtacaccaccgtgagctggctgaaggacggcaccagcctgaagaagcagaacaccttcaccctgaacctgagagaggtgaccaaggaccagagcggcaagtactgctgccaggtgagcaacgacgtgggccccggcagaagcgaggaggtgttcctgcaggtgcagtacgcccccgagcccagcaccgtgcagatcctgcacagccccgccgtggagggcagccaggtggagttcctgtgcatgagcctggccaaccccctgcccaccaactacacctggtaccacaacggcaaggagatgcagggcagaaccgaggagaaggtgcacatccccaagatcctgccctggcacgccggcacctacagctgcgtggccgagaacatcctgggcaccggccagagaggccccggcgccgagctggacgtgcagtacccccccaagaaggtgaccaccgtgatccagaaccccatgcccatcagagagggcgacaccgtgaccctgagctgcaactacaacagcagcaaccccagcgtgaccagatacgagtggaagccccacggcgcctgggaggagcccagcctgggcgtgctgaagatccagaacgtgggctgggacaacaccaccatcgcctgcgccgcctgcaacagctggtgcagctgggccagccccgtggccctgaacgtgcagtacgcccccagagacgtgagagtgagaaagatcaagcccctgagcgagatccacagcggcaacagcgtgagcctgcagtgcgacttcagcagcagccaccccaaggaggtgcagttcttctgggagaagaacggcagactgctgggcaaggagagccagctgaacttcgacagcatcagccccgaggacgccggcagctacagctgctgggtgaacaacagcatcggccagaccgccagcaaggcctggaccctggaggtgctgtacgcccccagaagactgagagtgagcatgagccccggcgaccaggtgatggagggcaagagcgccaccctgacctgcgagagcgacgccaacccccccgtgagccactacacctggttcgactggaacaaccagagcctgccctaccacagccagaagctgagactggagcccgtgaaggtgcagcacagcggcgcctactggtgccagggcaccaacagcgtgggcaagggcagaagccccctgagcaccctgaccgtgtactacagccccgagaccatcggcagaagagtggccgtgggcctgggcagctgcctggccatcctgatcctggccatctgcggcctgaagctgcagagaagagacgccgagagcagcgagatgcagagacccccccccgactgcgacgacaccgtgacctacagcgccctgcacaagagacaggtgggcgactacgagaacgtgatccccgacttccccgaggacgagggcatccactacagcgagctgatccagttcggcgtgggcgagagaccccaggcccaggagaacgtggactacgtgatcctgaagcactag

SEQ ID NO: 9931 - DNA, 2013 bp, Artificial Sequence
  Description of Artificial Sequence: Synthetic coding sequence
atgcacctgctgggcccctggctgctgctgctggtgctggagtacctggccttcagcgacagcagcaagtgggtgttcgagcaccccgagaccctgtacgcctgggagggcgcctgcgtgtggatcccctgcacctacagagccctggacggcgacctggagagcttcatcctgttccacaaccccgagtacaacaagaacaccagcaagttcgacggcaccagactgtacgagagcaccaaggacggcaaggtgcccagcgagcagaagagagtgcagttcctgggcgacaagaacaagaactgcaccctgagcatccaccccgtgcacctgaacgacagcggccagctgggcctgagaatggagagcaagaccgagaagtggatggagagaatccacctgaacgtgagcgagagacccttccccccccacatccagctgccccccgagatccaggagagccaggaggtgaccctgacctgcctgctgaacttcagctgctacggctaccccatccagctgcagtggctgctggagggcgtgcccatgagacaggccgccgtgaccagcaccagcctgaccatcaagagcgtgttcaccagaagcgagctgaagttcagcccccagtggagccaccacggcaagatcgtgacctgccagctgcaggacgccgacggcaagttcctgagcaacgacaccgtgcagctgaacgtgaagcacccccccaagaaggtgaccaccgtgatccagaaccccatgcccatcagagagggcgacaccgtgaccctgagctgcaactacaacagcagcaaccccagcgtgaccagatacgagtggaagccccacggcgcctgggaggagcccagcctgggcgtgctgaagatccagaacgtgggctgggacaacaccaccatcgcctgcgccgcctgcaacagctggtgcagctgggccagccccgtggccctgaacgtgcagtacgcccccagagacgtgagagtgagaaagatcaagcccctgagcgagatccacagcggcaacagcgtgagcctgcagtgcgacttcagcagcagccaccccaaggaggtgcagttcttctgggagaagaacggcagactgctgggcaaggagagccagctgaacttcgacagcatcagccccgaggacgccggcagctacagctgctgggtgaacaacagcatcggccagaccgccagcaaggcctggaccctggaggtgctgtacgcccccagaagactgagagtgagcatgagccccggcgaccaggtgatggagggcaagagcgccaccctgacctgcgagagcgacgccaacccccccgtgagccactacacctggttcgactggaacaaccagagcctgccctaccacagccagaagctgagactggagcccgtgaaggtgcagcacagcggcgcctactggtgccagggcaccaacagcgtgggcaagggcagaagccccctgagcaccctgaccgtgtactacagccccgagaccatcggcagaagagtggccgtgggcctgggcagctgcctggccatcctgatcctggccatctgcggcctgaagctgcagagaagatggaagagaacccagagccagcagggcctgcaggagaacagcagcggccagagcttcttcgtgagaaacaagaaggtgagaagagcccccctgagcgagggcccccacagcctgggctgctacaaccccatgatggaggacggcatcagctacaccaccctgagattccccgagatgaacatccccagaaccggcgacgccgagagcagcgagatgcagagacccccccccgactgcgacgacaccgtgacctacagcgccctgcacaagagacaggtgggcgactacgagaacgtgatccccgacttccccgaggacgagggcatccactacagcgagctgatccagttcggcgtgggcgagagaccccaggcccaggagaacgtggactacgtgatcctgaagcactag

SEQ ID NO: 9932 - DNA, 2028 bp, Artificial Sequence
  Description of Artificial Sequence: Synthetic coding sequence
atgagcctgtggctgctggagggcgtgcccatgagacaggccgccgtgaccagcaccagcctgaccatcaagagcgtgttcaccagaagcgagctgaagttcagcccccagtggagccaccacggcaagatcgtgacctgccagctgcaggacgccgacggcaagttcctgagcaacgacaccgtgcagctgaacgtgaagcacacccccaagctggagatcaaggtgacccccagcgacgccatcgtgagagagggcgacagcgtgaccatgacctgcgaggtgagcagcagcaaccccgagtacaccaccgtgagctggctgaaggacggcaccagcctgaagaagcagaacaccttcaccctgaacctgagagaggtgaccaaggaccagagcggcaagtactgctgccaggtgagcaacgacgtgggccccggcagaagcgaggaggtgttcctgcaggtgcagtacgcccccgagcccagcaccgtgcagatcctgcacagccccgccgtggagggcagccaggtggagttcctgtgcatgagcctggccaaccccctgcccaccaactacacctggtaccacaacggcaaggagatgcagggcagaaccgaggagaaggtgcacatccccaagatcctgccctggcacgccggcacctacagctgcgtggccgagaacatcctgggcaccggccagagaggccccggcgccgagctggacgtgcagtacccccccaagaaggtgaccaccgtgatccagaaccccatgcccatcagagagggcgacaccgtgaccctgagctgcaactacaacagcagcaaccccagcgtgaccagatacgagtggaagccccacggcgcctgggaggagcccagcctgggcgtgctgaagatccagaacgtgggctgggacaacaccaccatcgcctgcgccgcctgcaacagctggtgcagctgggccagccccgtggccctgaacgtgcagtacgcccccagagacgtgagagtgagaaagatcaagcccctgagcgagatccacagcggcaacagcgtgagcctgcagtgcgacttcagcagcagccaccccaaggaggtgcagttcttctgggagaagaacggcagactgctgggcaaggagagccagctgaacttcgacagcatcagccccgaggacgccggcagctacagctgctgggtgaacaacagcatcggccagaccgccagcaaggcctggaccctggaggtgctgtacgcccccagaagactgagagtgagcatgagccccggcgaccaggtgatggagggcaagagcgccaccctgacctgcgagagcgacgccaacccccccgtgagccactacacctggttcgactggaacaaccagagcctgccctaccacagccagaagctgagactggagcccgtgaaggtgcagcacagcggcgcctactggtgccagggcaccaacagcgtgggcaagggcagaagccccctgagcaccctgaccgtgtactacagccccgagaccatcggcagaagagtggccgtgggcctgggcagctgcctggccatcctgatcctggccatctgcggcctgaagctgcagagaagatggaagagaacccagagccagcagggcctgcaggagaacagcagcggccagagcttcttcgtgagaaacaagaaggtgagaagagcccccctgagcgagggcccccacagcctgggctgctacaaccccatgatggaggacggcatcagctacaccaccctgagattccccgagatgaacatccccagaaccggcgacgccgagagcagcgagatgcagagacccccccccgactgcgacgacaccgtgacctacagcgccctgcacaagagacaggtgggcgactacgagaacgtgatccccgacttccccgaggacgagggcatccactacagcgagctgatccagttcggcgtgggcgagagaccccaggcccaggagaacgtggactacgtgatcctgaagcactag

SEQ ID NO: 9933 - DNA, 2280 bp, Artificial Sequence
  Description of Artificial Sequence: Synthetic coding sequence
atgcacctgctgggcccctggctgctgctgctggtgctggagtacctggccttcagcgacagcagcaagtgggtgttcgagcaccccgagaccctgtacgcctgggagggcgcctgcgtgtggatcccctgcacctacagagccctggacggcgacctggagagcttcatcctgttccacaaccccgagtacaacaagaacaccagcaagttcgacggcaccagactgtacgagagcaccaaggacggcaaggtgcccagcgagcagaagagagtgcagttcctgggcgacaagaacaagaactgcaccctgagcatccaccccgtgcacctgaacgacagcggccagctgggcctgagaatggagagcaagaccgagaagtggatggagagaatccacctgaacgtgagcgagagacccttccccccccacatccagctgccccccgagatccaggagagccaggaggtgaccctgacctgcctgctgaacttcagctgctacggctaccccatccagctgcagtggctgctggagggcgtgcccatgagacaggccgccgtgaccagcaccagcctgaccatcaagagcgtgttcaccagaagcgagctgaagttcagcccccagtggagccaccacggcaagatcgtgacctgccagctgcaggacgccgacggcaagttcctgagcaacgacaccgtgcagctgaacgtgaagcacacccccaagctggagatcaaggtgacccccagcgacgccatcgtgagagagggcgacagcgtgaccatgacctgcgaggtgagcagcagcaaccccgagtacaccaccgtgagctggctgaaggacggcaccagcctgaagaagcagaacaccttcaccctgaacctgagagaggtgaccaaggaccagagcggcaagtactgctgccaggtgagcaacgacgtgggccccggcagaagcgaggaggtgttcctgcaggtgcagtacccccccaagaaggtgaccaccgtgatccagaaccccatgcccatcagagagggcgacaccgtgaccctgagctgcaactacaacagcagcaaccccagcgtgaccagatacgagtggaagccccacggcgcctgggaggagcccagcctgggcgtgctgaagatccagaacgtgggctgggacaacaccaccatcgcctgcgccgcctgcaacagctggtgcagctgggccagccccgtggccctgaacgtgcagtacgcccccagagacgtgagagtgagaaagatcaagcccctgagcgagatccacagcggcaacagcgtgagcctgcagtgcgacttcagcagcagccaccccaaggaggtgcagttcttctgggagaagaacggcagactgctgggcaaggagagccagctgaacttcgacagcatcagccccgaggacgccggcagctacagctgctgggtgaacaacagcatcggccagaccgccagcaaggcctggaccctggaggtgctgtacgcccccagaagactgagagtgagcatgagccccggcgaccaggtgatggagggcaagagcgccaccctgacctgcgagagcgacgccaacccccccgtgagccactacacctggttcgactggaacaaccagagcctgccctaccacagccagaagctgagactggagcccgtgaaggtgcagcacagcggcgcctactggtgccagggcaccaacagcgtgggcaagggcagaagccccctgagcaccctgaccgtgtactacagccccgagaccatcggcagaagagtggccgtgggcctgggcagctgcctggccatcctgatcctggccatctgcggcctgaagctgcagagaagatggaagagaacccagagccagcagggcctgcaggagaacagcagcggccagagcttcttcgtgagaaacaagaaggtgagaagagcccccctgagcgagggcccccacagcctgggctgctacaaccccatgatggaggacggcatcagctacaccaccctgagattccccgagatgaacatccccagaaccggcgacgccgagagcagcgagatgcagagacccccccccgactgcgacgacaccgtgacctacagcgccctgcacaagagacaggtgggcgactacgagaacgtgatccccgacttccccgaggacgagggcatccactacagcgagctgatccagttcggcgtgggcgagagaccccaggcccaggagaacgtggactacgtgatcctgaagcactag

SEQ ID NO: 9934 - DNA, 2256 bp, Artificial Sequence
  Description of Artificial Sequence: Synthetic coding sequence
atgcacctgctgggcccctggctgctgctgctggtgctggagtacctggccttcagcgacagcagcaagtgggtgttcgagcaccccgagaccctgtacgcctgggagggcgcctgcgtgtggatcccctgcacctacagagccctggacggcgacctggagagcttcatcctgttccacaaccccgagtacaacaagaacaccagcaagttcgacggcaccagactgtacgagagcaccaaggacggcaaggtgcccagcgagcagaagagagtgcagttcctgggcgacaagaacaagaactgcaccctgagcatccaccccgtgcacctgaacgacagcggccagctgggcctgagaatggagagcaagaccgagaagtggatggagagaatccacctgaacgtgagcgagagacccttccccccccacatccagctgccccccgagatccaggagagccaggaggtgaccctgacctgcctgctgaacttcagctgctacggctaccccatccagctgcagtggctgctggagggcgtgcccatgagacaggccgccgtgaccagcaccagcctgaccatcaagagcgtgttcaccagaagcgagctgaagttcagcccccagtggagccaccacggcaagatcgtgacctgccagctgcaggacgccgacggcaagttcctgagcaacgacaccgtgcagctgaacgtgaagcacacccccaagctggagatcaaggtgacccccagcgacgccatcgtgagagagggcgacagcgtgaccatgacctgcgaggtgagcagcagcaaccccgagtacaccaccgtgagctggctgaaggacggcaccagcctgaagaagcagaacaccttcaccctgaacctgagagaggtgaccaaggaccagagcggcaagtactgctgccaggtgagcaacgacgtgggccccggcagaagcgaggaggtgttcctgcaggtgcagtacgcccccgagcccagcaccgtgcagatcctgcacagccccgccgtggagggcagccaggtggagttcctgtgcatgagcctggccaaccccctgcccaccaactacacctggtaccacaacggcaaggagatgcagggcagaaccgaggagaaggtgcacatccccaagatcctgccctggcacgccggcacctacagctgcgtggccgagaacatcctgggcaccggccagagaggccccggcgccgagctggacgtgcagtacccccccaagaaggtgaccaccgtgatccagaaccccatgcccatcagagagggcgacaccgtgaccctgagctgcaactacaacagcagcaaccccagcgtgaccagatacgagtggaagccccacggcgcctgggaggagcccagcctgggcgtgctgaagatccagaacgtgggctgggacaacaccaccatcgcctgcgccgcctgcaacagctggtgcagctgggccagccccgtggccctgaacgtgcagtacgcccccagagacgtgagagtgagaaagatcaagcccctgagcgagatccacagcggcaacagcgtgagcctgcagtgcgacttcagcagcagccaccccaaggaggtgcagttcttctgggagaagaacggcagactgctgggcaaggagagccagctgaacttcgacagcatcagccccgaggacgccggcagctacagctgctgggtgaacaacagcatcggccagaccgccagcaaggcctggaccctggaggtgctgtacgcccccagaagactgagagtgagcatgagccccggcgaccaggtgatggagggcaagagcgccaccctgacctgcgagagcgacgccaacccccccgtgagccactacacctggttcgactggaacaaccagagcctgccctaccacagccagaagctgagactggagcccgtgaaggtgcagcacagcggcgcctactggtgccagggcaccaacagcgtgggcaagggcagaagccccctgagcaccctgaccgtgtactacagccccgagaccatcggcagaagagtggccgtgggcctgggcagctgcctggccatcctgatcctggccatctgcggcctgaagctgcagagaagatggaagagaacccagagccagcagggcctgcaggagaacagcagcggccagagcttcttcgtgagaaacaagaagagatgcagagtgctgagagacgccgagaccagccccggcctgagatag

SEQ ID NO: 9935 - DNA, 783 bp, Artificial Sequence
  Description of Artificial Sequence: Synthetic coding sequence
atggccagaccccacccctggtggctgtgcgtgctgggcaccctggtgggcctgagcgccacccccgcccccaagagctgccccgagagacactactgggcccagggcaagctgtgctgccagatgtgcgagcccggcaccttcctggtgaaggactgcgaccagcacagaaaggccgcccagtgcgacccctgcatccccggcgtgagcttcagccccgaccaccacaccagaccccactgcgagagctgcagacactgcaacagcggcctgctggtgagaaactgcaccatcaccgccaacgccgagtgcgcctgcagaaacggctggcagtgcagagacaaggagtgcaccgagtgcgaccccctgcccaaccccagcctgaccgccagaagcagccaggccctgagcccccacccccagcccacccacctgccctacgtgagcgagatgctggaggccagaaccgccggccacatgcagaccctggccgacttcagacagctgcccgccagaaccctgagcacccactggcccccccagagaagcctgtgcagcagcgacttcatcagaatcctggtgatcttcagcggcatgttcctggtgttcaccctggccggcgccctgttcctgcaccagagaagaaagtacagaagcaacaagggcgagagccccgtggagcccgccgagccctgccactacagctgccccagagaggaggagggcagcaccatccccatccaggaggactacagaaagcccgagcccgcctgcagcccctag

SEQ ID NO: 9936 - DNA, 1158 bp, Artificial Sequence
  Description of Artificial Sequence: Synthetic coding sequence
atgctggtgagaagaggcgccagagccggccccagaatgcccagaggctggaccgccctgtgcctgctgagcctgctgcccagcggcttcatgagcctggacaacaacggcaccgccacccccgagctgcccacccagggcaccttcagcaacgtgagcaccaacgtgagctaccaggagaccaccacccccagcaccctgggcagcaccagcctgcaccccgtgagccagcacggcaacgaggccaccaccaacatcaccgagaccaccgtgaagttcaccagcaccagcgtgatcaccagcgtgtacggcaacaccaacagcagcgtgcagagccagaccagcgtgatcagcaccgtgttcaccacccccgccaacgtgagcacccccgagaccaccctgaagcccagcctgagccccggcaacgtgagcgacctgagcaccaccagcaccagcctggccaccagccccaccaagccctacaccagcagcagccccatcctgagcgacatcaaggccgagatcaagtgcagcggcatcagagaggtgaagctgacccagggcatctgcctggagcagaacaagaccagcagctgcgccgagttcaagaaggacagaggcgagggcctggccagagtgctgtgcggcgaggagcaggccgacgccgacgccggcgcccaggtgtgcagcctgctgctggcccagagcgaggtgagaccccagtgcctgctgctggtgctggccaacagaaccgagatcagcagcaagctgcagctgatgaagaagcaccagagcgacctgaagaagctgggcatcctggacttcaccgagcaggacgtggccagccaccagagctacagccagaagaccctgatcgccctggtgaccagcggcgccctgctggccgtgctgggcatcaccggctacttcctgatgaacagaagaagctggagccccaccggcgagagactgggcgaggacccctactacaccgagaacggcggcggccagggctacagcagcggccccggcaccagccccgaggcccagggcaaggccagcgtgaacagaggcgcccaggagaacggcaccggccaggccaccagcagaaacggccacagcgccagacagcacgtggtggccgacaccgagctgtag

SEQ ID NO: 9937 - DNA, 987 bp, Artificial Sequence
  Description of Artificial Sequence: Synthetic coding sequence
atgctggtgagaagaggcgccagagccggccccagaatgcccagaggctggaccgccctgtgcctgctgagcctgctgcccagcggcttcatgagcctggacaacaacggcaccgccacccccgagctgcccacccagggcaccttcagcaacgtgagcaccaacgtgagctaccaggagaccaccacccccagcaccctgggcagcaccagcctgcaccccgtgagccagcacggcaacgaggccaccaccaacatcaccgagaccaccgtgaagttcaccagcaccagcgtgatcaccagcgtgtacggcaacaccaacagcagcgtgcagagccagaccagcgtgatcagcaccgtgttcaccacccccgccaacgtgagcacccccgagaccaccctgaagcccagcctgagccccggcaacgtgagcgacctgagcaccaccagcaccagcctggccaccagccccaccaagccctacaccagcagcagccccatcctgagcgacatcaaggccgagatcaagtgcagcggcatcagagaggtgaagctgacccagggcatctgcctggagcagaacaagaccagcagctgcgccgagttcaagaaggacagaggcgagggcctggccagagtgctgtgcggcgaggagcaggccgacgccgacgccggcgcccaggtgtgcagcctgctgctggcccagagcgaggtgagaccccagtgcctgctgctggtgctggccaacagaaccgagatcagcagcaagctgcagctgatgaagaagcaccagagcgacctgaagaagctgggcatcctggacttcaccgagcaggacgtggccagccaccagagctacagccagaagaccctgatcgccctggtgaccagcggcgccctgctggccgtgctgggcatcaccggctacttcctgatgaacagaagaagctggagccccaccggcgagagactggagctggagccctag

SEQ ID NO: 9938 - DNA, 684 bp, Artificial Sequence
  Description of Artificial Sequence: Synthetic coding sequence
atggacttcggccccggcagactgttcagattcttcagctactgcgtggtggcccacatccagctggccgtgttcttcttcagcgtgggcatcctggagaccagaatcctgctggccgacggcgccgagttcaagaaggacagaggcgagggcctggccagagtgctgtgcggcgaggagcaggccgacgccgacgccggcgcccaggtgtgcagcctgctgctggcccagagcgaggtgagaccccagtgcctgctgctggtgctggccaacagaaccgagatcagcagcaagctgcagctgatgaagaagcaccagagcgacctgaagaagctgggcatcctggacttcaccgagcaggacgtggccagccaccagagctacagccagaagaccctgatcgccctggtgaccagcggcgccctgctggccgtgctgggcatcaccggctacttcctgatgaacagaagaagctggagccccaccggcgagagactgggcgaggacccctactacaccgagaacggcggcggccagggctacagcagcggccccggcaccagccccgaggcccagggcaaggccagcgtgaacagaggcgcccaggagaacggcaccggccaggccaccagcagaaacggccacagcgccagacagcacgtggtggccgacaccgagctgtag

SEQ ID NO: 9939 - DNA, 1068 bp, Artificial Sequence
  Description of Artificial Sequence: Synthetic coding sequence
atgagcctggacaacaacggcaccgccacccccgagctgcccacccagggcaccttcagcaacgtgagcaccaacgtgagctaccaggagaccaccacccccagcaccctgggcagcaccagcctgcaccccgtgagccagcacggcaacgaggccaccaccaacatcaccgagaccaccgtgaagttcaccagcaccagcgtgatcaccagcgtgtacggcaacaccaacagcagcgtgcagagccagaccagcgtgatcagcaccgtgttcaccacccccgccaacgtgagcacccccgagaccaccctgaagcccagcctgagccccggcaacgtgagcgacctgagcaccaccagcaccagcctggccaccagccccaccaagccctacaccagcagcagccccatcctgagcgacatcaaggccgagatcaagtgcagcggcatcagagaggtgaagctgacccagggcatctgcctggagcagaacaagaccagcagctgcgccgagttcaagaaggacagaggcgagggcctggccagagtgctgtgcggcgaggagcaggccgacgccgacgccggcgcccaggtgtgcagcctgctgctggcccagagcgaggtgagaccccagtgcctgctgctggtgctggccaacagaaccgagatcagcagcaagctgcagctgatgaagaagcaccagagcgacctgaagaagctgggcatcctggacttcaccgagcaggacgtggccagccaccagagctacagccagaagaccctgatcgccctggtgaccagcggcgccctgctggccgtgctgggcatcaccggctacttcctgatgaacagaagaagctggagccccaccggcgagagactgggcgaggacccctactacaccgagaacggcggcggccagggctacagcagcggccccggcaccagccccgaggcccagggcaaggccagcgtgaacagaggcgcccaggagaacggcaccggccaggccaccagcagaaacggccacagcgccagacagcacgtggtggccgacaccgagctgtag

SEQ ID NO: 9940 - DNA, 753 bp, Artificial Sequence
  Description of Artificial Sequence: Synthetic coding sequence
atgttcctgcagatgtaccccaccaagaagctgcagcacctggtgcccctggaggtgcccgcctgcaccctgtgcctgaacatggccatgagaccccagcagaccagccaggccgagatcaagtgcagcggcatcagagaggtgaagctgacccagggcatctgcctggagcagaacaagaccagcagctgcgccgagttcaagaaggacagaggcgagggcctggccagagtgctgtgcggcgaggagcaggccgacgccgacgccggcgcccaggtgtgcagcctgctgctggcccagagcgaggtgagaccccagtgcctgctgctggtgctggccaacagaaccgagatcagcagcaagctgcagctgatgaagaagcaccagagcgacctgaagaagctgggcatcctggacttcaccgagcaggacgtggccagccaccagagctacagccagaagaccctgatcgccctggtgaccagcggcgccctgctggccgtgctgggcatcaccggctacttcctgatgaacagaagaagctggagccccaccggcgagagactgggcgaggacccctactacaccgagaacggcggcggccagggctacagcagcggccccggcaccagccccgaggcccagggcaaggccagcgtgaacagaggcgcccaggagaacggcaccggccaggccaccagcagaaacggccacagcgccagacagcacgtggtggccgacaccgagctgtag

SEQ ID NO: 9941 - DNA, 516 bp, Artificial Sequence
  Description of Artificial Sequence: Synthetic coding sequence
atggagcacagcaccttcctgagcggcctggtgctggccaccctgctgagccaggtgagccccttcaagatccccatcgaggagctggaggacagagtgttcgtgaactgcaacaccagcatcacctgggtggagggcaccgtgggcaccctgctgagcgacatcaccagactggacctgggcaagagaatcctggaccccagaggcatctacagatgcaacggcaccgacatctacaaggacaaggagagcaccgtgcaggtgcactacagaatgtgccagagctgcgtggagctggaccccgccaccgtggccggcatcatcgtgaccgacgtgatcgccaccctgctgctggccctgggcgtgttctgcttcgccggccacgagaccggcagactgagcggcgccgccgacacccaggccctgctgagaaacgaccaggtgtaccagcccctgagagacagagacgacgcccagtacagccacctgggcggcaactgggccagaaacaagtag

SEQ ID NO: 9942 - DNA, 384 bp, Artificial Sequence
  Description of Artificial Sequence: Synthetic coding sequence
atggagcacagcaccttcctgagcggcctggtgctggccaccctgctgagccaggtgagccccttcaagatccccatcgaggagctggaggacagagtgttcgtgaactgcaacaccagcatcacctgggtggagggcaccgtgggcaccctgctgagcgacatcaccagactggacctgggcaagagaatcctggaccccagaggcatctacagatgcaacggcaccgacatctacaaggacaaggagagcaccgtgcaggtgcactacagaaccgccgacacccaggccctgctgagaaacgaccaggtgtaccagcccctgagagacagagacgacgcccagtacagccacctgggcggcaactgggccagaaacaagtag

SEQ ID NO: 9943 - DNA, 1377 bp, Artificial Sequence
  Description of Artificial Sequence: Synthetic coding sequence
atgaacagaggcgtgcccttcagacacctgctgctggtgctgcagctggccctgctgcccgccgccacccagggcaagaaggtggtgctgggcaagaagggcgacaccgtggagctgacctgcaccgccagccagaagaagagcatccagttccactggaagaacagcaaccagatcaagatcctgggcaaccagggcagcttcctgaccaagggccccagcaagctgaacgacagagccgacagcagaagaagcctgtgggaccagggcaacttccccctgatcatcaagaacctgaagatcgaggacagcgacacctacatctgcgaggtggaggaccagaaggaggaggtgcagctgctggtgttcggcctgaccgccaacagcgacacccacctgctgcagggccagagcctgaccctgaccctggagagcccccccggcagcagccccagcgtgcagtgcagaagccccagaggcaagaacatccagggcggcaagaccctgagcgtgagccagctggagctgcaggacagcggcacctggacctgcaccgtgctgcagaaccagaagaaggtggagttcaagatcgacatcgtggtgctggccttccagaaggccagcagcatcgtgtacaagaaggagggcgagcaggtggagttcagcttccccctggccttcaccgtggagaagctgaccggcagcggcgagctgtggtggcaggccgagagagccagcagcagcaagagctggatcaccttcgacctgaagaacaaggaggtgagcgtgaagagagtgacccaggaccccaagctgcagatgggcaagaagctgcccctgcacctgaccctgccccaggccctgccccagtacgccggcagcggcaacctgaccctggccctggaggccaagaccggcaagctgcaccaggaggtgaacctggtggtgatgagagccacccagctgcagaagaacctgacctgcgaggtgtggggccccaccagccccaagctgatgctgagcctgaagctggagaacaaggaggccaaggtgagcaagagagagaaggccgtgtgggtgctgaaccccgaggccggcatgtggcagtgcctgctgagcgacagcggccaggtgctgctggagagcaacatcaaggtgctgcccacctggagcacccccgtgcagcccatggccctgatcgtgctgggcggcgtggccggcctgctgctgttcatcggcctgggcatcttcttctgcgtgagatgcagacacagaagaagacaggccgagagaatgagccagatcaagagactgctgagcgagaagaagacctgccagtgcccccacagattccagaagacctgcagccccatctag

SEQ ID NO: 9944 - DNA, 723 bp, Artificial Sequence
  Description of Artificial Sequence: Synthetic coding sequence
atgatcgagacctacaaccagaccagccccagaagcgccgccaccggcctgcccatcagcatgaagatcttcatgtacctgctgaccgtgttcctgatcacccagatgatcggcagcgccctgttcgccgtgtacctgcacagaagactggacaagatcgaggacgagagaaacctgcacgaggacttcgtgttcatgaagaccatccagagatgcaacaccggcgagagaagcctgagcctgctgaactgcgaggagatcaagagccagttcgagggcttcgtgaaggacatcatgctgaacaaggaggagaccaagaaggagaacagcttcgagatgcagaaggtgctgcagtgggccgagaagggctactacaccatgagcaacaacctggtgaccctggagaacggcaagcagctgaccgtgaagagacagggcctgtactacatctacgcccaggtgaccttctgcagcaacagagaggccagcagccaggcccccttcatcgccagcctgtgcctgaagagccccggcagattcgagagaatcctgctgagagccgccaacacccacagcagcgccaagccctgcggccagcagagcatccacctgggcggcgtgttcgagctgcagcccggcgccagcgtgttcgtgaacgtgaccgaccccagccaggtgagccacggcaccggcttcaccagcttcggcctgctgaagctgtag

SEQ ID NO: 9945 - DNA, 786 bp, Artificial Sequence
  Description of Artificial Sequence: Synthetic coding sequence
atgatcgagacctacaaccagaccagccccagaagcgccgccaccggcctgcccatcagcatgaagatcttcatgtacctgctgaccgtgttcctgatcacccagatgatcggcagcgccctgttcgccgtgtacctgcacagaagactggacaagatcgaggacgagagaaacctgcacgaggacttcgtgttcatgaagaccatccagagatgcaacaccggcgagagaagcctgagcctgctgaactgcgaggagatcaagagccagttcgagggcttcgtgaaggacatcatgctgaacaaggaggagaccaagaaggagaacagcttcgagatgcagaagggcgaccagaacccccagatcgccgcccacgtgatcagcgaggccagcagcaagaccaccagcgtgctgcagtgggccgagaagggctactacaccatgagcaacaacctggtgaccctggagaacggcaagcagctgaccgtgaagagacagggcctgtactacatctacgcccaggtgaccttctgcagcaacagagaggccagcagccaggcccccttcatcgccagcctgtgcctgaagagccccggcagattcgagagaatcctgctgagagccgccaacacccacagcagcgccaagccctgcggccagcagagcatccacctgggcggcgtgttcgagctgcagcccggcgccagcgtgttcgtgaacgtgaccgaccccagccaggtgagccacggcaccggcttcaccagcttcggcctgctgaagctgtag

SEQ ID NO: 9946 - DNA, 612 bp, Artificial Sequence
  Description of Artificial Sequence: Synthetic coding sequence
atggtgagactgcccctgcagtgcgtgctgtggggctgcctgctgaccgccgtgcaccccgagccccccaccgcctgcagagagaagcagtacctgatcaacagccagtgctgcagcctgtgccagcccggccagaagctggtgagcgactgcaccgagttcaccgagaccgagtgcctgccctgcggcgagagcgagttcctggacacctggaacagagagacccactgccaccagcacaagtactgcgaccccaacctgggcctgagagtgcagcagaagggcaccagcgagaccgacaccatctgcacctgcgaggagggctggcactgcaccagcgaggcctgcgagagctgcgtgctgcacagaagctgcagccccggcttcggcgtgaagcagatcgccaccggcgtgagcgacaccatctgcgagccctgccccgtgggcttcttcagcaacgtgagcagcgccttcgagaagtgccacccctggaccagaagccccggcagcgccgagagccccggcggcgacccccaccacctgagagaccccgtgtgccaccccctgggcgccggcctgtaccagaagggcggccaggaggccaaccagtag

SEQ ID NO: 9947 - DNA, 786 bp, Artificial Sequence
  Description of Artificial Sequence: Synthetic coding sequence
ggcagaagccccctgagaaccagagacagagtgctgaccaactgggaggacggcctgaccgtggcctacggcgccgtgaagctgatccagagcctgagcctgcagcccgtgggctggcagcagaactggggcctgagcagcccccccaccatgctgctgcccagcagagcccagagccccaccgagctgcccctggcccccctggccgagcccaacaccggctgcagcagcctgctgagctggcacagcaccagaggcgagctgcacctgtgggccctgggcctgggccagatgggcggcagcaagtgcggcagccccctgagccccctggcccccaccctggaggccctgagaagaccctggtgcggccagcagggcgccggcggcaccagaggcatcagcaccgacccccccagcggcaagggcggcagagcctggggcagagaccccctgcccagagagggcctgctgagaggcaccgccgcccccgccgccggcggcgacctgaccccctgcctgagcagaccccccacccccagcagaaaccccagaagaagcatcttccccaccatcttcctggcccccaccctgctgctgcagtgcagaagactgtacatggacgccaacagaagccccagaagaatggccaagagagtggccagccagtgcagaagagacagcgaggccgcccccacccaggagtgcggccacgtgggcaagcaggccgtgggccagagagcctggtgctgctgctgctgcggcgtgagagtgagaggctggcactag

SEQ ID NO: 9948 - DNA, 834 bp, Artificial Sequence
  Description of Artificial Sequence: Synthetic coding sequence
atggtgagactgcccctgcagtgcgtgctgtggggctgcctgctgaccgccgtgcaccccgagccccccaccgcctgcagagagaagcagtacctgatcaacagccagtgctgcagcctgtgccagcccggccagaagctggtgagcgactgcaccgagttcaccgagaccgagtgcctgccctgcggcgagagcgagttcctggacacctggaacagagagacccactgccaccagcacaagtactgcgaccccaacctgggcctgagagtgcagcagaagggcaccagcgagaccgacaccatctgcacctgcgaggagggctggcactgcaccagcgaggcctgcgagagctgcgtgctgcacagaagctgcagccccggcttcggcgtgaagcagatcgccaccggcgtgagcgacaccatctgcgagccctgccccgtgggcttcttcagcaacgtgagcagcgccttcgagaagtgccacccctggaccagctgcgagaccaaggacctggtggtgcagcaggccggcaccaacaagaccgacgtggtgtgcggcccccaggacagactgagagccctggtggtgatccccatcatcttcggcatcctgttcgccatcctgctggtgctggtgttcatcaagaaggtggccaagaagcccaccaacaaggccccccaccccaagcaggagccccaggagatcaacttccccgacgacctgcccggcagcaacaccgccgcccccgtgcaggagaccctgcacggctgccagcccgtgacccaggaggacggcaaggagagcagaatcagcgtgcaggagagacagtag

SEQ ID NO: 9949 - DNA, 1086 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccagagaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9950 - DNA, 420 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagcctgcactgcagccagcagagcaagaaggtgtgggccgaggagaaggccagcgaccagcagtggcagtggagctgcggcggccagaaggccaagtggacccagagaagaggccagcaggtgagcggcaacggcgccttcggcgagcagggcgtggtgagaaacagcagacccgtgtacgacagctag

SEQ ID NO: 9951 - DNA, 1023 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccagacacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9952 - DNA, 1191 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaacatggacagcagccacagcatcaccctgcagcccaccgccaaccccaacaccggcctggtggaggacctggacagaaccggccccctgagcatgaccaccagaagagaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9953 - DNA, 2100 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccagcaccagcagcaacaccatcagcgccggctgggagcccaacgaggagaacgaggacgagagagacagacacctgagcttcagcggcagcggcatcgacgacgacgaggacttcatcagcagcaccatcagcaccacccccagagccttcgaccacaccaagcagaaccaggactggacccagtggaaccccagccacagcaaccccgaggtgctgctgcagaccaccaccagaatgaccgacgtggacagaaacggcaccaccgcctacgagggcaactggaaccccgaggcccacccccccctgatccaccacgagcaccacgaggaggaggagaccccccacagcaccagcaccatccaggccacccccagcagcaccaccgaggagaccgccacccagaaggagcagtggttcggcaacagatggcacgagggctacagacagacccccaaggaggacagccacagcaccaccggcaccgccgccgccagcgcccacaccagccaccccatgcagggcagaaccacccccagccccgaggacagcagctggaccgacttcttcaaccccatcagccaccccatgggcagaggccaccaggccggcagaagaatggacatggacagcagccacagcatcaccctgcagcccaccgccaaccccaacaccggcctggtggaggacctggacagaaccggccccctgagcatgaccacccagcagagcaacagccagagcttcagcaccagccacgagggcctggaggaggacaaggaccaccccaccaccagcaccctgaccagcagcaacagaaacgacgtgaccggcggcagaagagaccccaaccacagcgagggcagcaccaccctgctggagggctacaccagccactacccccacaccaaggagagcagaaccttcatccccgtgaccagcgccaagaccggcagcttcggcgtgaccgccgtgaccgtgggcgacagcaacagcaacgtgaacagaagcctgagcggcgaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9954 - DNA, 243 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagcagcacctag

SEQ ID NO: 9955 - DNA, 2229 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaccctgatgagcaccagcgccaccgccaccgagaccgccaccaagagacaggagacctgggactggttcagctggctgttcctgcccagcgagagcaagaaccacctgcacaccaccacccagatggccggcaccagcagcaacaccatcagcgccggctgggagcccaacgaggagaacgaggacgagagagacagacacctgagcttcagcggcagcggcatcgacgacgacgaggacttcatcagcagcaccatcagcaccacccccagagccttcgaccacaccaagcagaaccaggactggacccagtggaaccccagccacagcaaccccgaggtgctgctgcagaccaccaccagaatgaccgacgtggacagaaacggcaccaccgcctacgagggcaactggaaccccgaggcccacccccccctgatccaccacgagcaccacgaggaggaggagaccccccacagcaccagcaccatccaggccacccccagcagcaccaccgaggagaccgccacccagaaggagcagtggttcggcaacagatggcacgagggctacagacagacccccaaggaggacagccacagcaccaccggcaccgccgccgccagcgcccacaccagccaccccatgcagggcagaaccacccccagccccgaggacagcagctggaccgacttcttcaaccccatcagccaccccatgggcagaggccaccaggccggcagaagaatggacatggacagcagccacagcatcaccctgcagcccaccgccaaccccaacaccggcctggtggaggacctggacagaaccggccccctgagcatgaccacccagcagagcaacagccagagcttcagcaccagccacgagggcctggaggaggacaaggaccaccccaccaccagcaccctgaccagcagcaacagaaacgacgtgaccggcggcagaagagaccccaaccacagcgagggcagcaccaccctgctggagggctacaccagccactacccccacaccaaggagagcagaaccttcatccccgtgaccagcgccaagaccggcagcttcggcgtgaccgccgtgaccgtgggcgacagcaacagcaacgtgaacagaagcctgagcggcgaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9956 - DNA, 2145 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaccctgatgagcaccagcgccaccgccaccgagaccgccaccaagagacaggagacctgggactggttcagctggctgttcctgcccagcgagagcaagaaccacctgcacaccaccacccagatggccggcaccagcagcaacaccatcagcgccggctgggagcccaacgaggagaacgaggacgagagagacagacacctgagcttcagcggcagcggcatcgacgacgacgaggacttcatcagcagcaccatcagcaccacccccagagccttcgaccacaccaagcagaaccaggactggacccagtggaaccccagccacagcaaccccgaggtgctgctgcagaccaccaccagaatgaccgccgacgtggacagaaacggcaccaccgcctacgagggcaactggaaccccgaggcccacccccccctgatccaccacgagcaccacgaggaggaggagaccccccacagcaccagcaccatccaggccacccccagcagcaccaccgaggagaccgccacccagaaggagcagtggttcggcaacagatggcacgagggctacagacagacccccaaggaggacagccacagcaccaccggcaccgccgccgccagcgcccacaccagccaccccatgcagggcagaaccacccccagccccgaggacagcagctggaccgacttcttcaaccccatcagccaccccatgggcagaggccaccaggccggcagaagaatggacatggacagcagccacagcatcaccctgcagcccaccgccaaccccaacaccggcctggtggaggacctggacagaaccggccccctgagcatgaccaccagaaacagaaacgacgtgaccggcggcagaagagaccccaaccacagcgagggcagcaccaccctgctggagggctacaccagccactacccccacaccaaggagagcagaaccttcatccccgtgaccagcgccaagaccggcagcttcggcgtgaccgccgtgaccgtgggcgacagcaacagcaacgtgaacagaagcctgagcggcgaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9957 - DNA, 1482 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaacatggacagcagccacagcatcaccctgcagcccaccgccaaccccaacaccggcctggtggaggacctggacagaaccggccccctgagcatgaccacccagcagagcaacagccagagcttcagcaccagccacgagggcctggaggaggacaaggaccaccccaccaccagcaccctgaccagcagcaacagaaacgacgtgaccggcggcagaagagaccccaaccacagcgagggcagcaccaccctgctggagggctacaccagccactacccccacaccaaggagagcagaaccttcatccccgtgaccagcgccaagaccggcagcttcggcgtgaccgccgtgaccgtgggcgacagcaacagcaacgtgaacagaagcctgagcggcgaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9958 - DNA, 1290 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaacagaaacgacgtgaccggcggcagaagagaccccaaccacagcgagggcagcaccaccctgctggagggctacaccagccactacccccacaccaaggagagcagaaccttcatccccgtgaccagcgccaagaccggcagcttcggcgtgaccgccgtgaccgtgggcgacagcaacagcaacgtgaacagaagcctgagcggcgaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9959 - DNA, 2025 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaccctgatgagcaccagcgccaccgccaccgagaccgccaccaagagacaggagacctgggactggttcagctggctgttcctgcccagcgagagcaagaaccacctgcacaccaccacccagatggccggcaccagcagcaacaccatcagcgccggctgggagcccaacgaggagaacgaggacgagagagacagacacctgagcttcagcggcagcggcatcgacgacgacgaggacttcatcagcagcaccatcagcaccacccccagagccttcgaccacaccaagcagaaccaggactggacccagtggaaccccagccacagcaaccccgaggtgctgctgcagaccaccaccagaatgaccgacgtggacagaaacggcaccaccgcctacgagggcaactggaaccccgaggcccacccccccctgatccaccacgagcaccacgaggaggaggagaccccccacagcaccagcaccatccaggccacccccagcagcaccaccgaggagaccgccacccagaaggagcagtggttcggcaacagatggcacgagggctacagacagacccccaaggaggacagccacagcaccaccggcaccgccgccgccagcgcccacaccagccaccccatgcagggcagaaccacccccagccccgaggacagcagctggaccgacttcttcaaccccatcagccaccccatgggcagaggccaccaggccggcagaagaatggacatggacagcagccacagcatcaccctgcagcccaccgccaaccccaacaccggcctggtggaggacctggacagaaccggccccctgagcatgaccacccagcagagcaacagccagagcttcagcaccagccacgagggcctggaggaggacaaggaccaccccaccaccagcaccctgaccagcagcagagaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9960 - DNA, 2100 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccaccctgatgagcaccagcgccaccgccaccgagaccgccaccaagagacaggagacctgggactggttcagctggctgttcctgcccagcgagagcaagaaccacctgcacaccaccacccagatggccggcaccagcagcaacaccatcagcgccggctgggagcccaacgaggagaacgaggacgagagagacagacacctgagcttcagcggcagcggcatcgacgacgacgaggacttcatcagcagcaccatcagcaccacccccagagccttcgaccacaccaagcagaaccaggactggacccagtggaaccccagccacagcaaccccgaggtgctgctgcagaccaccaccagaatgaccgacgtggacagaaacggcaccaccgcctacgagggcaactggaaccccgaggcccacccccccctgatccaccacgagcaccacgaggaggaggagaccccccacagcaccagcaccaccgccagcgcccacaccagccaccccatgcagggcagaaccacccccagccccgaggacagcagctggaccgacttcttcaaccccatcagccaccccatgggcagaggccaccaggccggcagaagaatggacatggacagcagccacagcatcaccctgcagcccaccgccaaccccaacaccggcctggtggaggacctggacagaaccggccccctgagcatgaccacccagcagagcaacagccagagcttcagcaccagccacgagggcctggaggaggacaaggaccaccccaccaccagcaccctgaccagcagcaacagaaacgacgtgaccggcggcagaagagaccccaaccacagcgagggcagcaccaccctgctggagggctacaccagccactacccccacaccaaggagagcagaaccttcatccccgtgaccagcgccaagaccggcagcttcggcgtgaccgccgtgaccgtgggcgacagcaacagcaacgtgaacagaagcctgagcggcgaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagatgcggccagaagaagaagctggtgatcaacagcggcaacggcgccgtggaggacagaaagcccagcggcctgaacggcgaggccagcaagagccaggagatggtgcacctggtgaacaaggagagcagcgagacccccgaccagttcatgaccgccgacgagaccagaaacctgcagaacgtggacatgaagatcggcgtgtag

SEQ ID NO: 9961 - DNA, 237 bp, Artificial Sequence
  Description of Artificial Sequence: Synthetic coding sequence
atggacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatag

SEQ ID NO: 9962 - DNA, 885 bp, Artificial Sequence
  Description of Artificial Sequence: Synthetic coding sequence
tgagacaagttctggtggcacgccgcctggggcctgtgcctggtgcccctgagcctggcccagatcgacctgaacatcacctgcagattcgccggcgtgttccacgtggagaagaacggcagatacagcatcagcagaaccgaggccgccgacctgtgcaaggccttcaacagcaccctgcccaccatggcccagatggagaaggccctgagcatcggcttcgagacctgcagatacggcttcatcgagggccacgtggtgatccccagaatccaccccaacagcatctgcgccgccaacaacaccggcgtgtacatcctgaccagcaacaccagccagtacgacacctactgcttcaacgccagcgccccccccgaggaggactgcaccagcgtgaccgacctgcccaacgccttcgacggccccatcaccatcaccatcgtgaacagagacggcaccagatacgtgcagaagggcgagtacagaaccaaccccgaggacatctaccccagcaaccccaccgacgacgacgtgagcagcggcagcagcagcgagagaagcagcaccagcggcggctacatcttctacaccttcagcaccgtgcaccccatccccgacgaggacagcccctggatcaccgacagcaccgacagaatccccgccaccagagaccaggacaccttccaccccagcggcggcagccacaccacccacggcagcgagagcgacggccacagccacggcagccaggagggcggcgccaacaccaccagcggccccatcagaaccccccagatccccgagtggctgatcatcctggccagcctgctggccctggccctgatcctggccgtgtgcatcgccgtgaacagcagaagaagctag

SEQ ID NO: 9963 - DNA, 918 bp, Artificial Sequence
  Description of Artificial Sequence: Synthetic coding sequence
atgtggcccctggtggccgccctgctgctgggcagcgcctgctgcggcagcgcccagctgctgttcaacaagaccaagagcgtggagttcaccttctgcaacgacaccgtggtgatcccctgcttcgtgaccaacatggaggcccagaacaccaccgaggtgtacgtgaagtggaagttcaagggcagagacatctacaccttcgacggcgccctgaacaagagcaccgtgcccaccgacttcagcagcgccaagatcgaggtgagccagctgctgaagggcgacgccagcctgaagatggacaagagcgacgccgtgagccacaccggcaactacacctgcgaggtgaccgagctgaccagagagggcgagaccatcatcgagctgaagtacagagtggtgagctggttcagccccaacgagaacatcctgatcgtgatcttccccatcttcgccatcctgctgttctggggccagttcggcatcaagaccctgaagtacagaagcggcggcatggacgagaagaccatcgccctgctggtggccggcctggtgatcaccgtgatcgtgatcgtgggcgccatcctgttcgtgcccggcgagtacagcctgaagaacgccaccggcctgggcctgatcgtgaccagcaccggcatcctgatcctgctgcactactacgtgttcagcaccgccatcggcctgaccagcttcgtgatcgccatcctggtgatccaggtgatcgcctacatcctggccgtggtgggcctgagcctgtgcatcgccgcctgcatccccatgcacggccccctgctgatcagcggcctgagcatcctggccctggcccagctgctgggcctggtgtacatgaagttcgtggccagcaaccagaagaccatccagccccccagaaacaactag

SEQ ID NO: 9964 - DNA, 972 bp, Artificial Sequence
  Description of Artificial Sequence: Synthetic coding sequence
atgtggcccctggtggccgccctgctgctgggcagcgcctgctgcggcagcgcccagctgctgttcaacaagaccaagagcgtggagttcaccttctgcaacgacaccgtggtgatcccctgcttcgtgaccaacatggaggcccagaacaccaccgaggtgtacgtgaagtggaagttcaagggcagagacatctacaccttcgacggcgccctgaacaagagcaccgtgcccaccgacttcagcagcgccaagatcgaggtgagccagctgctgaagggcgacgccagcctgaagatggacaagagcgacgccgtgagccacaccggcaactacacctgcgaggtgaccgagctgaccagagagggcgagaccatcatcgagctgaagtacagagtggtgagctggttcagccccaacgagaacatcctgatcgtgatcttccccatcttcgccatcctgctgttctggggccagttcggcatcaagaccctgaagtacagaagcggcggcatggacgagaagaccatcgccctgctggtggccggcctggtgatcaccgtgatcgtgatcgtgggcgccatcctgttcgtgcccggcgagtacagcctgaagaacgccaccggcctgggcctgatcgtgaccagcaccggcatcctgatcctgctgcactactacgtgttcagcaccgccatcggcctgaccagcttcgtgatcgccatcctggtgatccaggtgatcgcctacatcctggccgtggtgggcctgagcctgtgcatcgccgcctgcatccccatgcacggccccctgctgatcagcggcctgagcatcctggccctggcccagctgctgggcctggtgtacatgaagttcgtggccagcaaccagaagaccatccagccccccagaaaggccgtggaggagcccctgaacgccttcaaggagagcaagggcatgatgaacgacgagtag

SEQ ID NO: 9965 - DNA, 1488 bp, Artificial Sequence
  Description of Artificial Sequence: Synthetic coding sequence
atgcccatgggcagcctgcagcccctggccaccctgtacctgctgggcatgctggtggccagctgcctgggcagactgagctggtacgaccccgacttccaggccagactgaccagaagcaacagcaagtgccagggccagctggaggtgtacctgaaggacggctggcacatggtgtgcagccagagctggggcagaagcagcaagcagtgggaggaccccagccaggccagcaaggtgtgccagagactgaactgcggcgtgcccctgagcctgggccccttcctggtgacctacaccccccagagcagcatcatctgctacggccagctgggcagcttcagcaactgcagccacagcagaaacgacatgtgccacagcctgggcctgacctgcctggagccccagaagaccaccccccccaccaccagacccccccccaccaccacccccgagcccaccgccccccccagactgcagctggtggcccagagcggcggccagcactgcgccggcgtggtggagttctacagcggcagcctgggcggcaccatcagctacgaggcccaggacaagacccaggacctggagaacttcctgtgcaacaacctgcagtgcggcagcttcctgaagcacctgcccgagaccgaggccggcagagcccaggaccccggcgagcccagagagcaccagcccctgcccatccagtggaagatccagaacagcagctgcaccagcctggagcactgcttcagaaagatcaagccccagaagagcggcagagtgctggccctgctgtgcagcggcttccagcccaaggtgcagagcagactggtgggcggcagcagcatctgcgagggcaccgtggaggtgagacagggcgcccagtgggccgccctgtgcgacagcagcagcgccagaagcagcctgagatgggaggaggtgtgcagagagcagcagtgcggcagcgtgaacagctacagagtgctggacgccggcgaccccaccagcagaggcctgttctgcccccaccagaagctgagccagtgccacgagctgtgggagagaaacagctactgcaagaaggtgttcgtgacctgccaggaccccaaccccgccggcctggccgccggcaccgtggccagcatcatcctggccctggtgctgctggtggtgctgctggtggtgtgcggccccctggcctacaagaagctggtgaagaagttcagacagaagaagcagagacagtggatcggccccaccggcatgaaccagaacatgagcttccacagaaaccacaccgccaccgtgagaagccacgccgagaaccccaccgccagccacgtggacaacgagtacagccagccccccagaaacagccacctgagcgcctaccccgccctggagggcgccctgcacagaagcagcatgcagcccgacaacagcagcgacagcgactacgacctgcacggcgcccagagactgtag

SEQ ID NO: 9966 - DNA, 582 bp, Artificial Sequence
  Description of Artificial Sequence: Synthetic coding sequence
atgcccgaggagggcagcggctgcagcgtgagaagaagaccctacggctgcgtgctgagagccgccctggtgcccctggtggccggcctggtgatctgcctggtggtgtgcatccagagattcgcccaggcccagcagcagctgcccctggagagcctgggctgggacgtggccgagctgcagctgaaccacaccggcccccagcaggaccccagactgtactggcagggcggccccgccctgggcagaagcttcctgcacggccccgagctggacaagggccagctgagaatccacagagacggcatctacatggtgcacatccaggtgaccctggccatctgcagcagcaccaccgccagcagacaccaccccaccaccctggccgtgggcatctgcagccccgccagcagaagcatcagcctgctgagactgagcttccaccagggctgcaccatcgccagccagagactgacccccctggccagaggcgacaccctgtgcaccaacctgaccggcaccctgctgcccagcagaaacaccgacgagaccttcttcggcgtgcagtgggtgagaccctag

SEQ ID NO: 9967 - DNA, 627 bp, Artificial Sequence
  Description of Artificial Sequence: Synthetic coding sequence
atgcccgaggagggcagcggctgcagcgtgagaagaagaccctacggctgcgtgctgagagccgccctggtgcccctggtggccggcctggtgatctgcctggtggtgtgcatccagagattcgcccaggcccagcagcagctgcccctggagagcctgggctgggacgtggccgagctgcagctgaaccacaccggcccccagcaggaccccagactgtactggcagggcggccccgccctgggcagaagcttcctgcacggccccgagctggacaagggccagctgagaatccacagagacggcatctacatggtgcacatccaggtgaccctggccatctgcagcagcaccaccgccagcagacaccaccccaccaccctggccgtgggcatctgcagccccgccagcagaagcatcagcctgctgagactgagcttccaccagggcctgttcggcttctggaactggggcctgaaggtgaagtgcttcctgagacacctgatctggaccgcccactgcttcatccccctgacccagctggtgttcatgcaggccctgcagagctggagaaaccaccactgcagccacttcaccgacgaggagaacagaggcgtgaacagatag

SEQ ID NO: 9968 - DNA, 1305 bp, Artificial Sequence
  Description of Artificial Sequence: Synthetic coding sequence
atgagcgccgacggcgccgaggccgacggcagcacccaggtgaccgtggaggagcccgtgcagcagcccagcgtggtggacagagtggccagcatgcccctgatcagcagcacctgcgacatggtgagcgccgcctacgccagcaccaaggagagctacccccacatcaagaccgtgtgcgacgccgccgagaagggcgtgagaaccctgaccgccgccgccgtgagcggcgcccagcccatcctgagcaagctggagccccagatcgccagcgccagcgagtacgcccacagaggcctggacaagctggaggagaacctgcccatcctgcagcagcccaccgagaaggtgctggccgacaccaaggagctggtgagcagcaaggtgagcggcgcccaggagatggtgagcagcgccaaggacaccgtggccacccagctgagcgaggccgtggacgccaccagaggcgccgtgcagagcggcgtggacaagaccaagagcgtggtgaccggcggcgtgcagagcgtgatgggcagcagactgggccagatggtgctgagcggcgtggacaccgtgctgggcaagagcgaggagtgggccgacaaccacctgcccctgaccgacgccgagctggccagaatcgccaccagcctggacggcttcgacgtggccagcgtgcagcagcagagacaggagcagagctacttcgtgagactgggcagcctgagcgagagactgagacagcacgcctacgagcacagcctgggcaagctgagagccaccaagcagagagcccaggaggccctgctgcagctgagccaggtgctgagcctgatggagaccgtgaagcagggcgtggaccagaagctggtggagggccaggagaagctgcaccagatgtggctgagctggaaccagaagcagctgcagggccccgagaaggagccccccaagcccgagcaggtggagagcagagccctgaccatgttcagagacatcgcccagcagctgcaggccacctgcaccagcctgggcagcagcatccagggcctgcccaccaacgtgaaggaccaggtgcagcaggccagaagacaggtggaggacctgcaggccaccttcagcagcatccacagcttccaggacctgagcagcagcatcctggcccagagcagagagagagtggccagcgccagagaggccctggaccacatggtggagtacgtggcccagaacacccccgtgacctggctggtgggccccttcgcccccggcatcaccgagaaggcccccgaggagaagaagtag

SEQ ID NO: 9969 - DNA, 567 bp, Artificial Sequence
  Description of Artificial Sequence: Synthetic coding sequence
atgcccggcggccccggcgtgctgcaggccctgcccgccaccatcttcctgctgttcctgctgagcgccgtgtacctgggccccggctgccaggccctgtggatgcacaaggtgcccgccagcctgatggtgagcctgggcgaggacgcccacttccagtgcccccacaacagcagcaacaacgccaacgtgacctggtggagagtgctgcacggcaactacacctggccccccgagttcctgggccccggcgaggaccccaacgagcccccccccagacccttcctggacatgggcgagggcaccaagaacagaatcatcaccgccgagggcatcatcctgctgttctgcgccgtggtgcccggcaccctgctgctgttcagaaagagatggcagaacgagaagctgggcctggacgccggcgacgagtacgaggacgagaacctgtacgagggcctgaacctggacgactgcagcatgtacgaggacatcagcagaggcctgcagggcacctaccaggacgtgggcagcctgaacatcggcgacgtgcagctggagaagccctag

SEQ ID NO: 9970 - DNA, 867 bp, Artificial Sequence
  Description of Artificial Sequence: Synthetic coding sequence
atgggccacaccagaagacagggcaccagccccagcaagtgcccctacctgaacttcttccagctgctggtgctggccggcctgagccacttctgcagcggcgtgatccacgtgaccaaggaggtgaaggaggtggccaccctgagctgcggccacaacgtgagcgtggaggagctggcccagaccagaatctactggcagaaggagaagaagatggtgctgaccatgatgagcggcgacatgaacatctggcccgagtacaagaacagaaccatcttcgacatcaccaacaacctgagcatcgtgatcctggccctgagacccagcgacgagggcacctacgagtgcgtggtgctgaagtacgagaaggacgccttcaagagagagcacctggccgaggtgaccctgagcgtgaaggccgacttccccacccccagcatcagcgacttcgagatccccaccagcaacatcagaagaatcatctgcagcaccagcggcggcttccccgagccccacctgagctggctggagaacggcgaggagctgaacgccatcaacaccaccgtgagccaggaccccgagaccgagctgtacgccgtgagcagcaagctggacttcaacatgaccaccaaccacagcttcatgtgcctgatcaagtacggccacctgagagtgaaccagaccttcaactggaacaccaccaagcaggagcacttccccgacaacctgctgcccagctgggccatcaccctgatcagcgtgaacggcatcttcgtgatctgctgcctgacctactgcttcgcccccagatgcagagagagaagaagaaacgagagactgagaagagagagcgtgagacccgtgtag

SEQ ID NO: 9971 - DNA, 489 bp, Artificial Sequence
  Description of Artificial Sequence: Synthetic coding sequence
atgggccacaccagaagacagggcaccagccccagcaagtgcccctacctgaacttcttccagctgctggtgctggccggcctgagccacttctgcagcggcgtgatccacgtgaccaaggaggtgaaggaggtggccaccctgagctgcggccacaacgtgagcgtggaggagctggcccagaccagaatctactggcagaaggagaagaagatggtgctgaccatgatgagcggcgacatgaacatctggcccgagtacaagaacagaaccatcttcgacatcaccaacaacctgagcatcgtgatcctggccctgagacccagcgacgagggcacctacgagtgcgtggtgctgaagtacgagaaggacgccttcaagagagagcacctggccgaggtgaccctgagcgtgaagggcttcgcccccagatgcagagagagaagaagaaacgagagactgagaagagagagcgtgagacccgtgtag

SEQ ID NO: 9972 - DNA, 771 bp, Artificial Sequence
  Description of Artificial Sequence: Synthetic coding sequence
atgggccacaccagaagacagggcaccagccccagcaagtgcccctacctgaacttcttccagctgctggtgctggccggcctgagccacttctgcagcggcgtgatccacgtgaccaaggaggtgaaggaggtggccaccctgagctgcggccacaacgtgagcgtggaggagctggcccagaccagaatctactggcagaaggagaagaagatggtgctgaccatgatgagcggcgacatgaacatctggcccgagtacaagaacagaaccatcttcgacatcaccaacaacctgagcatcgtgatcctggccctgagacccagcgacgagggcacctacgagtgcgtggtgctgaagtacgagaaggacgccttcaagagagagcacctggccgaggtgaccctgagcgtgaaggccgacttccccacccccagcatcagcgacttcgagatccccaccagcaacatcagaagaatcatctgcagcaccagcggcggcttccccgagccccacctgagctggctggagaacggcgaggagctgaacgccatcaacaccaccgtgagccaggaccccgagaccgagctgtacgccgtgagcagcaagctggacttcaacatgaccaccaaccacagcttcatgtgcctgatcaagtacggccacctgagagtgaaccagaccttcaactggaacaccagcttcgcccccagatgcagagagagaagaagaaacgagagactgagaagagagagcgtgagacccgtgtag

SEQ ID NO: 9973 - DNA, 867 bp, Artificial Sequence; identical to SEQ ID NO: 9970
  Description of Artificial Sequence: Synthetic coding sequence

SEQ ID NO: 9974 - DNA, 456 bp, Artificial Sequence
  Description of Artificial Sequence: Synthetic coding sequence
atgagcatccccttcagcaacacccactacagaatcccccagggcttcggcaacctgctggagggcctgaccagagagatcctgagagagcagcccgacaacatccccgccttcgccgccgcctacttcgagagcctgctggagaagagagagaagaccaacttcgaccccgccgagtggggcagcaaggtggaggacagattctacaacaaccacgccttcgaggagcaggagccccccgagaagagcgaccccaagcaggaggagagccagatcagcggcaaggaggaggagaccagcgtgaccatcctggacagcagcgaggaggacaaggagaaggaggaggtggccgccgtgaagatccaggccgccttcagaggccacatcgccagagaggaggccaagaagatgaagaccaacagcctgcagaacgaggagaaggaggagaacaagtag

SEQ ID NO: 9975 - DNA, 729 bp, Artificial Sequence
  Description of Artificial Sequence: Synthetic coding sequence
atgggcagcgcctgcatcaaggtgaccaagtacttcctgttcctgttcaacctgatcttcttcatcctgggcgccgtgatcctgggcttcggcgtgtggatcctggccgacaagagcagcttcatcagcgtgctgcagaccagcagcagcagcctgagaatgggcgcctacgtgttcatcggcgtgggcgccgtgaccatgctgatgggcttcctgggctgcatcggcgccgtgaacgaggtgagatgcctgctgggcctgctgaagcaggagatgggcggcatcgtgaccgagctgatcagagactacaacagcagcagagaggacagcctgcaggacgcctgggactacgtgcaggcccaggtgaagtgctgcggctgggtgagcttctacaactggaccgacaacgccgagctgatgaacagacccgaggtgacctacccctgcagctgcgaggtgaagggcgaggaggacaacagcctgagcgtgagaaagggcttctgcgaggcccccggcaacagaacccagagcggcaaccaccccgaggactggcccgtgtaccaggagggctgcatggagaaggtgcaggcctggctgcaggagaacctgggcatcatcctgggcgtgggcgtgggcgtggccatcatcgagctgctgggcatggtgctgagcatctgcctgtgcagacacgtgcacagcgaggactacagcaaggtgcccaagtactag

SEQ ID NO: 9976 - DNA, 207 bp, Artificial Sequence
  Description of Artificial Sequence: Synthetic coding sequence
atgggcagcgcctgcatcaaggtgaccaagtacttcctgttcctgttcaacctgatcttcttcatcctgggcgccgtgatcctgggcttcggcgtgtggatcctggccgacaagagcagcttcatcagcgtgctgcagaccagcagcagcagcctgagaatgggcgcctacgtgttcatcggcgtgggcgccgtgaccatgctgtag

SEQ ID NO: 9977 - DNA, 117 bp, Artificial Sequence
  Description of Artificial Sequence: Synthetic coding sequence
atgggcagcgcctgcatcaaggtgaccaagtacttcctgttcctgttcaacctgatcttcttcatcctgggcgccgtgatcctgggcttcggcgtgtggatcctggccgacaagtag

SEQ ID NO: 9978 - DNA, 318 bp, Artificial Sequence
  Description of Artificial Sequence: Synthetic coding sequence
atgggcagcgcctgcatcaaggtgaccaagtacttcctgttcctgttcaacctgatcttcttcatcctgggcgccgtgatcctgggcttcggcgtgtggatcctggccgacaagagcagcttcatcagcgtgctgcagaccagcagcagcagcctgagaatgggcgcctacgtgttcatcggcgtgggcgccgtgaccatgctgatgggcttcctgggctgcatcggcgccgtgaacgaggtgagatgcctgctgggcctgtacttcgccttcctgctgctgatcctgatcgcccaggtgaccgccggcgccctgtag

SEQ ID NO: 9979 - DNA, 327 bp, Artificial Sequence
  Description of Artificial Sequence: Synthetic coding sequence
atgggcagcgcctgcatcaaggtgaccaagtacttcctgttcctgttcaacctgatcttcttcatcctgggcgccgtgatcctgggcttcggcgtgtggatcctggccgacaagagcagcttcatcagcgtgctgcagaccagcagcagcagcctgagaatgggcgcctacgtgttcatcggcgtgggcgccgtgaccatgctgatgggcttcctgggctgcatcggcgccgtgaacgaggtgagatgcctgctgggcctgtacttcgccttcctgctgctgatcctgatcgcccaggtgaccgccggcgccctgttctacttctag

SEQ ID NO: 9980 - DNA, 708 bp, Artificial Sequence
  Description of Artificial Sequence: Synthetic coding sequence
atggccctgcccgtgaccgccctgctgctgcccctggccctgctgctgcacgccgccagacccagccagttcagagtgagccccctggacagaacctggaacctgggcgagaccgtggagctgaagtgccaggtgctgctgagcaaccccaccagcggctgcagctggctgttccagcccagaggcgccgccgccagccccaccttcctgctgtacctgagccagaacaagcccaaggccgccgagggcctggacacccagagattcagcggcaagagactgggcgacaccttcgtgctgaccctgagcgacttcagaagagagaacgagggctactacttctgcagcgccctgagcaacagcatcatgtacttcagccacttcgtgcccgtgttcctgcccgccaagcccaccaccacccccgcccccagaccccccacccccgcccccaccatcgccagccagcccctgagcctgagacccgaggcctgcagacccgccgccggcggcgccgtgcacaccagaggcctggacttcgcctgcgacatctacatctgggcccccctggccggcacctgcggcgtgctgctgctgagcctggtgatcaccctgtactgcaaccacagaaacagaagaagagtgtgcaagtgccccagacccgtggtgaagagcggcgacaagcccagcctgagcgccagatacgtgtag

SEQ ID NO: 9981 - DNA, 597 bp, Artificial Sequence
  Description of Artificial Sequence: Synthetic coding sequence
atggccctgcccgtgaccgccctgctgctgcccctggccctgctgctgcacgccgccagacccagccagttcagagtgagccccctggacagaacctggaacctgggcgagaccgtggagctgaagtgccaggtgctgctgagcaaccccaccagcggctgcagctggctgttccagcccagaggcgccgccgccagccccaccttcctgctgtacctgagccagaacaagcccaaggccgccgagggcctggacacccagagattcagcggcaagagactgggcgacaccttcgtgctgaccctgagcgacttcagaagagagaacgagggctactacttctgcagcgccctgagcaacagcatcatgtacttcagccacttcgtgcccgtgttcctgcccgccaagcccaccaccacccccgcccccagaccccccacccccgcccccaccatcgccagccagcccctgagcctgagacccgaggcctgcagacccgccgccggcggcgccggcaacagaagaagagtgtgcaagtgccccagacccgtggtgaagagcggcgacaagcccagcctgagcgccagatacgtgtag

SEQ ID NO: 9982 - DNA, 708 bp, Artificial Sequence; identical to SEQ ID NO: 9980
  Description of Artificial Sequence: Synthetic coding sequence

SEQ ID NO: 9983 - DNA, 597 bp, Artificial Sequence
  Description of Artificial Sequence: Synthetic coding sequence
atggccctgcccgtgaccgccctgctgctgcccctggccctgctgctgcacgccgccagacccagccagttcagagtgagccccctggacagaacctggaacctgggcgagaccgtggagctgaagtgccaggtgctgctgagcaaccccaccagcggctgcagctggctgttccagcccagaggcgccgccgccagccccaccttcctgctgtacctgagccagaacaagcccaaggccgccgagggcctggacacccagagattcagcggcaagagactgggcgacaccttcgtgctgaccctgagcgacttcagaagagagaacgagggctactacttctgcagcgccctgagcaacagcatcatgtacttcagccacttcgtgcccgtgttcctgcccgtgcacaccagaggcctggacttcgcctgcgacatctacatctgggcccccctggccggcacctgcggcgtgctgctgctgagcctggtgatcaccctgtactgcaaccacagaaacagaagaagagtgtgcaagtgccccagacccgtggtgaagagcggcgacaagcccagcctgagcgccagatacgtgtag

SEQ ID NO: 9984 - DNA, 663 bp, Artificial Sequence
  Description of Artificial Sequence: Synthetic coding sequence
atggccctgcccgtgaccgccctgctgctgcccctggccctgctgctgcacgccgccagacccagccagttcagagtgagccccctggacagaacctggaacctgggcgagaccgtggagctgaagtgccaggtgctgctgagcaaccccaccagcggctgcagctggctgttccagcccagaggcgccgccgccagccccaccttcctgctgtacctgagccagaacaagcccaaggccgccgagggcctggacaccctgagcgacttcagaagagagaacgagggctactacttctgcagcgccctgagcaacagcatcatgtacttcagccacttcgtgcccgtgttcctgcccgccaagcccaccaccacccccgcccccagaccccccacccccgcccccaccatcgccagccagcccctgagcctgagacccgaggcctgcagacccgccgccggcggcgccgtgcacaccagaggcctggacttcgcctgcgacatctacatctgggcccccctggccggcacctgcggcgtgctgctgctgagcctggtgatcaccctgtactgcaaccacagaaacagaagaagagtgtgcaagtgccccagacccgtggtgaagagcggcgacaagcccagcctgagcgccagatacgtgtag

SEQ ID NO: 9985 - DNA, 597 bp, Artificial Sequence; identical to SEQ ID NO: 9981
  Description of Artificial Sequence: Synthetic coding sequence

SEQ ID NO: 9986 - DNA, 831 bp, Artificial Sequence
  Description of Artificial Sequence: Synthetic coding sequence
atgagaaaccaggcccccggcagacccaagggcgccaccttcccccccagaagacccaccggcagcagagccccccccctggcccccgagctgagagccaagcagagacccggcgagagagtgatggccctgcccgtgaccgccctgctgctgcccctggccctgctgctgcacgccgccagacccagccagttcagagtgagccccctggacagaacctggaacctgggcgagaccgtggagctgaagtgccaggtgctgctgagcaaccccaccagcggctgcagctggctgttccagcccagaggcgccgccgccagccccaccttcctgctgtacctgagccagaacaagcccaaggccgccgagggcctggacacccagagattcagcggcaagagactgggcgacaccttcgtgctgaccctgagcgacttcagaagagagaacgagggctactacttctgcagcgccctgagcaacagcatcatgtacttcagccacttcgtgcccgtgttcctgcccgccaagcccaccaccacccccgcccccagaccccccacccccgcccccaccatcgccagccagcccctgagcctgagacccgaggcctgcagacccgccgccggcggcgccgtgcacaccagaggcctggacttcgcctgcgacatctacatctgggcccccctggccggcacctgcggcgtgctgctgctgagcctggtgatcaccctgtactgcaaccacagaaacagaagaagagtgtgcaagtgccccagacccgtggtgaagagcggcgacaagcccagcctgagcgccagatacgtgtag

SEQ ID NO: 9987 - DNA, 240 bp, Artificial Sequence
  Description of Artificial Sequence: Synthetic coding sequence
atgagccacaagcagatctactacagcgacaagtacgacgacgaggagttcgagtacagacacgtgatgctgcccaaggacatcgccaagctggtgcccaagacccacctgatgagcgagagcgagtggagaaacctgggcgtgcagcagagccagggctgggtgcactacatgatccacgagcccgagccccacatcctgctgttcagaagacccctgcccaagaagcccaagaagtag

SEQ ID NO: 9988 - DNA, 204 bp, Artificial Sequence
  Description of Artificial Sequence: Synthetic coding sequence
atgagccacaagcagatctactacagcgacaagtacgacgacgaggagttcgagtacagacacgtgatgctgcccaaggacatcgccaagctggtgcccaagacccacctgatgagcgagagcgagtggagaaacctgggcgtgcagcagagccagggctgggtgcactacatgatccacgagcccggccagtgcaccggctag

SEQ ID NO: 9989 - DNA, 192 bp, Artificial Sequence
  Description of Artificial Sequence: Synthetic coding sequence
atgagaaccagacacgtgatgctgcccaaggacatcgccaagctggtgcccaagacccacctgatgagcgagagcgagtggagaaacctgggcgtgcagcagagccagggctgggtgcactacatgatccacgagcccgagccccacatcctgctgttcagaagacccctgcccaagaagcccaagaagtag

SEQ ID NO: 9990 - DNA, 240 bp, Artificial Sequence
  Description of Artificial Sequence: Synthetic coding sequence
atggcccacaagcagatctactacagcgacaagtacttcgacgagcactacgagtacagacacgtgatgctgcccagagagctgagcaagcaggtgcccaagacccacctgatgagcgaggaggagtggagaagactgggcgtgcagcagagcctgggctgggtgcactacatgatccacgagcccgagccccacatcctgctgttcagaagacccctgcccaaggaccagcagaagtag

SEQ ID NO: 9991 - DNA, 1533 bp, Artificial Sequence
  Description of Artificial Sequence: Synthetic coding sequence
atgcaccccctgcagtgcgtgctgcaggtgcagagaagcctgggctggggccccctggccagcgtgagctggctgagcctgagaatgtgcagagcccacagcagcctgagcagcaccatgtgccccagccccgagagacaggaggacggcgccagaaaggacttcagcagcagactggccgccggccccaccttccagcacttcctgaagagcgccagcgccccccaggagaagctgagcagcgaggtggaggacccccccccctacctgatgatggacgagctgctgggcagacagagaaaggtgtacctggagacctacggctgccagatgaacgtgaacgacaccgagatcgcctggagcatcctgcagaagagcggctacctgagaaccagcaacctgcaggaggccgacgtgatcctgctggtgacctgcagcatcagagagaaggccgagcagaccatctggaacagactgcaccagctgaaggccctgaagaccagaagacccagaagcagagtgcccctgagaatcggcatcctgggctgcatggccgagagactgaaggaggagatcctgaacagagagaagatggtggacatcctggccggccccgacgcctacagagacctgcccagactgctggccgtggccgagagcggccagcaggccgccaacgtgctgctgagcctggacgagacctacgccgacgtgatgcccgtgcagaccagcgccagcgccaccagcgccttcgtgagcatcatgagaggctgcgacaacatgtgcagctactgcatcgtgcccttcaccagaggcagagagagaagcagacccatcgccagcatcctggaggaggtgaagaagctgagcgagcaggtgctgcagctgatccacgagagagacaacatctgcaagcagatccacctgcccgcccagagcggcagcagcagagtgctggaggccatgagaagaggctacagcagagaggcctacgtggagctggtgcaccacatcagagagagcatccccggcgtgagcctgagcagcgacttcatcgccggcttctgcggcgagaccgaggaggaccacgtgcagaccgtgagcctgctgagagaggtgcagtacaacatgggcttcctgttcgcctacagcatgagacagaagaccagagcctaccacagactgaaggacgacgtgcccgaggaggtgaagctgagaagactggaggagctgatcaccatcttcagagaggaggccaccaaggccaaccagaccagcgtgggctgcacccagctggtgctggtggagggcctgagcaagagaagcgccaccgacctgtgcggcagaaacgacggcaacctgaaggtgatcttccccgacgccgagatggaggacgtgaacaaccccggcctgagagtgagagcccagcccggcgactacgtgctggtgaagatcaccagcgccagcagccagaccctgagaggccacgtgctgtgcagaaccaccctgagagacagcagcgcctactgctag

SEQ ID NO: 9992 - DNA, 1764 bp, Artificial Sequence
  Description of Artificial Sequence: Synthetic coding sequence
atgcaccccctgcagtgcgtgctgcaggtgcagagaagcctgggctggggccccctggccagcgtgagctggctgagcctgagaatgtgcagagcccacagcagcctgagcagcaccatgtgccccagccccgagagacaggaggacggcgccagaaaggacttcagcagcagactggccgccggccccaccttccagcacttcctgaagagcgccagcgccccccaggagaagctgagcagcgaggtggaggacccccccccctacctgatgatggacgagctgctgggcagacagagaaaggtgtacctggagacctacggctgccagatgaacgtgaacgacaccgagatcgcctggagcatcctgcagaagagcggctacctgagaaccagcaacctgcaggaggccgacgtgatcctgctggtgacctgcagcatcagagagaaggccgagcagaccatctggaacagactgcaccagctgaaggccctgaagaccagaagacccagaagcagagtgcccctgagaatcggcatcctgggctgcatggccgagagactgaaggaggagatcctgaacagagagaagatggtggacatcctggccggccccgacgcctacagagacctgcccagactgctggccgtggccgagagcggccagcaggccgccaacgtgctgctgagcctggacgagacctacgccgacgtgatgcccgtgcagaccagcgccagcgccaccagcgccttcgtgagcatcatgagaggctgcgacaacatgtgcagctactgcatcgtgcccttcaccagaggcagagagagaagcagacccatcgccagcatcctggaggaggtgaagaagctgagcgagcagggcctgaaggaggtgaccctgctgggccagaacgtgaacagcttcagagacaacagcgaggtgcagttcaacagcgccgtgcccaccaacctgagcagaggcttcaccaccaactacaagaccaagcagggcggcctgagattcgcccacctgctggaccaggtgagcagagtggaccccgagatgagaatcagattcaccagcccccaccccaaggacttccccgacgaggtgctgcagctgatccacgagagagacaacatctgcaagcagatccacctgcccgcccagagcggcagcagcagagtgctggaggccatgagaagaggctacagcagagaggcctacgtggagctggtgcaccacatcagagagagcatccccggcgtgagcctgagcagcgacttcatcgccggcttctgcggcgagaccgaggaggaccacgtgcagaccgtgagcctgctgagagaggtgcagtacaacatgggcttcctgttcgcctacagcatgagacagaagaccagagcctaccacagactgaaggacgacgtgcccgaggaggtgaagctgagaagactggaggagctgatcaccatcttcagagaggaggccaccaaggccaaccagaccagcgtgggctgcacccagctggtgctggtggagggcctgagcaagagaagcgccaccgacctgtgcggcagaaacgacggcaacctgaaggtgatcttccccgacgccgagatggaggacgtgaacaaccccggcctgagagtgagagcccagcccggcgactacgtgctggtgaagatcaccagcgccagcagccagaccctgagaggccacgtgctgtgcagaaccaccctgagagacagcagcgcctactgctag

SEQ ID NO: 9993 - DNA, 1806 bp, Artificial Sequence
  Description of Artificial Sequence: Synthetic coding sequence
atgcaccccctgcagtgcgtgctgcaggtgcagagaagcctgggctggggccccctggccagcgtgagctggctgagcctgagaatgtgcagagcccacagcagcctgagcagcaccatgtgccccagccccgagagacaggaggacggcgccagaaaggacttcagcagcagactggccgccggccccaccttccagcacttcctgaagagcgccagcgccccccaggagaagctgagcagcgaggtggaggacccccccccctacctgatgatggacgagctgctgggcagacagagaaaggtgtacctggagacctacggctgccagatgaacgtgaacgacaccgagatcgcctggagcatcctgcagaagagcggctacctgagaaccagcaacctgcaggaggccgacgtgatcctgctggtgacctgcagcatcagagagaaggccgagcagaccatctggaacagactgcaccagctgaaggccctgaagaccagaagacccagaagcagagtgcccctgagaatcggcatcctgggctgcatggccgagagactgaaggaggagatcctgaacagagagaagatggtggacatcctggccggccccgacgcctacagagacctgcccagactgctggccgtggccgagagcggccagcaggccgccaacgtgctgctgagcctggacgagacctacgccgacgtgatgcccgtgcagaccagcgccagcgccaccagcgccttcgtgagcatcatgagaggctgcgacaacatgtgcagctactgcatcgtgcccttcaccagaggcagagagagaagcagacccatcgccagcatcctggaggaggtgaagaagctgagcgagcaggtgttcctgccccccagaccccccaaggtgctgggcctgcagggcctgaaggaggtgaccctgctgggccagaacgtgaacagcttcagagacaacagcgaggtgcagttcaacagcgccgtgcccaccaacctgagcagaggcttcaccaccaactacaagaccaagcagggcggcctgagattcgcccacctgctggaccaggtgagcagagtggaccccgagatgagaatcagattcaccagcccccaccccaaggacttccccgacgaggtgctgcagctgatccacgagagagacaacatctgcaagcagatccacctgcccgcccagagcggcagcagcagagtgctggaggccatgagaagaggctacagcagagaggcctacgtggagctggtgcaccacatcagagagagcatccccggcgtgagcctgagcagcgacttcatcgccggcttctgcggcgagaccgaggaggaccacgtgcagaccgtgagcctgctgagagaggtgcagtacaacatgggcttcctgttcgcctacagcatgagacagaagaccagagcctaccacagactgaaggacgacgtgcccgaggaggtgaagctgagaagactggaggagctgatcaccatcttcagagaggaggccaccaaggccaaccagaccagcgtgggctgcacccagctggtgctggtggagggcctgagcaagagaagcgccaccgacctgtgcggcagaaacgacggcaacctgaaggtgatcttccccgacgccgagatggaggacgtgaacaaccccggcctgagagtgagagcccagcccggcgactacgtgctggtgaagatcaccagcgccagcagccagaccctgagaggccacgtgctgtgcagaaccaccctgagagacagcagcgcctactgctag

SEQ ID NO: 9994 - DNA, 984 bp, Artificial Sequence
  Description of Artificial Sequence: Synthetic coding sequence
atgaacgtgaacgacaccgagatcgcctggagcatcctgcagaagagcggctacctgagaaccagcaacctgcaggaggccgacgtgatcctgctggtgacctgcagcatcagagagaaggccgagcagaccatctggaacagactgcaccagctgaaggccctgaagaccagaagacccagaagcagagtgcccctgagaatcggcatcctgggctgcatggccgagagactgaaggaggagatcctgaacagagagaagatggtggacatcctggccggccccgacgcctacagagacctgcccagactgctggccgtggccgagagcggccagcaggccgccaacgtgctgctgagcctggacgagacctacgccgacgtgatgcccgtgcagaccagcgccagcgccaccagcgccttcgtgtacagcagagaggcctacgtggagctggtgcaccacatcagagagagcatccccggcgtgagcctgagcagcgacttcatcgccggcttctgcggcgagaccgaggaggaccacgtgcagaccgtgagcctgctgagagaggtgcagtacaacatgggcttcctgttcgcctacagcatgagacagaagaccagagcctaccacagactgaaggacgacgtgcccgaggaggtgaagctgagaagactggaggagctgatcaccatcttcagagaggaggccaccaaggccaaccagaccagcgtgggctgcacccagctggtgctggtggagggcctgagcaagagaagcgccaccgacctgtgcggcagaaacgacggcaacctgaaggtgatcttccccgacgccgagatggaggacgtgaacaaccccggcctgagagtgagagcccagcccggcgactacgtgctggtgaagatcaccagcgccagcagccagaccctgagaggccacgtgctgtgcagaaccaccctgagagacagcagcgcctactgctag

SEQ ID NO: 9995 - DNA, 1494 bp, Artificial Sequence
  Description of Artificial Sequence: Synthetic coding sequence
atgatggacgagctgctgggcagacagagaaaggtgtacctggagacctacggctgccagatgaacgtgaacgacaccgagatcgcctggagcatcctgcagaagagcggctacctgagaaccagcaacctgcaggaggccgacgtgatcctgctggtgacctgcagcatcagagagaaggccgagcagaccatctggaacagactgcaccagctgaaggccctgaagaccagaagacccagaagcagagtgcccctgagaatcggcatcctgggctgcatggccgagagactgaaggaggagatcctgaacagagagaagatggtggacatcctggccggccccgacgcctacagagacctgcccagactgctggccgtggccgagagcggccagcaggccgccaacgtgctgctgagcctggacgagacctacgccgacgtgatgcccgtgcagaccagcgccagcgccaccagcgccttcgtgagcatcatgagaggctgcgacaacatgtgcagctactgcatcgtgcccttcaccagaggcagagagagaagcagacccatcgccagcatcctggaggaggtgaagaagctgagcgagcagggcctgaaggaggtgaccctgctgggccagaacgtgaacagcttcagagacaacagcgaggtgcagttcaacagcgccgtgcccaccaacctgagcagaggcttcaccaccaactacaagaccaagcagggcggcctgagattcgcccacctgctggaccaggtgagcagagtggaccccgagatgagaatcagattcaccagcccccaccccaaggacttccccgacgaggtgctgcagctgatccacgagagagacaacatctgcaagcagatccacctgcccgcccagagcggcagcagcagagtgctggaggccatgagaagaggctacagcagagaggcctacgtggagctggtgcaccacatcagagagagcatccccggcgtgagcctgagcagcgacttcatcgccggcttctgcggcgagaccgaggaggaccacgtgcagaccgtgagcctgctgagagaggtgcagtacaacatgggcttcctgttcgcctacagcatgagacagaagaccagagcctaccacagactgaaggacgacgtgcccgaggaggtgaagctgagaagactggaggagctgatcaccatcttcagagaggaggccaccaaggccaaccagaccagcgtgggctgcacccagctggtgctggtggagggcctgagcaagagaagcgccaccgacctgtgcggcagaaacgacggcaacctgaaggtgatcttccccgacgccgagatggaggacgtgaacaaccccggcctgagagtgagagcccagcccggcgactacgtgctggtgaagatcaccagcgccagcagccagaccctgagaggccacgtgctgtgcagaaccaccctgagagacagcagcgcctactgctag

SEQ ID NO: 9996 - DNA, 1281 bp, Artificial Sequence
  Description of Artificial Sequence: Synthetic coding sequence
atgcaccccctgcagtgcgtgctgcaggtgcagagaagcctgggctggggccccctggccagcgtgagctggctgagcctgagaatgtgcagagcccacagcagcctgagcagcaccatgtgccccagccccgagagacaggaggacggcgccagaaaggacttcagcagcagactggccgccggccccaccttccagcacttcctgaagagcgccagcgccccccaggagaagctgagcagcgaggtggaggacccccccccctacctgatgatggacgagctgctgggcagacagagaaaggtgtacctggagacctacggctgccagatgaacgtgaacgacaccgagatcgcctggagcatcctgcagaagagcggctacctgagaaccagcaacctgcaggaggccgacgtgatcctgctggtgacctgcagcatcagagagaaggccgagcagaccatctggaacagactgcaccagctgaaggccctgaagaccagaagacccagaagcagagtgcccctgagaatcggcatcctgggctgcatggccgagagactgaaggaggagatcctgaacagagagaagatggtggacatcctggccggccccgacgcctacagagacctgcccagactgctggccgtggccgagagcggccagcaggccgccaacgtgctgctgagcctggacgagacctacgccgacgtgatgcccgtgcagaccagcgccagcgccaccagcgccttcgtgagcatcatgagaggctgcgacaacatgtgcagctactgcatcgtgcccttcaccagaggcagagagagaagcagacccatcgccagcatcctggaggaggtgaagaagctgagcgagcagggcctgaaggaggtgaccctgctgggccagaacgtgaacagcttcagagacaacagcgaggtgcagttcaacagcgccgtgcccaccaacctgagcagaggcttcaccaccaactacaagaccaagcagggcggcctgagattcgcccacctgctggaccaggtgagcagagtggaccccgagatgagaatcagattcaccagcccccaccccaaggacttccccgacgaggtgctgcagctgatccacgagagagacaacatctgcaagcagatccacctgcccgcccagagcggcagcagcagagtgctggaggccatgagaagaggctacagcagagaggcctacgtggagctggtgcaccacatcagagagagcatccccgaggacaccggcatcagctag

SEQ ID NO: 9997 - DNA, 1122 bp, Artificial Sequence
  Description of Artificial Sequence: Synthetic coding sequence
ggcgacggccagaacctgttcaccaaggacgtgaccgtgatcgagggcgaggtggccaccatcagctgccaggtgaacaagagcgacgacagcgtgatccagctgctgaaccccaacagacagaccatctacttcagagacttcagacccctgaaggacagcagattccagctgctgaacttcagcagcagcgagctgaaggtgagcctgaccaacgtgagcatcagcgacgagggcagatacttctgccagctgtacaccgaccccccccaggagagctacaccaccatcaccgtgctggtgccccccagaaacctgatgatcgacatccagaaggacaccgccgtggagggcgaggagatcgaggtgaactgcaccgccatggccagcaagcccgccaccaccatcagatggttcaagggcaacaccgagctgaagggcaagagcgaggtggaggagtggagcgacatgtacaccgtgaccagccagctgatgctgaaggtgcacaaggaggacgacggcgtgcccgtgatctgccaggtggagcaccccgccgtgaccggcaacctgcagacccagagatacctggaggtgcagtacaagccccaggtgcacatccagatgacctaccccctgcagggcctgaccagagagggcgacgccctggagctgacctgcgaggccatcggcaagccccagcccgtgatggtgacctgggtgagagtggacgacgagatgccccagcacgccgtgctgagcggccccaacctgttcatcaacaacctgaacaagaccgacaacggcacctacagatgcgaggccagcaacatcgtgggcaaggcccacagcgactacatgctgtacgtgtacgacagcagagccggcgaggagggcagcatcagagccgtggaccacgccgtgatcggcggcgtggtggccgtggtggtgttcgccatgctgtgcctgctgatcatcctgggcagatacttcgccagacacaagggcacctacttcacccacgaggccaagggcgccgacgacgccgccgacgccgacaccgccatcatcaacgccgagggcggccagaacaacagcgaggagaagaaggagtacttcatctag

SEQ ID NO: 9998 - DNA, 1329 bp, Artificial Sequence
  Description of Artificial Sequence: Synthetic coding sequence
atggccagcgtggtgctgcccagcggcagccagtgcgccgccgccgccgccgccgccgccccccccggcctgagactgagactgctgctgctgctgttcagcgccgccgccctgatccccaccggcgacggccagaacctgttcaccaaggacgtgaccgtgatcgagggcgaggtggccaccatcagctgccaggtgaacaagagcgacgacagcgtgatccagctgctgaaccccaacagacagaccatctacttcagagacttcagacccctgaaggacagcagattccagctgctgaacttcagcagcagcgagctgaaggtgagcctgaccaacgtgagcatcagcgacgagggcagatacttctgccagctgtacaccgaccccccccaggagagctacaccaccatcaccgtgctggtgccccccagaaacctgatgatcgacatccagaaggacaccgccgtggagggcgaggagatcgaggtgaactgcaccgccatggccagcaagcccgccaccaccatcagatggttcaagggcaacaccgagctgaagggcaagagcgaggtggaggagtggagcgacatgtacaccgtgaccagccagctgatgctgaaggtgcacaaggaggacgacggcgtgcccgtgatctgccaggtggagcaccccgccgtgaccggcaacctgcagacccagagatacctggaggtgcagtacaagccccaggtgcacatccagatgacctaccccctgcagggcctgaccagagagggcgacgccctggagctgacctgcgaggccatcggcaagccccagcccgtgatggtgacctgggtgagagtggacgacgagatgccccagcacgccgtgctgagcggccccaacctgttcatcaacaacctgaacaagaccgacaacggcacctacagatgcgaggccagcaacatcgtgggcaaggcccacagcgactacatgctgtacgtgtacgacccccccaccaccatccccccccccaccaccaccaccaccaccaccaccaccaccaccaccaccatcctgaccatcatcaccgacagcagagccggcgaggagggcagcatcagagccgtggaccacgccgtgatcggcggcgtggtggccgtggtggtgttcgccatgctgtgcctgctgatcatcctgggcagatacttcgccagacacaagggcacctacttcacccacgaggccaagggcgccgacgacgccgccgacgccgacaccgccatcatcaacgccgagggcggccagaacaacagcgaggagaagaaggagtacttcatctag

SEQ ID NO: 9999 - DNA, 384 bp, Artificial Sequence
  Description of Artificial Sequence: Synthetic coding sequence
atgctgtacgtgtacgacccccccaccaccatccccccccccaccaccaccaccaccaccaccaccaccaccaccaccaccatcctgaccatcatcaccgacaccaccgccaccaccgagcccgccgtgcacgacagcagagccggcgaggagggcagcatcagagccgtggaccacgccgtgatcggcggcgtggtggccgtggtggtgttcgccatgctgtgcctgctgatcatcctgggcagatacttcgccagacacaagggcacctacttcacccacgaggccaagggcgccgacgacgccgccgacgccgacaccgccatcatcaacgccgagggcggccagaacaacagcgaggagaagaaggagtacttcatctag

SEQ ID NO: 10000 - DNA, 1245 bp, Artificial Sequence
  Description of Artificial Sequence: Synthetic coding sequence
atggccagcgtggtgctgcccagcggcagccagtgcgccgccgccgccgccgccgccgccccccccggcctgagactgagactgctgctgctgctgttcagcgccgccgccctgatccccaccggcgacggccagaacctgttcaccaaggacgtgaccgtgatcgagggcgaggtggccaccatcagctgccaggtgaacaagagcgacgacagcgtgatccagctgctgaaccccaacagacagaccatctacttcagagacttcagacccctgaaggacagcagattccagctgctgaacttcagcagcagcgagctgaaggtgagcctgaccaacgtgagcatcagcgacgagggcagatacttctgccagctgtacaccgaccccccccaggagagctacaccaccatcaccgtgctggtgccccccagaaacctgatgatcgacatccagaaggacaccgccgtggagggcgaggagatcgaggtgaactgcaccgccatggccagcaagcccgccaccaccatcagatggttcaagggcaacaccgagctgaagggcaagagcgaggtggaggagtggagcgacatgtacaccgtgaccagccagctgatgctgaaggtgcacaaggaggacgacggcgtgcccgtgatctgccaggtggagcaccccgccgtgaccggcaacctgcagacccagagatacctggaggtgcagtacaagccccaggtgcacatccagatgacctaccccctgcagggcctgaccagagagggcgacgccctggagctgacctgcgaggccatcggcaagccccagcccgtgatggtgacctgggtgagagtggacgacgagatgccccagcacgccgtgctgagcggccccaacctgttcatcaacaacctgaacaagaccgacaacggcacctacagatgcgaggccagcaacatcgtgggcaaggcccacagcgactacatgctgtacgtgtacgacagcagagccggcgaggagggcagcatcagagccgtggaccacgccgtgatcggcggcgtggtggccgtggtggtgttcgccatgctgtgcctgctgatcatcctgggcagatacttcgccagacacaagggcacctacttcacccacgaggccaagggcgccgacgacgccgccgacgccgacaccgccatcatcaacgccgagggcggccagaacaacagcgaggagaagaaggagtacttcatctag

SEQ ID NO: 10001 - DNA, 5346 bp, Artificial Sequence
  Description of Artificial Sequence: Synthetic coding sequence
atgaccacctacagagccatccccagcgacggcgtggacctggccgccagctgcggcgccagagtgggcgacgtgctgcccggcccccacaccggcgactacgcccccctgggcttctgggcccagaacggcagcatgagccagcccctgggcgagagccccgccaccgccaccgccaccgccaccgccaccaccagacccagccccaccacccccgccatgcccaagatgggcgtgagagccagagtggccgactggccccccaagagagaggccctgagagagcacagcaaccccagccccagccaggacaccgacggcaccaaggccaccaagatggcccacagcatgagaagcatccagaacggccagccccccaccagcacccccgccagcagcggcagcaaggccttccacagactgagcagaagaagaagcaaggacgtggagttccaggacggctggcccagaagccccggcagagccttcctgcccctgagacacagaagcagcagcgagatcaccctgagcgagtgcgacgccgaggacgccggcgagcccagaggcgccagacacaccggcgccctgcccctgttcagagagtacggcagcaccagcagcatcgacgtgcagggcatgcccgagcagagcttcttcgacatcctgaacgagttcagaagcgagcagcccgacgccagaggctgccaggccctgaccgagctgctgagagccgaccccggcccccacctgatgggcggcggcggcggcgccaagggcgacagccacaacggccagcccgccaaggacagcctgctgcccctgcagcccaccaaggagaaggagaaggccagaaagaagcccgccagaggcctgggcggcggcgacaccgtggacagcagcatcttcagaaagctgagaagcagcaagcccgagggcgaggccggcagaagccccggcgaggccgacgagggcagaagcccccccgaggccagcagaccctgggtgtgccagaagagcttcgcccacttcgacgtgcagagcatgctgttcgacctgaacgaggccgccgccaacagagtgagcgtgagccagagaagaaacaccaccaccggcgccagcgccgccagcgccgccagcgccatggccagcctgaccgccagcagagcccacagcctgggcggcctggaccccgccttcaccagcaccgaggacctgaactgcaaggagaacctggagcaggacctgggcgacgacaacagcaacgacctgctgctgagctgcccccacttcagaaacgagatcggcggcgagtgcgagagaaacgtgagcttcagcagagccagcgtgggcagccccagcagcggcgagggccacctggccgagcccgccctgagcgcctacagaaccaacgccagcatcagcgtgctggaggtgcccaaggagcagcagagaacccagagcagacccagacagtacagcatcgagcacgtggacctgggcgccagatactaccaggactacttcgtgggcaaggagcacgccaactacttcggcgtggacgagaagctgggccccgtggccgtgagcatcaagagagagaagctggaggaccacaaggagcacggcccccagtaccagtacagaatcatcttcagaaccagagagctgatcaccctgagaggcagcatcctggaggacgccacccccaccgccaccaagcacggcaccggcagaggcctgcccctgaaggacgccctggagtacgtgatccccgagctgaacatccactgcctgagactggccctgaacacccccaaggtgaccgagcagctgctgaagctggacgagcagggcctgtgcagaaagcacaaggtgggcatcctgtactgcaaggccggccagagcagcgaggaggagatgtacaacaacgaggaggccggccccgccttcgaggagttcctgagcctgatcggcgagaaggtgtgcctgaagggcttcaccaagtacgccgcccagctggacgtgaagaccgacagcaccggcacccacagcctgtacaccatgtaccaggactacgagatcatgttccacgtgagcaccctgctgccctacacccccaacaacagacagcagctgctgagaaagagacacatcggcaacgacatcgtgaccatcatcttccaggagcccggcgccctgcccttcacccccaagaacatcagaagccacttccagcacgtgttcatcatcgtgagagtgcacaacccctgcaccgacaacgtgtgctacagcatggccgtgaccagaagcaaggacgccccccccttcggcccccccatccccagcggcaccaccttcagaaagagcgacgtgttcagagacttcctgctggccaaggtgatcaacgccgagaacgccgcccacaagagcgacaagttccacaccatggccaccagaaccagacaggagtacctgaaggacctggccgagaactgcgtgagcaacacccccatcgacagcaccggcaagttcaacctgatcagcctgaccagcaagaagaaggagaagaccaaggccagagccggcgccgagcagcacagcgccggcgccatcgcctggagagtggtggcccaggactacgcccagggcgtggagatcgactgcatcctgggcatcagcaacgagttcgtggtgctgctggacctgagaaccaaggaggtggtgttcaactgctactgcggcgacgtgatcggctggacccccgacagcagcaccctgaagatcttctacggcagaggcgaccacatcttcctgcaggccaccgagggcagcgtggaggacatcagagagatcgtgcagagactgaaggtgatgaccagcggctgggagaccgtggacatgaccctgagaagaaacggcctgggccagctgggcttccacgtgaagtacgacggcaccgtggccgaggtggaggactacggcttcgcctggcaggccggcctgagacagggcagcagactggtggagatctgcaaggtggccgtggtgaccctgacccacgaccagatgatcgacctgctgagaaccagcgtgaccgtgaaggtggtgatcatcccccccttcgaggacggcacccccagaagaggctggcccgagacctacgacatgaacaccagcgagcccaagaccgagcaggagagcatcacccccggcggcagacccccctacagaagcaacgccccctggcagtggagcggccccgccagccacaacagcctgcccgccagcaagtgggccacccccaccacccccggccacgcccagagcctgagcagacccctgaagcagacccccatcgtgcccttcagagagagccagcccctgcacagcaagagacccgtgagcttccccgagaccccctacaccgtgagccccgccggcgccgacagagtgcccccctacagacagcccagcggcagcttcagcacccccggcagcgccacctacgtgagatacaagcccagccccgagagatacaccgccgccccccaccccctgctgagcctggacccccacttcagccacgacggcaccagcagcggcgacagcagcagcggcggcctgaccagccaggagagcaccatggagagacagaagcccgagcccctgtggcacgtgcccgcccaggccagactgagcgccatcgccggcagcagcggcaacaagcaccccagcagacaggacgccgccggcaaggacagccccaacagacacagcaagggcgagccccagtacagcagccacagcagcagcaacaccctgagcagcaacgccagcagcagccacagcgacgacagatggttcgaccccctggaccccctggagcccgagcaggaccccctgagcaagggcggcagcagcgacagcggcatcgacaccaccctgtacaccagcagccccagctgcatgagcctggccaaggcccccagacccgccaagccccacaagccccccggcagcatgggcctgtgcggcggcggcagagaggccgccggcagaagccaccacgccgacagaagaagagaggtgagccccgcccccgccgtggccggccagagcaagggctacagacccaagctgtacagcagcggcagcagcacccccaccggcctggccggcggcagcagagacccccccagacagcccagcgacatgggcagcagagtgggctaccccgcccaggtgtacaagaccgccagcgccgagacccccagacccagccagctggcccagcccagccccttccagctgagcgccagcgtgcccaagagcttcttcagcaagcagcccgtgagaaacaagcaccccaccggctggaagagaaccgaggagcccccccccagacccctgcccttcagcgaccccaagaagcaggtggacaccaacaccaagaacgtgttcggccagcccagactgagagccagcctgagagacctgagaagccccagaaagaactacaagagcaccatcgaggacgacctgaagaagctgatcatcatggacaacctgggccccgagcaggagagagacaccggccagagcccccagaagggcctgcagagaaccctgagcgacgagagcctgtgcagcggcagaagagagcccagcttcgccagccccgccggcctggagcccggcctgcccagcgacgtgctgttcaccagcacctgcgccttccccagcagcaccctgcccgccagaagacagcaccagcacccccacccccccgtgggccccggcgccacccccgccgccggcagcggcttccccgagaagaagagcaccatcagcgccagcgagctgagcctggccgacggcagagacagacccctgagaagactggaccccggcctgatgcccctgcccgacaccgccgccggcctggagtggagcagcctggtgaacgccgccaaggcctacgaggtgcagagagccgtgagcctgttcagcctgaacgaccccgccctgagccccgacatcccccccgcccacagccccgtgcacagccacctgagcctggagagaggcccccccacccccagaaccacccccaccatgagcgaggagccccccctggacctgaccggcaaggtgtaccagctggaggtgatgctgaagcagctgcacaccgacctgcagaaggagaagcaggacaaggtggtgctgcagagcgaggtggccagcctgagacagaacaaccagagactgcaggaggagagccaggccgccagcgagcagctgagaaagttcgccgagatcttctgcagagagaagaaggagctgtag

SEQ ID NO: 10002 - DNA, 660 bp, Artificial Sequence
  Description of Artificial Sequence: Synthetic coding sequence
atggaggccgccagagactacgccggcgccctgatcagacccctgaccttcatgggcagccagaccaagagagtgctgttcacccccctgatgcaccccgccagacccttcagagtgagcaaccacgacagaagcagcagaagaggcgtgatggccagcagcctgcaggagctgatcagcaagaccctggacgccctggtgatcgccaccggcctggtgaccctggtgctggaggaggacggcaccgtggtggacaccgaggagttcttccagaccctgggcgacaacacccacttcatgatcctggagaagggccagaagtggatgcccggcagccagcacgtgcccacctgcagcccccccaagagaagcggcatcgccagagtgaccttcgacctgtacagactgaaccccaaggacttcatcggctgcctgaacgtgaaggccaccatgtacgagatgtacagcgtgagctacgacatcagatgcaccggcctgaagggcctgctgagaagcctgctgagattcctgagctacagcgcccaggtgaccggccagttcctgatctacctgggcacctacatgctgagagtgctggacgacaaggaggagagacccagcctgagaagccaggccaagggcagattcacctgcggctag

SEQ ID NO: 10003 - DNA, 660 bp, Artificial Sequence
  Description of Artificial Sequence: Synthetic coding sequence
atggagtacctgagcgccctgaaccccagcgacctgctgagaagcgtgagcaacatcagcagcgagttcggcagaagagtgtggaccagcgccccccccccccagagacccttcagagtgtgcgaccacaagagaaccatcagaaagggcctgaccgccgccaccagacaggagctgctggccaaggccctggagaccctgctgctgaacggcgtgctgaccctggtgctggaggaggacggcaccgccgtggacagcgaggacttcttccagctgctggaggacgacacctgcctgatggtgctgcagagcggccagagctggagccccaccagaagcggcgtgctgagctacggcctgggcagagagagacccaagcacagcaaggacatcgccagattcaccttcgacgtgtacaagcagaaccccagagacctgttcggcagcctgaacgtgaaggccaccttctacggcctgtacagcatgagctgcgacttccagggcctgggccccaagaaggtgctgagagagctgctgagatggaccagcaccctgctgcagggcctgggccacatgctgctgggcatcagcagcaccctgagacacgccgtggagggcgccgagcagtggcagcagaagggcagactgcacagctactag

SEQ ID NO: 10004 - DNA, 660 bp, Artificial Sequence; identical to SEQ ID NO: 10003
  Description of Artificial Sequence: Synthetic coding sequence

SEQ ID NO: 10005 - DNA, 660 bp, Artificial Sequence; identical to SEQ ID NO: 10003
  Description of Artificial Sequence: Synthetic coding sequence

SEQ ID NO: 10006 - DNA, 660 bp, Artificial Sequence; identical to SEQ ID NO: 10003
  Description of Artificial Sequence: Synthetic coding sequence

SEQ ID NO: 10007 - DNA, 1860 bp, Artificial Sequence
  Description of Artificial Sequence: Synthetic coding sequence
atgaacctggagagactgagaaagagagtgagacagtacctggaccagcagcagtaccagagcgccctgttctgggccgacaaggtggccagcctgagcagagagccccaggacatctactggctggcccagtgcctgtacctgaccgcccagtaccacagagccgcccacgccctgagaagcagaaagctggacaagctgtacgaggcctgcagatacctggccgccagatgccactacgccgccaaggagcaccagcaggccctggacgtgctggacatggaggagcccatcaacaagagactgttcgagaagtacctgaaggacgagagcggcttcaaggaccccagcagcgactgggagatgagccagagcagcatcaagagcagcatctgcctgctgagaggcaagatctacgacgccctggacaacagaaccctggccacctacagctacaaggaggccctgaagctggacgtgtactgcttcgaggccttcgacctgctgaccagccaccacatgctgaccgcccaggaggagaaggagctgctggagagcctgcccctgagcaagctgtgcaacgaggagcaggagctgctgagattcctgttcgagaacaagctgaagaagtacaacaagcccagcgagaccgtgatccccgagagcgtggacggcctgcaggagaacctggacgtggtggtgagcctggccgagagacactactacaactgcgacttcaagatgtgctacaagctgaccagcgtggtgatggagaaggaccccttccacgccagctgcctgcccgtgcacatcggcaccctggtggagctgaacaaggccaacgagctgttctacctgagccacaagctggtggacctgtaccccagcaaccccgtgagctggttcgccgtgggctgctactacctgatggtgggccacaagaacgagcacgccagaagatacctgagcaaggccaccaccctggagaagacctacggccccgcctggatcgcctacggccacagcttcgccgtggagagcgagcacgaccaggccatggccgcctacttcaccgccgcccagctgatgaagggctgccacctgcccatgctgtacatcggcctggagtacggcctgaccaacaacagcaagctggccgagagattcttcagccaggccctgagcatcgcccccgaggaccccttcgtgatgcacgaggtgggcgtggtggccttccagaacggcgagtggaagaccgccgagaagtggttcctggacgccctggagaagatcaaggccatcggcaacgaggtgaccgtggacaagtgggagcccctgctgaacaacctgggccacgtgtgcagaaagctgaagaagtacgccgaggccctggactaccacagacaggccctggtgctgatcccccagaacgccagcacctacagcgccatcggctacatccacagcctgatgggcaacttcgagaacgccgtggactacttccacaccgccctgggcctgagaagagacgacaccttcagcgtgaccatgctgggccactgcatcgagatgtacatcggcgacagcgaggcctacatcggcgccgacatcaaggacaagctgaagtgctacgacttcgacgtgcacaccatgaagaccctgaagaacatcatcagccccccctgggacttcagagagttcgaggtggagaagcagaccgccgaggagaccggcctgacccccctggagaccagcagaaagacccccgacagcagacccagcctggaggagaccttcgagatcgagatgaacgagagcgacatgatgctggagaccagcatgagcgaccacagcacctag

SEQ ID NO: 10008 - DNA, 1428 bp, Artificial Sequence
  Description of Artificial Sequence: Synthetic coding sequence
atggaggagcccatcaacaagagactgttcgagaagtacctgaaggacgagagcggcttcaaggaccccagcagcgactgggagatgagccagagcagcatcaagagcagcatctgcctgctgagaggcaagatctacgacgccctggacaacagaaccctggccacctacagctacaaggaggccctgaagctggacgtgtactgcttcgaggccttcgacctgctgaccagccaccacatgctgaccgcccaggaggagaaggagctgctggagagcctgcccctgagcaagctgtgcaacgaggagcaggagctgctgagattcctgttcgagaacaagctgaagaagtacaacaagcccagcgagaccgtgatccccgagagcgtggacggcctgcaggagaacctggacgtggtggtgagcctggccgagagacactactacaactgcgacttcaagatgtgctacaagctgaccagcgtggtgatggagaaggaccccttccacgccagctgcctgcccgtgcacatcggcaccctggtggagctgaacaaggccaacgagctgttctacctgagccacaagctggtggacctgtaccccagcaaccccgtgagctggttcgccgtgggctgctactacctgatggtgggccacaagaacgagcacgccagaagatacctgagcaaggccaccaccctggagaagacctacggccccgcctggatcgcctacggccacagcttcgccgtggagagcgagcacgaccaggccatggccgcctacttcaccgccgcccagctgatgaagggctggaagaccgccgagaagtggttcctggacgccctggagaagatcaaggccatcggcaacgaggtgaccgtggacaagtgggagcccctgctgaacaacctgggccacgtgtgcagaaagctgaagaagtacgccgaggccctggactaccacagacaggccctggtgctgatcccccagaacgccagcacctacagcgccatcggctacatccacagcctgatgggcaacttcgagaacgccgtggactacttccacaccgccctgggcctgagaagagacgacaccttcagcgtgaccatgctgggccactgcatcgagatgtacatcggcgacagcgaggcctacatcggcgccgacatcaaggacaagctgaagtgctacgacttcgacgtgcacaccatgaagaccctgaagaacatcatcagccccccctgggacttcagagagttcgaggtggagaagcagaccgccgaggagaccggcctgacccccctggagaccagcagaaagacccccgacagcagacccagcctggaggagaccttcgagatcgagatgaacgagagcgacatgatgctggagaccagcatgagcgaccacagcacctag

SEQ ID NO: 10009 - DNA, 1863 bp, Artificial Sequence
  Description of Artificial Sequence: Synthetic coding sequence
atgaacctggagagactgagaaagagagtgagacagtacctggaccagcagcagtaccagagcgccctgttctgggccgacaaggtggccagcctgagcagagaggagccccaggacatctactggctggcccagtgcctgtacctgaccgcccagtaccacagagccgcccacgccctgagaagcagaaagctggacaagctgtacgaggcctgcagatacctggccgccagatgccactacgccgccaaggagcaccagcaggccctggacgtgctggacatggaggagcccatcaacaagagactgttcgagaagtacctgaaggacgagagcggcttcaaggaccccagcagcgactgggagatgagccagagcagcatcaagagcagcatctgcctgctgagaggcaagatctacgacgccctggacaacagaaccctggccacctacagctacaaggaggccctgaagctggacgtgtactgcttcgaggccttcgacctgctgaccagccaccacatgctgaccgcccaggaggagaaggagctgctggagagcctgcccctgagcaagctgtgcaacgaggagcaggagctgctgagattcctgttcgagaacaagctgaagaagtacaacaagcccagcgagaccgtgatccccgagagcgtggacggcctgcaggagaacctggacgtggtggtgagcctggccgagagacactactacaactgcgacttcaagatgtgctacaagctgaccagcgtggtgatggagaaggaccccttccacgccagctgcctgcccgtgcacatcggcaccctggtggagctgaacaaggccaacgagctgttctacctgagccacaagctggtggacctgtaccccagcaaccccgtgagctggttcgccgtgggctgctactacctgatggtgggccacaagaacgagcacgccagaagatacctgagcaaggccaccaccctggagaagacctacggccccgcctggatcgcctacggccacagcttcgccgtggagagcgagcacgaccaggccatggccgcctacttcaccgccgcccagctgatgaagggctgccacctgcccatgctgtacatcggcctggagtacggcctgaccaacaacagcaagctggccgagagattcttcagccaggccctgagcatcgcccccgaggaccccttcgtgatgcacgaggtgggcgtggtggccttccagaacggcgagtggaagaccgccgagaagtggttcctggacgccctggagaagatcaaggccatcggcaacgaggtgaccgtggacaagtgggagcccctgctgaacaacctgggccacgtgtgcagaaagctgaagaagtacgccgaggccctggactaccacagacaggccctggtgctgatcccccagaacgccagcacctacagcgccatcggctacatccacagcctgatgggcaacttcgagaacgccgtggactacttccacaccgccctgggcctgagaagagacgacaccttcagcgtgaccatgctgggccactgcatcgagatgtacatcggcgacagcgaggcctacatcggcgccgacatcaaggacaagctgaagtgctacgacttcgacgtgcacaccatgaagaccctgaagaacatcatcagccccccctgggacttcagagagttcgaggtggagaagcagaccgccgaggagaccggcctgacccccctggagaccagcagaaagacccccgacagcagacccagcctggaggagaccttcgagatcgagatgaacgagagcgacatgatgctggagaccagcatgagcgaccacagcacctag

SEQ ID NO: 10010 - DNA, 1863 bp, Artificial Sequence; identical to SEQ ID NO: 10009
  Description of Artificial Sequence: Synthetic coding sequence

SEQ ID NO: 10011 - DNA, 1581 bp, Artificial Sequence
  Description of Artificial Sequence: Synthetic coding sequence
atggaggagcccatcaacaagagactgttcgagaagtacctgaaggacgagagcggcttcaaggaccccagcagcgactgggagatgagccagagcagcatcaagagcagcatctgcctgctgagaggcaagatctacgacgccctggacaacagaaccctggccacctacagctacaaggaggccctgaagctggacgtgtactgcttcgaggccttcgacctgctgaccagccaccacatgctgaccgcccaggaggagaaggagctgctggagagcctgcccctgagcaagctgtgcaacgaggagcaggagctgctgagattcctgttcgagaacaagctgaagaagtacaacaagcccagcgagaccgtgatccccgagagcgtggacggcctgcaggagaacctggacgtggtggtgagcctggccgagagacactactacaactgcgacttcaagatgtgctacaagctgaccagcgtggtgatggagaaggaccccttccacgccagctgcctgcccgtgcacatcggcaccctggtggagctgaacaaggccaacgagctgttctacctgagccacaagctggtggacctgtaccccagcaaccccgtgagctggttcgccgtgggctgctactacctgatggtgggccacaagaacgagcacgccagaagatacctgagcaaggccaccaccctggagaagacctacggccccgcctggatcgcctacggccacagcttcgccgtggagagcgagcacgaccaggccatggccgcctacttcaccgccgcccagctgatgaagggctgccacctgcccatgctgtacatcggcctggagtacggcctgaccaacaacagcaagctggccgagagattcttcagccaggccctgagcatcgcccccgaggaccccttcgtgatgcacgaggtgggcgtggtggccttccagaacggcgagtggaagaccgccgagaagtggttcctggacgccctggagaagatcaaggccatcggcaacgaggtgaccgtggacaagtgggagcccctgctgaacaacctgggccacgtgtgcagaaagctgaagaagtacgccgaggccctggactaccacagacaggccctggtgctgatcccccagaacgccagcacctacagcgccatcggctacatccacagcctgatgggcaacttcgagaacgccgtggactacttccacaccgccctgggcctgagaagagacgacaccttcagcgtgaccatgctgggccactgcatcgagatgtacatcggcgacagcgaggcctacatcggcgccgacatcaaggacaagctgaagtgctacgacttcgacgtgcacaccatgaagaccctgaagaacatcatcagccccccctgggacttcagagagttcgaggtggagaagcagaccgccgaggagaccggcctgacccccctggagaccagcagaaagacccccgacagcagacccagcctggaggagaccttcgagatcgagatgaacgagagcgacatgatgctggagaccagcatgagcgaccacagcacctag

SEQ ID NO: 10012 - DNA, 1581 bp, Artificial Sequence; identical to SEQ ID NO: 10011
  Description of Artificial Sequence: Synthetic coding sequence

SEQ ID NO: 10013 - DNA, 1428 bp, Artificial Sequence; identical to SEQ ID NO: 10008
  Description of Artificial Sequence: Synthetic coding sequence

SEQ ID NO: 10014 - DNA, 1500 bp, Artificial Sequence
  Description of Artificial Sequence: Synthetic coding sequence
atggcccagttcgccttcgagagcgacctgcacagcctgctgcagctggacgcccccatccccaacgccccccccgccagatggcagagaaaggccaaggaggccgccggccccgcccccagccccatgagagccgccaacagaagccacagcgccggcagaacccccggcagaacccccggcaagagcagcagcaaggtgcagaccacccccagcaagcccggcggcgacagatacatcccccacagaagcgccgcccagatggaggtggccagcttcctgctgagcaaggagaaccagcccgagaacagccagacccccaccaagaaggagcaccagaaggcctgggccctgaacctgaacggcttcgacgtggaggaggccaagatcctgagactgagcggcaagccccagaacgcccccgagggctaccagaacagactgaaggtgctgtacagccagaaggccacccccggcagcagcagaaagacctgcagatacatccccagcctgcccgacagaatcctggacgcccccgagatcagaaacgactactacctgaacctggtggactggagcagcggcaacgtgctggccgtggccctggacaacagcgtgtacctgtggagcgccagcagcggcgacatcctgcagctgctgcagatggagcagcccggcgagtacatcagcagcgtggcctggatcaaggagggcaactacctggccgtgggcaccagcagcgccgaggtgcagctgtgggacgtgcagcagcagaagagactgagaaacatgaccagccacagcgccagagtgggcagcctgagctggaacagctacatcctgagcagcggcagcagaagcggccacatccaccaccacgacgtgagagtggccgagcaccacgtggccaccctgagcggccacagccaggaggtgtgcggcctgagatgggcccccgacggcagacacctggccagcggcggcaacgacaacctggtgaacgtgtggcccagcgcccccggcgagggcggctgggtgcccctgcagaccttcacccagcaccagggcgccgtgaaggccgtggcctggtgcccctggcagagcaacgtgctggccaccggcggcggcaccagcgacagacacatcagaatctggaacgtgtgcagcggcgcctgcctgagcgccgtggacgcccacagccaggtgtgcagcatcctgtggagcccccactacaaggagctgatcagcggccacggcttcgcccagaaccagctggtgatctggaagtaccccaccatggccaaggtggccgagctgaagggccacaccagcagagtgctgagcctgaccatgagccccgacggcgccaccgtggccagcgccgccgccgacgagaccctgagactgtggagatgcttcgagctggaccccgccagaagaagagagagagagaaggccagcgccgccaagagcagcctgatccaccagggcatcagatag

SEQ ID NO: 10015 - DNA, 1500 bp, Artificial Sequence; identical to SEQ ID NO: 10014
  Description of Artificial Sequence: Synthetic coding sequence

SEQ ID NO: 10016 - DNA, 1428 bp, Artificial Sequence
  Description of Artificial Sequence: Synthetic coding sequence
atggcccagttcgccttcgagagcgacctgcacagcctgctgcagctggacgcccccatccccaacgccccccccgccagatggcagagaaaggccaaggaggccgccggccccgcccccagccccatgagagccgccaacagaagccacagcgccggcagaacccccggcagaacccccggcaagagcagcagcaaggtgcagaccacccccagcaaggagaaccagcccgagaacagccagacccccaccaagaaggagcaccagaaggcctgggccctgaacctgaacggcttcgacgtggaggaggccaagatcctgagactgagcggcaagccccagaacgcccccgagggctaccagaacagactgaaggtgctgtacagccagaaggccacccccggcagcagcagaaagacctgcagatacatccccagcctgcccgacagaatcctggacgcccccgagatcagaaacgactactacctgaacctggtggactggagcagcggcaacgtgctggccgtggccctggacaacagcgtgtacctgtggagcgccagcagcggcgacatcctgcagctgctgcagatggagcagcccggcgagtacatcagcagcgtggcctggatcaaggagggcaactacctggccgtgggcaccagcagcgccgaggtgcagctgtgggacgtgcagcagcagaagagactgagaaacatgaccagccacagcgccagagtgggcagcctgagctggaacagctacatcctgagcagcggcagcagaagcggccacatccaccaccacgacgtgagagtggccgagcaccacgtggccaccctgagcggccacagccaggaggtgtgcggcctgagatgggcccccgacggcagacacctggccagcggcggcaacgacaacctggtgaacgtgtggcccagcgcccccggcgagggcggctgggtgcccctgcagaccttcacccagcaccagggcgccgtgaaggccgtggcctggtgcccctggcagagcaacgtgctggccaccggcggcggcaccagcgacagacacatcagaatctggaacgtgtgcagcggcgcctgcctgagcgccgtggacgcccacagccaggtgtgcagcatcctgtggagcccccactacaaggagctgatcagcggccacggcttcgcccagaaccagctggtgatctggaagtaccccaccatggccaaggtggccgagctgaagggccacaccagcagagtgctgagcctgaccatgagccccgacggcgccaccgtggccagcgccgccgccgacgagaccctgagactgtggagatgcttcgagctggaccccgccagaagaagagagagagagaaggccagcgccgccaagagcagcctgatccaccagggcatcagatag

SEQ ID NO: 10017 - DNA, 1422 bp, Artificial Sequence
  Description of Artificial Sequence: Synthetic coding sequence
atgagcaccgagctgttcagcagcaccagagaggagggcagcagcggcagcggccccagcttcagaagcaaccagagaaagatgctgaacctgctgctggagagagacaccagcttcaccgtgtgccccgacgtgcccagaacccccgtgggcaagttcctgggcgacagcgccaacctgagcatcctgagcggcggcacccccaagagatgcctggacctgagcaacctgagcagcggcgagatcaccgccacccagctgaccaccagcgccgacctggacgagaccggccacctggacagcagcggcctgcaggaggtgcacctggccggcatgaaccacgaccagcacctgatgaagtgcagccccgcccagctgctgtgcagcacccccaacggcctggacagaggccacagaaagagagacgccatgtgcagcagcagcgccaacaaggagaacgacaacggcaacctggtggacagcgagatgaagtacctgggcagccccatcaccaccgtgcccaagctggacaagaaccccaacctgggcgaggaccaggccgaggagatcagcgacgagctgatggagttcagcctgaaggaccaggaggccaaggtgagcagaagcggcctgtacagaagccccagcatgcccgagaacctgaacagacccagactgaagcaggtggagaagttcaaggacaacaccatccccgacaaggtgaagaagaagtacttcagcggccagggcaagctgagaaagggcctgtgcctgaagaagaccgtgagcctgtgcgacatcaccatcacccagatgctggaggaggacagcaaccagggccacctgatcggcgacttcagcaaggtgtgcgccctgcccaccgtgagcggcaagcaccaggacctgaagtacgtgaaccccgagaccgtggccgccctgctgagcggcaagttccagggcctgatcgagaagttctacgtgatcgactgcagatacccctacgagtacctgggcggccacatccagggcgccctgaacctgtacagccaggaggagctgttcaacttcttcctgaagaagcccatcgtgcccctggacacccagaagagaatcatcatcgtgttccactgcgagttcagcagcgagagaggccccagaatgtgcagatgcctgagagaggaggacagaagcctgaaccagtaccccgccctgtactaccccgagctgtacatcctgaagggcggctacagagacttcttccccgagtacatggagctgtgcgagccccagagctactgccccatgcaccaccaggaccacaagaccgagctgctgagatgcagaagccagagcaaggtgcaggagggcgagagacagctgagagagcagatcgccctgctggtgaaggacatgagcccctag

SEQ ID NO: 10018 - DNA, 1203 bp, Artificial Sequence
  Description of Artificial Sequence: Synthetic coding sequence
atgagcaccgagctgttcagcagcaccagagaggagggcagcagcggcagcggccccagcttcagaagcaaccagagaaagatgctgaacctgctgctggagagagacaccagcttcaccgtgtgccccgacgtgcccagaacccccgtgggcaagttcctgggcgacagcgccaacctgagcatcctgagcggcagccccggcttcttcagaaccagcggcagcgccttcagctgggacgacaacggcaacctggtggacagcgagatgaagtacctgggcagccccatcaccaccgtgcccaagctggacaagaaccccaacctgggcgaggaccaggccgaggagatcagcgacgagctgatggagttcagcctgaaggaccaggaggccaaggtgagcagaagcggcctgtacagaagccccagcatgcccgagaacctgaacagacccagactgaagcaggtggagaagttcaaggacaacaccatccccgacaaggtgaagaagaagtacttcagcggccagggcaagctgagaaagggcctgtgcctgaagaagaccgtgagcctgtgcgacatcaccatcacccagatgctggaggaggacagcaaccagggccacctgatcggcgacttcagcaaggtgtgcgccctgcccaccgtgagcggcaagcaccaggacctgaagtacgtgaaccccgagaccgtggccgccctgctgagcggcaagttccagggcctgatcgagaagttctacgtgatcgactgcagatacccctacgagtacctgggcggccacatccagggcgccctgaacctgtacagccaggaggagctgttcaacttcttcctgaagaagcccatcgtgcccctggacacccagaagagaatcatcatcgtgttccactgcgagttcagcagcgagagaggccccagaatgtgcagatgcctgagagaggaggacagaagcctgaaccagtaccccgccctgtactaccccgagctgtacatcctgaagggcggctacagagacttcttccccgagtacatggagctgtgcgagccccagagctactgccccatgcaccaccaggaccacaagaccgagctgctgagatgcagaagccagagcaaggtgcaggagggcgagagacagctgagagagcagatcgccctgctggtgaaggacatgagcccctag

SEQ ID NO: 10019 - DNA, 1332 bp, Artificial Sequence
  Description of Artificial Sequence: Synthetic coding sequence
atgagcaccgagctgttcagcagcaccagagaggagggcagcagcggcagcggccccagcttcagaagcaaccagagaaagatgctgaacctgctgctggagagagacaccagcttcaccgtgtgccccgacgtgcccagaacccccgtgggcaagttcctgggcgacagcgccaacctgagcatcctgagcggcggcacccccaagagatgcctggacctgagcaacctgagcagcggcgagatcaccgccacccagctgaccaccagcgccgacctggacgagaccggccacctggacagcagcggcctgcaggaggtgcacctggccggcatgaaccacgaccagcacctgatgaagtgcagccccgacaacggcaacctggtggacagcgagatgaagtacctgggcagccccatcaccaccgtgcccaagctggacaagaaccccaacctgggcgaggaccaggccgaggagatcagcgacgagctgatggagttcagcctgaaggaccaggaggccaaggtgagcagaagcggcctgtacagaagccccagcatgcccgagaacctgaacagacccagactgaagcaggtggagaagttcaaggacaacaccatccccgacaaggtgaagaagaagtacttcagcggccagggcaagctgagaaagggcctgtgcctgaagaagaccgtgagcctgtgcgacatcaccatcacccagatgctggaggaggacagcaaccagggccacctgatcggcgacttcagcaaggtgtgcgccctgcccaccgtgagcggcaagcaccaggacctgaagtacgtgaaccccgagaccgtggccgccctgctgagcggcaagttccagggcctgatcgagaagttctacgtgatcgactgcagatacccctacgagtacctgggcggccacatccagggcgccctgaacctgtacagccaggaggagctgttcaacttcttcctgaagaagcccatcgtgcccctggacacccagaagagaatcatcatcgtgttccactgcgagttcagcagcgagagaggccccagaatgtgcagatgcctgagagaggaggacagaagcctgaaccagtaccccgccctgtactaccccgagctgtacatcctgaagggcggctacagagacttcttccccgagtacatggagctgtgcgagccccagagctactgccccatgcaccaccaggaccacaagaccgagctgctgagatgcagaagccagagcaaggtgcaggagggcgagagacagctgagagagcagatcgccctgctggtgaaggacatgagcccctag

SEQ ID NO: 10020 - DNA, 1293 bp, Artificial Sequence
  Description of Artificial Sequence: Synthetic coding sequence
atgagcaccgagctgttcagcagcaccagagaggagggcagcagcggcagcggccccagcttcagaagcaaccagagaaagatgctgaacctgctgctggagagagacaccagcttcaccgtgtgccccgacgtgcccagaacccccgtgggcaagttcctgggcgacagcgccaacctgagcatcctgagcggcagccccggcttcttcagaaccagcggcagcgccttcagctgggacgcccagctgctgtgcagcacccccaacggcctggacagaggccacagaaagagagacgccatgtgcagcagcagcgccaacaaggagaacgacaacggcaacctggtggacagcgagatgaagtacctgggcagccccatcaccaccgtgcccaagctggacaagaaccccaacctgggcgaggaccaggccgaggagatcagcgacgagctgatggagttcagcctgaaggaccaggaggccaaggtgagcagaagcggcctgtacagaagccccagcatgcccgagaacctgaacagacccagactgaagcaggtggagaagttcaaggacaacaccatccccgacaaggtgaagaagaagtacttcagcggccagggcaagctgagaaagggcctgtgcctgaagaagaccgtgagcctgtgcgacatcaccatcacccagatgctggaggaggacagcaaccagggccacctgatcggcgacttcagcaaggtgtgcgccctgcccaccgtgagcggcaagcaccaggacctgaagtacgtgaaccccgagaccgtggccgccctgctgagcggcaagttccagggcctgatcgagaagttctacgtgatcgactgcagatacccctacgagtacctgggcggccacatccagggcgccctgaacctgtacagccaggaggagctgttcaacttcttcctgaagaagcccatcgtgcccctggacacccagaagagaatcatcatcgtgttccactgcgagttcagcagcgagagaggccccagaatgtgcagatgcctgagagaggaggacagaagcctgaaccagtaccccgccctgtactaccccgagctgtacatcctgaagggcggctacagagacttcttccccgagtacatggagctgtgcgagccccagagctactgccccatgcaccaccaggaccacaagaccgagctgctgagatgcagaagccagagcaaggtgcaggagggcgagagacagctgagagagcagatcgccctgctggtgaaggacatgagcccctag

SEQ ID NO: 10021 - DNA, 1203 bp, Artificial Sequence; identical to SEQ ID NO: 10018
  Description of Artificial Sequence: Synthetic coding sequence

SEQ ID NO: 10022 - DNA, 750 bp, Artificial Sequence
  Description of Artificial Sequence: Synthetic coding sequence
atgagcaccgagctgttcagcagcaccagagaggagggcagcagcggcagcggccccagcttcagaagcaaccagagaaagatgctgaacctgctgctggagagagacaccagcttcaccgtgtgccccgacgtgcccagaacccccgtgggcaagttcctgggcgacagcgccaacctgagcatcctgagcggcggcacccccaagagatgcctggacctgagcaacctgagcagcggcgagatcaccgccacccagctgaccaccagcgccgacctggacgagaccggccacctggacagcagcggcctgcaggaggtgcacctggccggcatgaaccacgaccagcacctgatgaagtgcagccccgcccagctgctgtgcagcacccccaacggcctggacagaggccacagaaagagagacgccatgtgcagcagcagcgccaacaaggagaacgacaacggcaacctggtggacagcgagatgaagtacctgggcagccccatcaccaccgtgcccaagctggacaagaaccccaacctgggcgaggaccaggccgaggagatcagcgacgagctgatggagttcagcctgaaggaccaggaggccaaggtgagcagaagcggcctgtacagaagccccagcatgcccgagaacctgaacagacccagactgaagcaggtggagaagttcaaggacaacaccatccccgacaaggtgaagaagaagtacttcagcggccagtag

SEQ ID NO: 10023 - DNA, 1422 bp, Artificial Sequence; identical to SEQ ID NO: 10017
  Description of Artificial Sequence: Synthetic coding sequence

SEQ ID NO: 10024 - DNA, 1473 bp, Artificial Sequence
  Description of Artificial Sequence: Synthetic coding sequence
atgagcgaggaggccagattctgcttcagccccggcgagaacagcaagaccatgagcaccgagctgttcagcagcaccagagaggagggcagcagcggcagcggccccagcttcagaagcaaccagagaaagatgctgaacctgctgctggagagagacaccagcttcaccgtgtgccccgacgtgcccagaacccccgtgggcaagttcctgggcgacagcgccaacctgagcatcctgagcggcggcacccccaagagatgcctggacctgagcaacctgagcagcggcgagatcaccgccacccagctgaccaccagcgccgacctggacgagaccggccacctggacagcagcggcctgcaggaggtgcacctggccggcatgaaccacgaccagcacctgatgaagtgcagccccgcccagctgctgtgcagcacccccaacggcctggacagaggccacagaaagagagacgccatgtgcagcagcagcgccaacaaggagaacgacaacggcaacctggtggacagcgagatgaagtacctgggcagccccatcaccaccgtgcccaagctggacaagaaccccaacctgggcgaggaccaggccgaggagatcagcgacgagctgatggagttcagcctgaaggaccaggaggccaaggtgagcagaagcggcctgtacagaagccccagcatgcccgagaacctgaacagacccagactgaagcaggtggagaagttcaaggacaacaccatccccgacaaggtgaagaagaagtacttcagcggccagggcaagctgagaaagggcctgtgcctgaagaagaccgtgagcctgtgcgacatcaccatcacccagatgctggaggaggacagcaaccagggccacctgatcggcgacttcagcaaggtgtgcgccctgcccaccgtgagcggcaagcaccaggacctgaagtacgtgaaccccgagaccgtggccgccctgctgagcggcaagttccagggcctgatcgagaagttctacgtgatcgactgcagatacccctacgagtacctgggcggccacatccagggcgccctgaacctgtacagccaggaggagctgttcaacttcttcctgaagaagcccatcgtgcccctggacacccagaagagaatcatcatcgtgttccactgcgagttcagcagcgagagaggccccagaatgtgcagatgcctgagagaggaggacagaagcctgaaccagtaccccgccctgtactaccccgagctgtacatcctgaagggcggctacagagacttcttccccgagtacatggagctgtgcgagccccagagctactgccccatgcaccaccaggaccacaagaccgagctgctgagatgcagaagccagagcaaggtgcaggagggcgagagacagctgagagagcagatcgccctgctggtgaaggacatgagcccctag

SEQ ID NO: 10025 - DNA, 288 bp, Artificial Sequence
  Description of Artificial Sequence: Synthetic coding sequence
atggagggcggcttcggcagcgacttcggcggcagcggcagcggcaagctggaccccggcctgatcatggagcaggtgaaggtgcagatcgccgtggccaacgcccaggagctgctgcagagaatgaccgacaagtgcttcagaaagtgcatcggcaagcccggcggcagcctggacaacagcgagcagaagtgcatcgccatgtgcatggacagatacatggacgcctggaacaccgtgagcagagcctacaacagcagactgcagagagagagagccaacatgtag

SEQ ID NO: 10026 - DNA, 576 bp, Artificial Sequence
  Description of Artificial Sequence: Synthetic coding sequence
atgcagaccatcaagtgcgtggtggtgggcgacggcgccgtgggcaagacctgcctgctgatcagctacaccaccaacaagttccccagcgagtacgtgcccaccgtgttcgacaactacgccgtgaccgtgatgatcggcggcgagccctacaccctgggcctgttcgacaccgccggccaggaggactacgacagactgagacccctgagctacccccagaccgacgtgttcctggtgtgcttcagcgtggtgagccccagcagcttcgagaacgtgaaggagaagtgggtgcccgagatcacccaccactgccccaagacccccttcctgctggtgggcacccagatcgacctgagagacgaccccagcaccatcgagaagctggccaagaacaagcagaagcccatcacccccgagaccgccgagaagctggccagagacctgaaggccgtgaagtacgtggagtgcagcgccctgacccagagaggcctgaagaacgtgttcgacgaggccatcctggccgccctggagccccccgagacccagcccaagagaaagtgctgcatcttctag

SEQ ID NO: 10027 - DNA, 576 bp, Artificial Sequence
  Description of Artificial Sequence: Synthetic coding sequence
atgcagaccatcaagtgcgtggtggtgggcgacggcgccgtgggcaagacctgcctgctgatcagctacaccaccaacaagttccccagcgagtacgtgcccaccgtgttcgacaactacgccgtgaccgtgatgatcggcggcgagccctacaccctgggcctgttcgacaccgccggccaggaggactacgacagactgagacccctgagctacccccagaccgacgtgttcctggtgtgcttcagcgtggtgagccccagcagcttcgagaacgtgaaggagaagtgggtgcccgagatcacccaccactgccccaagacccccttcctgctggtgggcacccagatcgacctgagagacgaccccagcaccatcgagaagctggccaagaacaagcagaagcccatcacccccgagaccgccgagaagctggccagagacctgaaggccgtgaagtacgtggagtgcagcgccctgacccagaagggcctgaagaacgtgttcgacgaggccatcctggccgccctggagccccccgagcccaagaagagcagaagatgcgtgctgctgtag

SEQ ID NO: 10028 - DNA, 576 bp, Artificial Sequence; identical to SEQ ID NO: 10027
  Description of Artificial Sequence: Synthetic coding sequence

SEQ ID NO: 10029 - DNA, 411 bp, Artificial Sequence
  Description of Artificial Sequence: Synthetic coding sequence
atgcagaccatcaagtgcgtggtggtgggcgacggcgccgtgggcaagacctgcctgctgatcagctacaccaccaacaagttccccagcgagtacgtgcccaccgtgttcgacaactacgccgtgaccgtgatgatcggcggcgagccctacaccctgggcctgttcgacaccgccggccaggaggactacgacagactgagacccctgagctacccccagaccgacgtgttcctggtgtgcttcagcgtggtgagccccagcagcttcgagaacgtgaaggagaagtgggtgcccgagatcacccaccactgccccaagacccccttcctgctggtgggcacccagatcgacctgagagacgaccccagcaccatcgagaagctggccaagaacaagcagaagccctag

SEQ ID NO: 10030 - DNA, 702 bp, Artificial Sequence
  Description of Artificial Sequence: Synthetic coding sequence
atgagccccgacatcctgcacaacaagcagatcagcatcggcatctgcaccgactacctggacttcagctgggtgaactacatccacttcaagcagctgaagaaccagtggaaggtgagaagaggcgacaccggcttcgccagaagcgccggcagacagaacagcagcagacaggacagcaacgagtggtggagccagttcggcgaggtgtgccccaccagctggaacgaggtgttcgacaactacgccgtgaccgtgatgatcggcggcgagccctacaccctgggcctgttcgacaccgccggccaggaggactacgacagactgagacccctgagctacccccagaccgacgtgttcctggtgtgcttcagcgtggtgagccccagcagcttcgagaacgtgaaggagaagtgggtgcccgagatcacccaccactgccccaagacccccttcctgctggtgggcacccagatcgacctgagagacgaccccagcaccatcgagaagctggccaagaacaagcagaagcccatcacccccgagaccgccgagaagctggccagagacctgaaggccgtgaagtacgtggagtgcagcgccctgacccagaagggcctgaagaacgtgttcgacgaggccatcctggccgccctggagccccccgagcccaagaagagcagaagatgcgtgctgctgtag

SEQ ID NO: 10031 - DNA, 1269 bp, Artificial Sequence
  Description of Artificial Sequence: Synthetic coding sequence
atgaacagcggccacagcttcagccagacccccagcgccagcttccacggcgccggcggcggctggggcagacccagaagcttccccagagcccccaccgtgcacggcggcgccggcggcgccagaatcagcctgagcttcaccaccagaagctgccccccccccggcggcagctggggcagcggcagaagcagccccctgctgggcggcaacggcaaggccaccatgcagaacctgaacgacagactggccagctacctggagaaggtgagagccctggaggaggccaacatgaagctggagagcagaatcctgaagtggcaccagcagagagaccccggcagcaagaaggactacagccagtacgaggagaacatcacccacctgcaggagcagatcgtggacggcaagatgaccaacgcccagatcatcctgctgatcgacaacgccagaatggccgtggacgacttcaacctgaagtacgagaacgagcacagcttcaagaaggacctggagatcgaggtggagggcctgagaagaaccctggacaacctgaccatcgtgaccaccgacctggagcaggaggtggagggcatgagaaaggagctgatcctgatgaagaagcaccacgagcaggagatggagaagcaccacgtgcccagcgacttcaacgtgaacgtgaaggtggacaccggccccagagaggacctgatcaaggtgctggaggacatgagacaggagtacgagctgatcatcaagaagaagcacagagacctggacacctggtacaaggagcagagcgccgccatgagccaggaggccgccagccccgccaccgtgcagagcagacagggcgacatccacgagctgaagagaaccttccaggccctggagatcgacctgcagacccagtacagcaccaagagcgccctggagaacatgctgagcgagacccagagcagatacagctgcaagctgcaggacatgcaggagatcatcagccactacgaggaggagctgacccagctgagacacgagctggagagacagaacaacgagtaccaggtgctgctgggcatcaagacccacctggagaaggagatcaccacctacagaagactgctggagggcgagagcgagggcaccagagaggagagcaagagcagcatgaaggtgagcgccacccccaagatcaaggccatcacccaggagaccatcaacggcagactggtgctgtgccaggtgaacgagatccagaagcacgcctag

SEQ ID NO: 10032 - DNA, 1596 bp, Artificial Sequence
  Description of Artificial Sequence: Synthetic coding sequence
atggccgacgtgctgagcgtgctgagacagtacaacatccagaagaaggagatcgtggtgaagggcgacgaggtgatcttcggcgagttcagctggcccaagaacgtgaagaccaactacgtggtgtggggcaccggcaaggagggccagcccagagagtactacaccctggacagcatcctgttcctgctgaacaacgtgcacctgagccaccccgtgtacgtgagaagagccgccaccgagaacatccccgtggtgagaagacccgacagaaaggacctgctgggctacctgaacggcgaggccagcaccagcgccagcatcgacagaagcgcccccctggagatcggcctgcagagaagcacccaggtgaagagagccgccgacgaggtgctggccgaggccaagaagcccagaatcgaggacgaggagtgcgtgagactggacaaggagagactggccgccagactggagggccacaaggagggcatcgtgcagaccgagcagatcagaagcctgagcgaggccatgagcgtggagaagatcgccgccatcaaggccaagatcatggccaagaagagaagcaccatcaagaccgacctggacgacgacatcaccgccctgaagcagagaagcttcgtggacgccgaggtggacgtgaccagagacatcgtgagcagagagagagtgtggagaaccagaaccaccatcctgcagagcaccggcaagaacttcagcaagaacatcttcgccatcctgcagagcgtgaaggccagagaggagggcagagcccccgagcagagacccgcccccaacgccgcccccgtggaccccaccctgagaaccaagcagcccatccccgccgcctacaacagatacgaccaggagagattcaagggcaaggaggagaccgagggcttcaagatcgacaccatgggcacctaccacggcatgaccctgaagagcgtgaccgagggcgccagcgccagaaagacccagacccccgccgcccagcccgtgcccagacccgtgagccaggccagacccccccccaaccagaagaagggcagcagaacccccatcatcatcatccccgccgccaccaccagcctgatcaccatgctgaacgccaaggacctgctgcaggacctgaagttcgtgcccagcgacgagaagaagaagcagggctgccagagagagaacgagaccctgatccagagaagaaaggaccagatgcagcccggcggcaccgccatcagcgtgaccgtgccctacagagtggtggaccagcccctgaagctgatgccccaggactgggacagagtggtggccgtgttcgtgcagggccccgcctggcagttcaagggctggccctggctgctgcccgacggcagccccgtggacatcttcgccaagatcaaggccttccacctgaagtacgacgaggtgagactggaccccaacgtgcagaagtgggacgtgaccgtgctggagctgagctaccacaagagacacctggacagacccgtgttcctgagattctgggagaccctggacagatacatggtgaagcacaagagccacctgagattctag

SEQ ID NO: 10033 - DNA, 951 bp, Artificial Sequence
  Description of Artificial Sequence: Synthetic coding sequence
atggccgacgtgctgagcgtgctgagacagtacaacatccagaagaaggagatcgtggtgaagggcgacgaggtgatcttcggcgagttcagctggcccaagaacgtgaagaccaactacgtggtgtggggcaccggcaaggagggccagcccagagagtactacaccctggacagcatcctgttcctgctgaacaacgtgcacctgagccaccccgtgtacgtgagaagagccgccaccgagaacatccccgtggtgagaagacccgacagaaaggacctgctgggctacctgaacggcgaggccagcaccagcgccagcatcgacagaagcgcccccctggagatcggcctgcagagaagcacccaggtgaagagagccgccgacgaggtgctggccgaggccaagaagcccagaatcgaggacgaggagtgcgtgagactggacaaggagagactggccgccagactggagggccacaaggagggcatcgtgcagaccgagcagatcagaagcctgagcgaggccatgagcgtggagaagatcgccgccatcaaggccaagatcatggccaagaagagaagcaccatcaagaccgacctggacgacgacatcaccgccctgaagcagagaagcttcgtggacgccgaggtggacgtgaccagagacatcgtgagcagagagagagtgtggagaaccagaaccaccatcctgcagagcaccggcaagaacttcagcaagaacatcttcgccatcctgcagagcgtgaaggccagagaggagggcagagcccccgagcagagacccgcccccaacgccgcccccgtggaccccaccctgagaaccaagcagcccatccccgccgcctacaacagatacgaccaggagagaatcagcaacacccactaccacaacagctgcagctaccacctgttcaacaaccacgcctag

SEQ ID NO: 10034 - DNA, 1317 bp, Artificial Sequence
  Description of Artificial Sequence: Synthetic coding sequence
atgggcggctgcgccggcagcagaagaagattcagcgacagcgagggcgaggagaccgtgcccgagcccagactgcccctgctggaccaccagggcgcccactggaagaacgccgtgggcttctggctgctgggcctgtgcaacaacttcagctacgtggtgatgctgagcgccgcccacgacatcctgagccacaagagaaccagcggcaaccagagccacgtggaccccggccccacccccatcccccacaacagcagcagcagattcgactgcaacagcgtgagcaccgccgccgtgctgctggccgacatcctgcccaccctggtgatcaagctgctggcccccctgggcctgcacctgctgccctacagccccagagtgctggtgagcggcatctgcgccgccggcagcttcgtgctggtggccttcagccacagcgtgggcaccagcctgtgcggcgtggtgttcgccagcatcagcagcggcctgggcgaggtgaccttcctgagcctgaccgccttctaccccagagccgtgatcagctggtggagcagcggcaccggcggcgccggcctgctgggcgccctgagctacctgggcctgacccaggccggcctgagcccccagcagaccctgctgagcatgctgggcatccccgccctgctgctggccagctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10035 - DNA, 504 bp, Artificial Sequence
  Description of Artificial Sequence: Synthetic coding sequence
atgggcggctgcgccggcagcagaagaagattcagcgacagcgagggcgaggagaccgtgcccgagcccagactgcccctgctggaccaccagggcgcccactggaagaacgccgtgggcttctggctgctgggcctgtgcaacaacttcagctacgtggtgatgctgagcgccgcccacgacatcctgagccacaagagaaccagcggcaaccagagccacccccccggcagcagacagtgggacctgtgctgctggaagctgagacccggctgcctgttcagcttctgcggcgaccagcccgtgtgctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtgtag

SEQ ID NO: 10036 - DNA, 1266 bp, Artificial Sequence
  Description of Artificial Sequence: Synthetic coding sequence
atgggcggctgcgccggcagcagaagaagattcagcgacagcgagggcgaggagaccgtgcccgagcccagactgcccctgctggaccaccagggcgcccactggaagaacgccgtgggcttctggctgctgggcctgtgcaacaacttcagctacgtggtgatgctgagcgccgcccacgacatcctgagccacaagagaaccagcggcaaccagagccacgtggaccccggccccacccccatcccccacaacagcagcagcagattcgactgcaacagcgtgagcaccgccgccgtgctgctggccgacatcctgcccaccctggtgatcaagctgctggcccccctgggcctgcacctgctgccctacagccccagagtgctggtgagcggcatctgcgccgccggcagcttcgtgctggtggccttcagccacagcgtgggcaccagcctgtgcggcgtggtgttcgccagcatcagcagcggcctgggcgaggtgaccttcctgagcctgaccgccttctaccccagagccgtgatcagctggtggagcagcggcaccggcggcgccggcctgctgggcgccctgagctacctgggcctgacccaggccggcctgagcccccagcagaccctgctgagcatgctgggcatccccgccctgctgctggccagctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaaggtgagaatgatggccggcttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10037 - DNA, 1173 bp, Artificial Sequence
  Description of Artificial Sequence: Synthetic coding sequence
atgggcggctgcgccggcagcagaagaagattcagcgacagcgagggcgaggagaccgtgcccgagcccagactgcccctgctggaccaccagggcgcccactggaagaacgccgtgggcttctggctgctgggcctgtgcaacaacttcagctacgtggtgatgctgagcgccgcccacgacatcctgagccacaagagaaccagcggcaaccagagccacgtggaccccggccccacccccatcccccacaacagcagcagcagattcgactgcaacagcgtgagcaccgccgccgtgctgctggccgacatcctgcccaccctggtgatcaagctgctggcccccctgggcctgcacctgctgccctacagccccagagtgctggtgagcggcatctgcgccgccggcagcttcgtgctggtggccttcagccacagcgtgggcaccagcctgtgcggcgtggtgttcgccagcatcagcagcggcctgggcgaggtgaccttcctgagcctgaccgccttctaccccagctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10038 - DNA, 762 bp, Artificial Sequence
  Description of Artificial Sequence: Synthetic coding sequence
atgggcggctgcgccggcagcagaagaagattcagcgacagcgagggcgaggagaccgtgcccgagcccagactgcccctgctggaccaccagggcgcccactggaagaacgccgtgggcttctggctgctgggcctgtgcaacaacttcagctacgtggtgatgctgagcgccgcccacgacatcctgagccacaagagaaccagcggcaaccagagccacgtggaccccggccccacccccatcccccacaacagcagcagcagattcgactgcaacagcgtgagcaccgccgccgtgctgctggccgacatcctgcccaccctggtgatcaagctgctggcccccctgggcctgcacctgctgccctacagccccagagtgctggtgagcggcatctgcgccgccggcagcttcgtgctggtggccttcagccacagcgtgggcaccagcctgtgcggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagatggagagcagaagcgtggcccaggccggcatgtag

SEQ ID NO: 10039 - DNA, 1020 bp, Artificial Sequence
  Description of Artificial Sequence: Synthetic coding sequence
atgggcggctgcgccggcagcagaagaagattcagcgacagcgagggcgaggagaccgtgcccgagcccagactgcccctgctggaccaccagggcgcccactggaagaacgccgtgggcttctggctgctgggcctgtgcaacaacttcagctacgtggtgatgctgagcgccgcccacgacatcctgagccacaagagaaccagcggcaaccagagccacgtggaccccggccccacccccatcccccacaacagcagcagcagattcgactgcaacagcgtgagcaccgccccccccggcagcagacagtgggacctgtgctgctggaagctgagacccggctgcctgttcagcttctgcggcgaccagcccgtgtgctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10040 - DNA, 1155 bp, Artificial Sequence
  Description of Artificial Sequence: Synthetic coding sequence
atgctgagcgccgcccacgacatcctgagccacaagagaaccagcggcaaccagagccacgtggaccccggccccacccccatcccccacaacagcagcagcagattcgactgcaacagcgtgagcaccgccgccgtgctgctggccgacatcctgcccaccctggtgatcaagctgctggcccccctgggcctgcacctgctgccctacagccccagagtgctggtgagcggcatctgcgccgccggcagcttcgtgctggtggccttcagccacagcgtgggcaccagcctgtgcggcgtggtgttcgccagcatcagcagcggcctgggcgaggtgaccttcctgagcctgaccgccttctaccccagagccgtgatcagctggtggagcagcggcaccggcggcgccggcctgctgggcgccctgagctacctgggcctgacccaggccggcctgagcccccagcagaccctgctgagcatgctgggcatccccgccctgctgctggccagctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10041 - DNA, 1317 bp, Artificial Sequence; identical to SEQ ID NO: 10034
  Description of Artificial Sequence: Synthetic coding sequence

SEQ ID NO: 10042 - DNA, 1317 bp, Artificial Sequence; identical to SEQ ID NO: 10034
  Description of Artificial Sequence: Synthetic coding sequence

SEQ ID NO: 10043 - DNA, 1017 bp, Artificial Sequence
  Description of Artificial Sequence: Synthetic coding sequence
atgtggacccaggcccagagaagaagccccaccaccgcccaccacgacctgaccgccaccctgagcctgagactgcccagagtgctggtgagcggcatctgcgccgccggcagcttcgtgctggtggccttcagccacagcgtgggcaccagcctgtgcggcgtggtgttcgccagcatcagcagcggcctgggcgaggtgaccttcctgagcctgaccgccttctaccccagagccgtgatcagctggtggagcagcggcaccggcggcgccggcctgctgggcgccctgagctacctgggcctgacccaggccggcctgagcccccagcagaccctgctgagcatgctgggcatccccgccctgctgctggccagctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10044 - DNA, 1083 bp, Artificial Sequence
  Description of Artificial Sequence: Synthetic coding sequence
atgctgagcgccgcccacgacatcctgagccacaagagaaccagcggcaaccagagccacgccgtgctgctggccgacatcctgcccaccctggtgatcaagctgctggcccccctgggcctgcacctgctgccctacagccccagagtgctggtgagcggcatctgcgccgccggcagcttcgtgctggtggccttcagccacagcgtgggcaccagcctgtgcggcgtggtgttcgccagcatcagcagcggcctgggcgaggtgaccttcctgagcctgaccgccttctaccccagagccgtgatcagctggtggagcagcggcaccggcggcgccggcctgctgggcgccctgagctacctgggcctgacccaggccggcctgagcccccagcagaccctgctgagcatgctgggcatccccgccctgctgctggccagctacttcctgctgctgaccagccccgaggcccaggaccccggcggcgaggaggaggccgagagcgccgccagacagcccctgatcagaaccgaggcccccgagagcaagcccggcagcagcagcagcctgagcctgagagagagatggaccgtgttcaagggcctgctgtggtacatcgtgcccctggtggtggtgtacttcgccgagtacttcatcaaccagggcctgttcgagctgctgttcttctggaacaccagcctgagccacgcccagcagtacagatggtaccagatgctgtaccaggccggcgtgttcgccagcagaagcagcctgagatgctgcagaatcagattcacctgggccctggccctgctgcagtgcctgaacctggtgttcctgctggccgacgtgtggttcggcttcctgcccagcatctacctggtgttcctgatcatcctgtacgagggcctgctgggcggcgccgcctacgtgaacaccttccacaacatcgccctggagaccagcgacgagcacagagagttcgccatggccgccacctgcatcagcgacaccctgggcatcagcctgagcggcctgctggccctgcccctgcacgacttcctgtgccagctgagctag

SEQ ID NO: 10045 - DNA, 1299 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacccacagagacatcaagcccgagaacctgctgctggacgagagagacaacctgaagatcagcgacttcggcctggccaccgtgttcagatacaacaacagagagagactgctgaacaagatgtgcggcaccctgccctacgtggcccccgagctgctgaagagaagagagttccacgccgagcccgtggacgtgtggagctgcggcatcgtgctgaccgccatgctggccggcgagctgccctgggaccagcccagcgacagctgccaggagtacagcgactggaaggagaagaagacctacctgaacccctggaagaagatcgacagcgcccccctggccctgctgcacaagatcctggtggagaaccccagcgccagaatcaccatccccgacatcaagaaggacagatggtacaacaagcccctgaagaagggcgccaagagacccagagtgaccagcggcggcgtgagcgagagccccagcggcttcagcaagcacatccagagcaacctggacttcagccccgtgaacagcgccagcagcgaggagaacgtgaagtacagcagcagccagcccgagcccagaaccggcctgagcctgtgggacaccagccccagctacatcgacaagctggtgcagggcatcagcttcagccagcccacctgccccgaccacatgctgctgaacagccagctgctgggcacccccggcagcagccaggtgaccatcagcaccaccgacagaagaaacaacaagctgatcttcaaggtgaacctgctggagatggacgacaagatcctggtggacttcagactgagcaagggcgacggcctggagttcaagagacacttcctgaagatcaagggcaagctgatcgacatcgtgagcagccagaagatctggctgcccgccacctag

SEQ ID NO: 10046 - DNA, 1431 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacccacagagacatcaagcccgagaacctgctgctggacgagagagacaacctgaagatcagcgacttcggcctggccaccgtgttcagatacaacaacagagagagactgctgaacaagatgtgcggcaccctgccctacgtggcccccgagctgctgaagagaagagagttccacgccgagcccgtggacgtgtggagctgcggcatcgtgctgaccgccatgctggccggcgagctgccctgggaccagcccagcgacagctgccaggagtacagcgactggaaggagaagaagacctacctgaacccctggaagaagatcgacagcgcccccctggccctgctgcacaagatcctggtggagaaccccagcgccagaatcaccatccccgacatcaagaaggacagatggtacaacaagcccctgaagaagggcgccaagagacccagagtgaccagcggcggcgtgagcgagagccccagcggcttcagcaagcacatccagagcaacctggacttcagccccgtgaacagcgccagcagcgaggagaacgtgaagtacagcagcagccagcccgagcccagaaccggcctgagcctgtgggacaccagccccagctacatcgacaagctggtgcagggcatcagcttcagccagcccacctgccccgaccacatgctgctgaacagccagctgctgggcacccccggcagcagccagaacccctggcagagactggtgaagagaatgaccagattcttcaccaagctggacgccgacaagagctaccagtgcctgaaggagacctgcgagaagctgggctaccagtggaagaagagctgcatgaaccaggtgaccatcagcaccaccgacagaagaaacaacaagctgatcttcaaggtgaacctgctggagatggacgacaagatcctggtggacttcagactgagcaagggcgacggcctggagttcaagagacacttcctgaagatcaagggcaagctgatcgacatcgtgagcagccagaagatctggctgcccgccacctag

SEQ ID NO: 10047 - DNA, 1431 bp, Artificial Sequence; identical to SEQ ID NO: 10046
  Description of Artificial Sequence: Synthetic coding sequence

SEQ ID NO: 10048 - DNA, 1431 bp, Artificial Sequence; identical to SEQ ID NO: 10046
  Description of Artificial Sequence: Synthetic coding sequence

SEQ ID NO: 10049 - DNA, 402 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacccacagagacatcaagccctag

SEQ ID NO: 10050 - DNA, 513 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacccacagagacatcaagcccgagaacctgctgctggacgagagagacaacctgaagatcagcgacttcggcctggccaccgtgttcagatacaacaacagagagagactgctgaacaagatgtgcggcacctag

SEQ ID NO: 10051 - DNA, 615 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacccacagagacatcaagcccgagaacctgctgctggacgagagagacaacctgaagatcagcgacttcggcctggccaccgtgttcagatacaacaacagagagagactgctgaacaagatgtgcggcaccctgccctacgtggcccccgagctgctgaagagaagagagttccacgccgagcccgtggacgtgtggagctgcggcatcgtgctgaccgccatgctggccggctag

SEQ ID NO: 10052 - DNA, 129 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgtag

SEQ ID NO: 10053 - DNA, 1431 bp, Artificial Sequence; identical to SEQ ID NO: 10046
  Description of Artificial Sequence: Synthetic coding sequence

SEQ ID NO: 10054 - DNA, 384 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacctag

SEQ ID NO: 10055 - DNA, 1329 bp, Artificial Sequence
  Description of Artificial Sequence: Synthetic coding sequence
atggccgtgcccttcgtggaggactgggacctggtgcagaccctgggcgagggcgcctacggcgaggtgcagctggccgtgaacagagtgaccgaggaggccgtggccgtgaagatcgtggacatgaagagagccgtggactgccccgagaacatcaagaaggagatctgcatcaacaagatgctgaaccacgagaacgtggtgaagttctacggccacagaagagagggcaacatccagtacctgttcctggagtactgcagcggcggcgagctgttcgacagaatcgagcccgacatcggcatgcccgagcccgacgcccagagattcttccaccagctgatggccggcgtggtgtacctgcacggcatcggcatcacccacagagacatcaagcccgagaacctgctgctggacgagagagacaacctgaagatcagcgacttcggcctggccaccgtgttcagatacaacaacagagagagactgctgaacaagatgtgcggcaccctgccctacgtggcccccgagctgctgaagagaagagagttccacgccgagcccgtggacgtgtggagctgcggcatcgtgctgaccgccatgctggccggcgagctgccctgggaccagcccagcgacagctgccaggagtacagcgactggaaggagaagaagacctacctgaacccctggaagaagatcgacagcgcccccctggccctgctgcacaagatcctggtggagaaccccagcgccagaatcaccatccccgacatcaagaaggacagatggtacaacaagcccctgaagaagggcgccaagagacccagagtgaccagcggcggcgtgagcgagagccccagcggcttcagcaagcacatccagagcaacctggacttcagccccgtgaacagcgccagcagcgaggagaacgtgaagtacagcagcagccagcccgagcccagaaccggcctgagcctgtgggacaccagccccagctacatcgacaagctggtgcagggcatcagcttcagccagcccacctgccccgaccacatgctgctgaacagccagctgctgggcacccccggcagcagccagaacccctggcagagactggtgaagagaatgaccagattcttcaccaagctggacgccgacaagagctaccagtgcctgaaggagacctgcgagaagctgggctaccagtggaagaagagctgcatgaaccagggcgacggcctggagttcaagagacacttcctgaagatcaagggcaagctgatcgacatcgtgagcagccagaagatctggctgcccgccacctag

SEQ ID NO: 10056 - DNA, 1632 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctggagtgcgtgaacgacaactactggttcggcagagacaagagctgcgagtactgcttcgacgagcccctgctgaagagaaccgacaagtacagaacctacagcaagaagcacttcagaatcttcagagaggtgggccccaagaacagctacatcgcctacatcgaggaccacagcggcaacggcaccttcgtgaacaccgagctggtgggcaagggcaagagaagacccctgaacaacaacagcgagatcgccctgagcctgagcagaaacaaggtgttcgtgttcttcgacctgaccgtggacgaccagagcgtgtaccccaaggccctgagagacgagtacatcatgagcaagaccctgggcagcggcgcctgcggcgaggtgaagctggccttcgagagaaagacctgcaagaaggtggccatcaagatcatcagcaagagaaagttcgccatcggcagcgccagagaggccgaccccgccctgaacgtggagaccgagatcgagatcctgaagaagctgaaccacccctgcatcatcaagatcaagaacttcttcgacgccgaggactactacatcgtgctggagctgatggagggcggcgagctgttcgacaaggtggtgggcaacaagagactgaaggaggccacctgcaagctgtacttctaccagatgctgctggccgtgcagtacctgcacgagaacggcatcatccacagagacctgaagcccgagaacgtgctgctgagcagccaggaggaggactgcctgatcaagatcaccgacttcggccacagcaagatcctgggcgagaccagcctgatgagaaccctgtgcggcacccccacctacctggcccccgaggtgctggtgagcgtgggcaccgccggctacaacagagccgtggactgctggagcctgggcgtgatcctgttcatctgcctgagcggctacccccccttcagcgagcacagaacccaggtgagcctgaaggaccagatcaccagcggcaagtacaacttcatccccgaggtgtgggccgaggtgagcgagaaggccctggacctggtgaagaagctgctggtggtggaccccaaggccagattcaccaccgaggaggccctgagacacccctggctgcaggacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10057 - DNA, 1545 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctggagtgcgtgaacgacaactactggttcggcagagacaagagctgcgagtactgcttcgacgagcccctgctgaagagaaccgacaagtacagaacctacagcaagaagcacttcagaatcttcagagaggtgggccccaagaacagctacatcgcctacatcgaggaccacagcggcaacggcaccttcgtgaacaccgagctggtgggcaagggcaagagaagacccctgaacaacaacagcgagatcgccctgagcctgagcagaaacaaggtgttcgtgttcttcgacctgaccgtggacgaccagagcgtgtaccccaaggccctgagagacgagtacatcatgagcaagaccctgggcagcggcgcctgcggcgaggtgaagctggccttcgagagaaagacctgcaagaaggtggccatcaagatcatcagcaagagaaagttcgccatcggcagcgccagagaggccgaccccgccctgaacgtggagaccgagatcgagatcctgaagaagctgaaccacccctgcatcatcaagatcaagaacttcttcgacgccgaggactactacatcgtgctggagctgatggagggcggcgagctgttcgacaaggtggtgggcaacaagagactgaaggaggccacctgcaagctgtacttctaccagatgctgctggccgtgcagatcaccgacttcggccacagcaagatcctgggcgagaccagcctgatgagaaccctgtgcggcacccccacctacctggcccccgaggtgctggtgagcgtgggcaccgccggctacaacagagccgtggactgctggagcctgggcgtgatcctgttcatctgcctgagcggctacccccccttcagcgagcacagaacccaggtgagcctgaaggaccagatcaccagcggcaagtacaacttcatccccgaggtgtgggccgaggtgagcgagaaggccctggacctggtgaagaagctgctggtggtggaccccaaggccagattcaccaccgaggaggccctgagacacccctggctgcaggacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10058 - DNA, 681 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatcccccccgaggtgctggtgagcgtgggcaccgccggctacaacagagccgtggactgctggagcctgggcgtgatcctgttcatctgcctgagcggctacccccccttcagcgagcacagaacccaggtgagcctgaaggaccagatcaccagcggcaagtacaacttcatccccgaggtgtgggccgaggtgagcgagaaggccctggacctggtgaagaagctgctggtggtggaccccaaggccagattcaccaccgaggaggccctgagacacccctggctgcaggacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10059 - DNA, 492 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctgggcgacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10060 - DNA, 870 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctggagtgcgtgaacgacaactactggttcggcagagacaagagctgcgagtactgcttcgacgagcccctgctgaagagaaccgacaagtacagaacctacagcaagaagcacttcagaatcttcagagaggtgggccccaagaacagctacatcgcctacatcgaggaccacagcggcaacggcaccttcgtgaacaccgagctggtgggcaagggcaagagaagacccctgaacaacaacagcgagatcgccctgagcctgagcagaaacaaggtgttcgtgttcttcgacctgaccgtggacgaccagagcgtgtaccccaaggccctgagagacgagtacatcatgagcaagaccctgggcagcggcgcctgcggcgaggtgaagctggccttcgagagaaagacctgcaagaaggtggccatcaagatcatcagcaagagaaagttcgccatcggcagcgccagagaggccgaccccgccctgaacgtggagaccgagatcgagatcctgaagaagctgaaccacgacggcagaggcagagccgtgtag

SEQ ID NO: 10061 - DNA, 1359 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctggtgttcgtgttcttcgacctgaccgtggacgaccagagcgtgtaccccaaggccctgagagacgagtacatcatgagcaagaccctgggcagcggcgcctgcggcgaggtgaagctggccttcgagagaaagacctgcaagaaggtggccatcaagatcatcagcaagagaaagttcgccatcggcagcgccagagaggccgaccccgccctgaacgtggagaccgagatcgagatcctgaagaagctgaaccacccctgcatcatcaagatcaagaacttcttcgacgccgaggactactacatcgtgctggagctgatggagggcggcgagctgttcgacaaggtggtgggcaacaagagactgaaggaggccacctgcaagctgtacttctaccagatgctgctggccgtgcagtacctgcacgagaacggcatcatccacagagacctgaagcccgagaacgtgctgctgagcagccaggaggaggactgcctgatcaagatcaccgacttcggccacagcaagatcctgggcgagaccagcctgatgagaaccctgtgcggcacccccacctacctggcccccgaggtgctggtgagcgtgggcaccgccggctacaacagagccgtggactgctggagcctgggcgtgatcctgttcatctgcctgagcggctacccccccttcagcgagcacagaacccaggtgagcctgaaggaccagatcaccagcggcaagtacaacttcatccccgaggtgtgggccgaggtgagcgagaaggccctggacctggtgaagaagctgctggtggtggaccccaaggccagattcaccaccgaggaggccctgagacacccctggctgcaggacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10062 - DNA, 1761 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctggagaccgagagcggccacgtgacccagagcgacctggagctgctgctgagcagcgacccccccgccagcgccagccagagcgccggcatcagaggcgtgagacaccaccccagacccgtgtgcagcctgaagtgcgtgaacgacaactactggttcggcagagacaagagctgcgagtactgcttcgacgagcccctgctgaagagaaccgacaagtacagaacctacagcaagaagcacttcagaatcttcagagaggtgggccccaagaacagctacatcgcctacatcgaggaccacagcggcaacggcaccttcgtgaacaccgagctggtgggcaagggcaagagaagacccctgaacaacaacagcgagatcgccctgagcctgagcagaaacaaggtgttcgtgttcttcgacctgaccgtggacgaccagagcgtgtaccccaaggccctgagagacgagtacatcatgagcaagaccctgggcagcggcgcctgcggcgaggtgaagctggccttcgagagaaagacctgcaagaaggtggccatcaagatcatcagcaagagaaagttcgccatcggcagcgccagagaggccgaccccgccctgaacgtggagaccgagatcgagatcctgaagaagctgaaccacccctgcatcatcaagatcaagaacttcttcgacgccgaggactactacatcgtgctggagctgatggagggcggcgagctgttcgacaaggtggtgggcaacaagagactgaaggaggccacctgcaagctgtacttctaccagatgctgctggccgtgcagtacctgcacgagaacggcatcatccacagagacctgaagcccgagaacgtgctgctgagcagccaggaggaggactgcctgatcaagatcaccgacttcggccacagcaagatcctgggcgagaccagcctgatgagaaccctgtgcggcacccccacctacctggcccccgaggtgctggtgagcgtgggcaccgccggctacaacagagccgtggactgctggagcctgggcgtgatcctgttcatctgcctgagcggctacccccccttcagcgagcacagaacccaggtgagcctgaaggaccagatcaccagcggcaagtacaacttcatccccgaggtgtgggccgaggtgagcgagaaggccctggacctggtgaagaagctgctggtggtggaccccaaggccagattcaccaccgaggaggccctgagacacccctggctgcaggacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10063 - DNA, 1545 bp, Artificial Sequence; identical to SEQ ID NO: 10057
  Description of Artificial Sequence: Synthetic coding sequence

SEQ ID NO: 10064 - DNA, 1359 bp, Artificial Sequence; identical to SEQ ID NO: 10061
  Description of Artificial Sequence: Synthetic coding sequence

SEQ ID NO: 10065 - DNA, 1632 bp, Artificial Sequence; identical to SEQ ID NO: 10056
  Description of Artificial Sequence: Synthetic coding sequence

SEQ ID NO: 10066 - DNA, 1632 bp, Artificial Sequence; identical to SEQ ID NO: 10056
  Description of Artificial Sequence: Synthetic coding sequence

SEQ ID NO: 10067 - DNA, 969 bp, Artificial Sequence
  Description of Artificial Sequence: Synthetic coding sequence
atgagcaagaccctgggcagcggcgcctgcggcgaggtgaagctggccttcgagagaaagacctgcaagaaggtggccatcaagatcatcagcaagagaaagttcgccatcggcagcgccagagaggccgaccccgccctgaacgtggagaccgagatcgagatcctgaagaagctgaaccacccctgcatcatcaagatcaagaacttcttcgacgccgaggactactacatcgtgctggagctgatggagggcggcgagctgttcgacaaggtggtgggcaacaagagactgaaggaggccacctgcaagctgtacttctaccagatgctgctggccgtgcagtacctgcacgagaacggcatcatccacagagacctgaagcccgagaacgtgctgctgagcagccaggaggaggactgcctgatcaagatcaccgacttcggccacagcaagatcctgggcgagaccagcctgatgagaaccctgtgcggcacccccacctacctggcccccgaggtgctggtgagcgtgggcaccgccggctacaacagagccgtggactgctggagcctgggcgtgatcctgttcatctgcctgagcggctacccccccttcagcgagcacagaacccaggtgagcctgaaggaccagatcaccagcggcaagtacaacttcatccccgaggtgtgggccgaggtgagcgagaaggccctggacctggtgaagaagctgctggtggtggaccccaaggccagattcaccaccgaggaggccctgagacacccctggctgcaggacgaggacatgaagagaaagttccaggacctgctgagcgaggagaacgagagcaccgccctgccccaggtgctggcccagcccagcaccagcagaaagagacccagagagggcgaggccgagggcgccgagaccaccaagagacccgccgtgtgcgccgccgtgctgtag

SEQ ID NO: 10068 - DNA, 624 bp, Artificial Sequence
  Description of Artificial Sequence: Synthetic coding sequence
atgagcagagagagcgacgtggaggcccagcagagccacggcagcagcgcctgcagccagccccacggcagcgtgacccagagccagggcagcagcagccagagccagggcatcagcagcagcagcaccagcaccatgcccaacagcagccagagcagccacagcagcagcggcaccctgagcagcctggagaccgtgagcacccaggagctgtacagcatccccgaggaccaggagcccgaggaccaggagcccgaggagcccacccccgccccctgggccagactgtgggccctgcaggacggcttcgccaacctggagtgcgtgaacgacaactactggttcggcagagacaagagctgcgagtactgcttcgacgagcccctgctgaagagaaccgacaagtacagaacctacagcaagaagcacttcagaatcttcagagaggtgggccccaagaacagctacatcgcctacatcgaggaccacagcggcaacggcaccttcgtgaacaccgagctggtgggcaagggcaagagaagacccctgaacaacaacagcgagatcgccctgagcctgagcagaaacaaggagaagatcctgaagatctacagcctgagctag

SEQ ID NO: 10069 - DNA, 294 bp, Artificial Sequence
  Description of Artificial Sequence: Synthetic coding sequence
atgaaggtgagcgccgccctgctgtggctgctgctgatcgccgccgccttcagcccccagggcctggccggccccgccagcgtgcccaccacctgctgcttcaacctggccaacagaaagatccccctgcagagactggagagctacagaagaatcaccagcggcaagtgcccccagaaggccgtgatcttcaagaccaagctggccaaggacatctgcgccgaccccaagaagaagtgggtgcaggacagcatgaagtacctggaccagaagagccccacccccaagccctag

SEQ ID NO: 10070 - DNA, 1692 bp, Artificial Sequence
  Description of Artificial Sequence: Synthetic coding sequence
atgagcagaatcggcggcgccggcctgcccgccgccgccctgaccggccccggcagattcagaatggccagagaggagcccgcccccgccgccctggccgccgccggccagcccggcggcggcagaggcggcgagagagccctgcagggccccggcgtggccagaagaggcagacccagcctgagcagagccaagctgcacggcctgagacacatgtgcgccggcagaaccgccgccggcggcagcttccagagaagagccctgtgggtgctggccttctgcaccagcttcggcctgctgctgagctggagcagcaacagactgctgtactggctgagcttccccagccacaccagagtgcacagagagtggagcagacagctgcccttccccgccgtgaccgtgtgcaacaacaaccccctgagattccccagactgagcaagggcgacctgtactacgccggccactggctgggcctgctgctgcccaacagaaccgccagacccctggtgagcgagctgctgagaggcgacgagcccagaagacagtggttcagaaagctggccgacttcagactgttcctgccccccagacacttcgagggcatcagcgccgccttcatggacagactgggccaccagctggaggacatgctgctgagctgcaagtacagaggcgagctgtgcggcccccacaacttcagcagcgtgttcaccaagtacggcaagtgctacatgttcaacagcggcgaggacggcaagcccctgctgaccaccgtgaagggcggcaccggcaacggcctggagatcatgctggacatccagcaggacgagtacctgcccatctggggcgagaccgaggagaccaccttcgaggccggcgtgaaggtgcagatccacagccagagcgagccccccttcatccaggagctgggcttcggcgtggcccccggcttccagaccttcgtggccacccaggagcagagactgacctacctgccccccccctggggcgagtgcagaagcagcgagatgggcctggacttcttccccgtgtacagcatcaccgcctgcagaatcgactgcgagaccagatacatcgtggagaactgcaactgcagaatggtgcacatgcccggcgacgcccccttctgcacccccgagcagcacaaggagtgcgccgagcccgccctgggcctgctggccgagaaggacagcaactactgcctgtgcagaaccccctgcaacctgaccagatacaacaaggagctgagcatggtgaagatccccagcaagaccagcgccaagtacctggagaagaagttcaacaagagcgagaagtacatcagcgagaacatcctggtgctggacatcttcttcgaggccctgaactacgagaccatcgagcagaagaaggcctacgaggtggccgccctgctgggcgacatcggcggccagatgggcctgttcatcggcgccagcatcctgaccatcctggagctgttcgactacatctacgagctgatcaaggagaagctgctggacctgctgggcaaggaggaggacgagggcagccacgacgagaacgtgagcacctgcgacaccatgcccaaccacagcgagaccatcagccacaccgtgaacgtgcccctgcagaccaccctgggcaccctggaggagatcgcctgctag

SEQ ID NO: 10071 - DNA, 2328 bp, Artificial Sequence
  Description of Artificial Sequence: Synthetic coding sequence
atggtgggccccgaggacgccggcgcctgcagcggcagaaaccccaagctgctgcccgtgcccgcccccgaccccgtgggccaggacagaaaggtgatcagagccaccggcggcttcggcggcggcgtgggcgccgtggagccccccgaggaggccgacgaggaggaggaggccgacgaggaggaggagaccccccccagacagctgctgcagagatacctggccgccgccggcgagcagctggagcccggcctgtgctactgccccctgcccgccggccaggccggcgcccccccccccagcgccgcccccagaagcgacgcctgcctgctgggcagcggcagcaagcacagaggcgccgaggtggccgacggcagagcccccagacacgagggcatgaccaacggcgacagcggcttcctgcccggcagagactgcagagacctggaggaggccagaggcctggccagagccggcggcagagagagcagaagaagaagaccctacggcagactgagactggagggccccggcgacgaggacgccgacggcgccggcagccccagcgactgggccagccccctggaggaccccctgagaagctgctgcctggtggccgccgacgcccaggagcccgagggcgccggcagcgacagcggcgacagccccgccagcagctgcagcagcagcgaggacagcgagcagagaggcgtgggcgccggcggccccgaggagggcgccccccccgccaccagcgccgagagaaccaacggcggcgccgagcccagactgggcttcagcgacatccacttcaacagcagaaacaccttccaggtgagcagaggccagagcgccagagaccacctgccccccgccggcccccccgtgcccctgcccgccgccgagcagggccccgccggcgccagcgccagagccagaagaagcggcggcttcgccgacttcttcaccagaaacctgttccccaagagaaccaaggagctgaagagcgtggtgcacagcgcccccggctggaagctgttcggcaaggtgccccccagagagaacctgcagaagaccagcaagatcatccagcaggagtacgaggccagaaccggcagaacctgcaagccccccccccagagcagcagaagaaagaacttcgagttcgagcccctgagcaccaccgccctgatcctggaggacagacccagcaacctgcccgccaagagcgtggaggaggccctgagacacagacaggagtacgacgagatggtggccgaggccaagaagagagagatcaaggaggcccacaagagaaagagaatcatgaaggagagattcaagcaggaggagaacatcgccagcgccatggtgatctggatcaacgagatcctgcccaactgggaggtgatgagaagcaccagaagagtgagagagctgtggtggcagggcctgccccccagcgtgagaggcaaggtgtggagcctggccgtgggcaacgagctgaacatcacccccgagctgtacgagatcttcctgagcagagccaaggagagatggaagagcttcagcgagaccagcagcgagaacgacaccgagggcgtgagcgtggccgacagagaggccagcctggagctgatcaagctggacatcagcagaaccttccccagcctgtacatcttccagaagggcggcccctaccacgacgtgctgcacagcatcctgggcgcctacacctgctacagacccgacgtgggctacgtgcagggcatgagcttcatcgccgccgtgctgatcctgaacctggaggaggccgacgccttcatcgccttcgccaacctgctgaacaagccctgccagctggccttcttcagagtggaccacagcatgatgctgaagtacttcgccaccttcgaggtgttcttcgaggagaacctgagcaagctgttcctgcacttcaagagctacagcctgacccccgacatctacctgatcgactggatcttcaccctgtacagcaagagcctgcccctggacctggcctgcagagtgtgggacgtgttctgcagagacggcgaggagttcctgttcagaaccggcctgggcatcctgagactgtacgaggacatcctgctgcagatggacttcatccacatcgcccagttcctgaccaagctgcccgaggacatcaccagcgagaagctgttcagctgcatcgccgccatccagatgcagaacagcaccaagaagtggacccaggtgttcgccagcgtgatgaaggacatcaaggagggcgacaagaacagcagccccgccctgaagagctag

SEQ ID NO: 10072 - DNA, 276 bp, Artificial Sequence
  Description of Artificial Sequence: Synthetic coding sequence
atgaaggtgagcgccgccgccctggccgtgatcctgatcgccaccgccctgtgcgcccccgccagcgccagcccctacagcagcgacaccaccccctgctgcttcgcctacatcgccagacccctgcccagagcccacatcaaggagtacttctacaccagcggcaagtgcagcaaccccgccgtggtgttcgtgaccagaaagaacagacaggtgtgcgccaaccccgagaagaagtgggtgagagagtacatcaacagcctggagatgagctag

SEQ ID NO: 10073 - DNA, 276 bp, Artificial Sequence; identical to SEQ ID NO: 10072
  Description of Artificial Sequence: Synthetic coding sequence

SEQ ID NO: 10074 - DNA, 300 bp, Artificial Sequence
  Description of Artificial Sequence: Synthetic coding sequence
atgaaggccagcgccgccctgctgtgcctgctgctgaccgccgccgccttcagcccccagggcctggcccagcccgtgggcatcaacaccagcaccacctgctgctacagattcatcaacaagaagatccccaagcagagactggagagctacagaagaaccaccagcagccactgccccagagaggccgtgatcttcaagaccaagctggacaaggagatctgcgccgaccccacccagaagtgggtgcaggacttcatgaagcacctggacaagaagacccagacccccaagctgtag

SEQ ID NO: 10075 - DNA, 330 bp, Artificial Sequence
  Description of Artificial Sequence: Synthetic coding sequence
atgtggaagcccatgcccagccccagcaacatgaaggccagcgccgccctgctgtgcctgctgctgaccgccgccgccttcagcccccagggcctggcccagcccgtgggcatcaacaccagcaccacctgctgctacagattcatcaacaagaagatccccaagcagagactggagagctacagaagaaccaccagcagccactgccccagagaggccgtgatcttcaagaccaagctggacaaggagatctgcgccgaccccacccagaagtgggtgcaggacttcatgaagcacctggacaagaagacccagacccccaagctgtag

SEQ ID NO: 10076 - DNA, 276 bp, Artificial Sequence
  Description of Artificial Sequence: Synthetic coding sequence
atgtggaagcccatgcccagccccagcaacatgaaggccagcgccgccctgctgtgcctgctgctgaccgccgccgccttcagcccccagggcctggcccagcccgagagacccagaacccacccccagtggaccttcctgctggtggtgagcctgcagctgggcctgatcctgcagctgcccgccgccaccgacctgagcatcagaaagagcctgagcagaggctggagagccaccgagggcccccccgtggccaccgtgcccggcaagctgtag

SEQ ID NO: 10077 - DNA, 174 bp, Artificial Sequence
  Description of Artificial Sequence: Synthetic coding sequence
atgtggaagcccatgcccagccccagcaacatgaaggccagcgccgccctgctgtgcctgctgctgaccgccgccgccttcagcccccagggcctggcccagcccgccagcagacccaactggaccagaagaagcgtgctgaccccccacagaagcggcagcagaaccctgtag

SEQ ID NO: 10078 - DNA, 297 bp, Artificial Sequence
  Description of Artificial Sequence: Synthetic coding sequence
atgaaccagaccgccatcctgatctgctgcctgatcttcctgaccctgagcggcatccagggcgtgcccctgagcagaaccgtgagatgcacctgcatcagcatcagcaaccagcccgtgaaccccagaagcctggagaagctggagatcatccccgccagccagttctgccccagagtggagatcatcgccaccatgaagaagaagggcgagaagagatgcctgaaccccgagagcaaggccatcaagaacctgctgaaggccgtgagcaaggagagaagcaagagaagcccctag

SEQ ID NO: 10079 - DNA, 270 bp, Artificial Sequence
  Description of Artificial Sequence: Synthetic coding sequence
atgaacgccaaggtggtggtggtgctggtgctggtgctgaccgccctgtgcctgagcgacggcaagcccgtgagcctgagctacagatgcccctgcagattcttcgagagccacgtggccagagccaacgtgaagcacctgaagatcctgaacacccccaactgcgccctgcagatcgtggccagactgaagaacaacaacagacaggtgtgcatcgaccccaagctgaagtggatccaggagtacctggagaaggccctgaacaagtag

SEQ ID NO: 10080 - DNA, 360 bp, Artificial Sequence
  Description of Artificial Sequence: Synthetic coding sequence
atgaacgccaaggtggtggtggtgctggtgctggtgctgaccgccctgtgcctgagcgacggcaagcccgtgagcctgagctacagatgcccctgcagattcttcgagagccacgtggccagagccaacgtgaagcacctgaagatcctgaacacccccaactgcgccctgcagatcgtggccagactgaagaacaacaacagacaggtgtgcatcgaccccaagctgaagtggatccaggagtacctggagaaggccctgaacaagggcagaagagaggagaaggtgggcaagaaggagaagatcggcaagaagaagagacagaagaagagaaaggccgcccagaagagaaagaactag

SEQ ID NO: 10081 - DNA, 282 bp, Artificial Sequence
  Description of Artificial Sequence: Synthetic coding sequence
atgaacgccaaggtggtggtggtgctggtgctggtgctgaccgccctgtgcctgagcgacggcaagcccgtgagcctgagctacagatgcccctgcagattcttcgagagccacgtggccagagccaacgtgaagcacctgaagatcctgaacacccccaactgcgccctgcagatcgtggccagactgaagaacaacaacagacaggtgtgcatcgaccccaagctgaagtggatccaggagtacctggagaaggccctgaacaagagattcaagatgtag

SEQ ID NO: 10082 - DNA, 423 bp, Artificial Sequence
  Description of Artificial Sequence: Synthetic coding sequence
atgaacgccaaggtggtggtggtgctggtgctggtgctgaccgccctgtgcctgagcgacggcaagcccgtgagcctgagctacagatgcccctgcagattcttcgagagccacgtggccagagccaacgtgaagcacctgaagatcctgaacacccccaactgcgccctgcagatcgtggccagactgaagaacaacaacagacaggtgtgcatcgaccccaagctgaagtggatccaggagtacctggagaaggccctgaacaacctgatcagcgccgcccccgccggcaagagagtgatcgccggcgccagagccctgcaccccagcccccccagagcctgccccaccgccagagccctgtgcgagatcagactgtggcccccccccgagtggagctggcccagccccggcgacgtgtag

SEQ ID NO: 10083 - DNA, 273 bp, Artificial Sequence
  Description of Artificial Sequence: Synthetic coding sequence
atgaacgccaaggtggtggtggtgctggtgctggtgctgaccgccctgtgcctgagcgacggcaagcccgtgagcctgagctacagatgcccctgcagattcttcgagagccacgtggccagagccaacgtgaagcacctgaagatcctgaacacccccaactgcgccctgcagatcgtggccagactgaagaacaacaacagacaggtgtgcatcgaccccaagctgaagtggatccaggagtacctggagaaggccctgaacaactgctag

SEQ ID NO: 10084 - DNA, 330 bp, Artificial Sequence
  Description of Artificial Sequence: Synthetic coding sequence
atgaagttcatcagcaccagcctgctgctgatgctgctggtgagcagcctgagccccgtgcagggcgtgctggaggtgtactacaccagcctgagatgcagatgcgtgcaggagagcagcgtgttcatccccagaagattcatcgacagaatccagatcctgcccagaggcaacggctgccccagaaaggagatcatcgtgtggaagaagaacaagagcatcgtgtgcgtggacccccaggccgagtggatccagagaatgatggaggtgctgagaaagagaagcagcagcaccctgcccgtgcccgtgttcaagagaaagatcccctag

SEQ ID NO: 10085 - DNA, 1560 bp, Artificial Sequence
  Description of Artificial Sequence: Synthetic coding sequence
atgttcctgctgcccctgcccgccgccggcagagtggtggtgagaagactggccgtgagaagattcggcagcagaagcctgagcaccgccgacatgaccaagggcctggtgctgggcatctacagcaaggagaaggaggacgacgtgccccagttcaccagcgccggcgagaacttcgacaagctgctggccggcaagctgagagagaccctgaacatcagcggcccccccctgaaggccggcaagaccagaaccttctacggcctgcaccaggacttccccagcgtggtgctggtgggcctgggcaagaaggccgccggcatcgacgagcaggagaactggcacgagggcaaggagaacatcagagccgccgtggccgccggctgcagacagatccaggacctggagctgagcagcgtggaggtggacccctgcggcgacgcccaggccgccgccgagggcgccgtgctgggcctgtacgagtacgacgacctgaagcagaagaagaagatggccgtgagcgccaagctgtacggcagcggcgaccaggaggcctggcagaagggcgtgctgttcgccagcggccagaacctggccagacagctgatggagacccccgccaacgagatgacccccaccagattcgccgagatcatcgagaagaacctgaagagcgccagcagcaagaccgaggtgcacatcagacccaagagctggatcgaggagcaggccatgggcagcttcctgagcgtggccaagggcagcgacgagccccccgtgttcctggagatccactacaagggcagccccaacgccaacgagccccccctggtgttcgtgggcaagggcatcaccttcgacagcggcggcatcagcatcaaggccagcgccaacatggacctgatgagagccgacatgggcggcgccgccaccatctgcagcgccatcgtgagcgccgccaagctgaacctgcccatcaacatcatcggcctggcccccctgtgcgagaacatgcccagcggcaaggccaacaagcccggcgacgtggtgagagccaagaacggcaagaccatccaggtggacaacaccgacgccgagggcagactgatcctggccgacgccctgtgctacgcccacaccttcaaccccaaggtgatcctgaacgccgccaccctgaccggcgccatggacgtggccctgggcagcggcgccaccggcgtgttcaccaacagcagctggctgtggaacaagctgttcgaggccagcatcgagaccggcgacagagtgtggagaatgcccctgttcgagcactacaccagacaggtggtggactgccagctggccgacgtgaacaacatcggcaagtacagaagcgccggcgcctgcaccgccgccgccttcctgaaggagttcgtgacccaccccaagtgggcccacctggacatcgccggcgtgatgaccaacaaggacgaggtgccctacctgagaaagggcatgaccggcagacccaccagaaccctgatcgagttcctgctgagattcagccaggacaacgcctag

SEQ ID NO: 10086 - DNA, 378 bp, Artificial Sequence
  Description of Artificial Sequence: Synthetic coding sequence
atgaagaagagcggcgtgctgttcctgctgggcatcatcctgctggtgctgatcggcgtgcagggcacccccgtggtgagaaagggcagatgcagctgcatcagcaccaaccagggcaccatccacctgcagagcctgaaggacctgaagcagttcgcccccagccccagctgcgagaagatcgagatcatcgccaccctgaagaacggcgtgcagacctgcctgaaccccgacagcgccgacgtgaaggagctgatcaagaagtgggagaagcaggtgagccagaagaagaagcagaagaacggcaagaagcaccagaagaagaaggtgctgaaggtgagaaagagccagagaagcagacagaagaagaccacctag

SEQ ID NO: 10087 - DNA, 1083 bp, Artificial Sequence
  Description of Artificial Sequence: Synthetic coding sequence
atggaggacttcaacatggagagcgacagcttcgaggacttctggaagggcgaggacctgagcaactacagctacagcagcaccctgccccccttcctgctggacgccgccccctgcgagcccgagagcctggagatcaacaagtacttcgtggtgatcatctacgccctggtgttcctgctgagcctgctgggcaacagcctggtgatgctggtgatcctgtacagcagagtgggcagaagcgtgaccgacgtgtacctgctgaacctggccctggccgacctgctgttcgccctgaccctgcccatctgggccgccagcaaggtgaacggctggatcttcggcaccttcctgtgcaaggtggtgagcctgctgaaggaggtgaacttctacagcggcatcctgctgctggcctgcatcagcgtggacagatacctggccatcgtgcacgccaccagaaccctgacccagaagagatacctggtgaagttcatctgcctgagcatctggggcctgagcctgctgctggccctgcccgtgctgctgttcagaagaaccgtgtacagcagcaacgtgagccccgcctgctacgaggacatgggcaacaacaccgccaactggagaatgctgctgagaatcctgccccagagcttcggcttcatcgtgcccctgctgatcatgctgttctgctacggcttcaccctgagaaccctgttcaaggcccacatgggccagaagcacagagccatgagagtgatcttcgccgtggtgctgatcttcctgctgtgctggctgccctacaacctggtgctgctggccgacaccctgatgagaacccaggtgatccaggagacctgcgagagaagaaaccacatcgacagagccctggacgccaccgagatcctgggcatcctgcacagctgcctgaaccccctgatctacgccttcatcggccagaagttcagacacggcctgctgaagatcctggccatccacggcctgatcagcaaggacagcctgcccaaggacagcagacccagcttcgtgggcagcagcagcggccacaccagcaccaccctgtag

SEQ ID NO: 10088 - DNA, 417 bp, Artificial Sequence
  Description of Artificial Sequence: Synthetic coding sequence
atggaggacttcaacatggagagcgacagcttcgaggacttctggaagggcgaggacctgagcaactacagctacagcagcaccctgccccccttcctgctggacgccgccccctgcgagcccgagagcctggagatcaacaagtacttcgtggtgatcatctacgccctggtgttcctgctgagcctgctgggcaacagcctggtgatgctggtgatcctgtacagcagagtgggcagaagcgtgaccgacgtgtacctgctgaacctggccctggccgacctgctgttcgccctgaccctgcccatctgggccgccagcaaggtgaacggctggatcttcggcaccttcctgtgcaaggtggtgagcctgctgaaggaggtgaacttctacagcggcatcctgctgctggcctag

SEQ ID NO: 10089 - DNA, 48 bp, Artificial Sequence
  Description of Artificial Sequence: Synthetic coding sequence
atggaggacttcaacatggagagcgacagcttcgaggacttctggtag

SEQ ID NO: 10090 - DNA, 519 bp, Artificial Sequence
  Description of Artificial Sequence: Synthetic coding sequence
atggaggacttcaacatggagagcgacagcttcgaggacttctggaagggcgaggacctgagcaactacagctacagcagcaccctgccccccttcctgctggacgccgccccctgcgagcccgagagcctggagatcaacaagtacttcgtggtgatcatctacgccctggtgttcctgctgagcctgctgggcaacagcctggtgatgctggtgatcctgtacagcagagtgggcagaagcgtgaccgacgtgtacctgctgaacctggccctggccgacctgctgttcgccctgaccctgcccatctgggccgccagcaaggtgaacggctggatcttcggcaccttcctgtgcaaggtggtgagcctgctgaaggaggtgaacttctacagcggcatcctgctgctggcctgcatcagcgtggacagatacctggccatcgtgcacgccaccagaaccctgacccagaagagatacctggtgaagttcatctgcctgagcatctggggcctgtag

SEQ ID NO: 10091 - DNA, 48 bp, Artificial Sequence; identical to SEQ ID NO: 10089
  Description of Artificial Sequence: Synthetic coding sequence

SEQ ID NO: 10092 - DNA, 606 bp, Artificial Sequence
  Description of Artificial Sequence: Synthetic coding sequence
atggaggacttcaacatggagagcgacagcttcgaggacttctggaagggcgaggacctgagcaactacagctacagcagcaccctgccccccttcctgctggacgccgccccctgcgagcccgagagcctggagatcaacaagtacttcgtggtgatcatctacgccctggtgttcctgctgagcctgctgggcaacagcctggtgatgctggtgatcctgtacagcagagtgggcagaagcgtgaccgacgtgtacctgctgaacctggccctggccgacctgctgttcgccctgaccctgcccatctgggccgccagcaaggtgaacggctggatcttcggcaccttcctgtgcaaggtggtgagcctgctgaaggaggtgaacttctacagcggcatcctgctgctggcctgcatcagcgtggacagatacctggccatcgtgcacgccaccagaaccctgacccagaagagatacctggtgaagttcatctgcctgagcatctggggcctgagcctgctgctggccctgcccgtgctgctgttcagaagaaccgtgtacagcagcaacgtgagccccgcctgctacgaggacatgggctag

SEQ ID NO: 10093 - DNA, 411 bp, Artificial Sequence
  Description of Artificial Sequence: Synthetic coding sequence
atggaggacttcaacatggagagcgacagcttcgaggacttctggaagggcgaggacctgagcaactacagctacagcagcaccctgccccccttcctgctggacgccgccccctgcgagcccgagagcctggagatcaacaagtacttcgtggtgatcatctacgccctggtgttcctgctgagcctgctgggcaacagcctggtgatgctggtgatcctgtacagcagagtgggcagaagcgtgaccgacgtgtacctgctgaacctggccctggccgacctgctgttcgccctgaccctgcccatctgggccgccagcaaggtgaacggctggatcttcggcaccttcctgtgcaaggtggtgagcctgctgaaggaggtgaacttctacagcggcatcctgctgtag

SEQ ID NO: 10094 - DNA, 1059 bp, Artificial Sequence
  Description of Artificial Sequence: Synthetic coding sequence
atggagggcatcagcatctacaccagcgacaactacaccgaggagatgggcagcggcgactacgacagcatgaaggagccctgcttcagagaggagaacgccaacttcaacaagatcttcctgcccaccatctacagcatcatcttcctgaccggcatcgtgggcaacggcctggtgatcctggtgatgggctaccagaagaagctgagaagcatgaccgacaagtacagactgcacctgagcgtggccgacctgctgttcgtgatcaccctgcccttctgggccgtggacgccgtggccaactggtacttcggcaacttcctgtgcaaggccgtgcacgtgatctacaccgtgaacctgtacagcagcgtgctgatcctggccttcatcagcctggacagatacctggccatcgtgcacgccaccaacagccagagacccagaaagctgctggccgagaaggtggtgtacgtgggcgtgtggatccccgccctgctgctgaccatccccgacttcatcttcgccaacgtgagcgaggccgacgacagatacatctgcgacagattctaccccaacgacctgtgggtggtggtgttccagttccagcacatcatggtgggcctgatcctgcccggcatcgtgatcctgagctgctactgcatcatcatcagcaagctgagccacagcaagggccaccagaagagaaaggccctgaagaccaccgtgatcctgatcctggccttcttcgcctgctggctgccctactacatcggcatcagcatcgacagcttcatcctgctggagatcatcaagcagggctgcgagttcgagaacaccgtgcacaagtggatcagcatcaccgaggccctggccttcttccactgctgcctgaaccccatcctgtacgccttcctgggcgccaagttcaagaccagcgcccagcacgccctgaccagcgtgagcagaggcagcagcctgaagatcctgagcaagggcaagagaggcggccacagcagcgtgagcaccgagagcgagagcagcagcttccacagcagctag

SEQ ID NO: 10095 - DNA, 1071 bp, Artificial Sequence
  Description of Artificial Sequence: Synthetic coding sequence
atgagcatccccctgcccctgctgcagatctacaccagcgacaactacaccgaggagatgggcagcggcgactacgacagcatgaaggagccctgcttcagagaggagaacgccaacttcaacaagatcttcctgcccaccatctacagcatcatcttcctgaccggcatcgtgggcaacggcctggtgatcctggtgatgggctaccagaagaagctgagaagcatgaccgacaagtacagactgcacctgagcgtggccgacctgctgttcgtgatcaccctgcccttctgggccgtggacgccgtggccaactggtacttcggcaacttcctgtgcaaggccgtgcacgtgatctacaccgtgaacctgtacagcagcgtgctgatcctggccttcatcagcctggacagatacctggccatcgtgcacgccaccaacagccagagacccagaaagctgctggccgagaaggtggtgtacgtgggcgtgtggatccccgccctgctgctgaccatccccgacttcatcttcgccaacgtgagcgaggccgacgacagatacatctgcgacagattctaccccaacgacctgtgggtggtggtgttccagttccagcacatcatggtgggcctgatcctgcccggcatcgtgatcctgagctgctactgcatcatcatcagcaagctgagccacagcaagggccaccagaagagaaaggccctgaagaccaccgtgatcctgatcctggccttcttcgcctgctggctgccctactacatcggcatcagcatcgacagcttcatcctgctggagatcatcaagcagggctgcgagttcgagaacaccgtgcacaagtggatcagcatcaccgaggccctggccttcttccactgctgcctgaaccccatcctgtacgccttcctgggcgccaagttcaagaccagcgcccagcacgccctgaccagcgtgagcagaggcagcagcctgaagatcctgagcaagggcaagagaggcggccacagcagcgtgagcaccgagagcgagagcagcagcttccacagcagctag

SEQ ID NO: 10096 - DNA, 669 bp, Artificial Sequence
  Description of Artificial Sequence: Synthetic coding sequence
atgccctggcagaccggcaccctgggcaccagctacgccagacagagcatgagcagcacccagagcaccagcaccgccgtgagcagcagctggatccccgccctgctgctgaccatccccgacttcatcttcgccaacgtgagcgaggccgacgacagatacatctgcgacagattctaccccaacgacctgtgggtggtggtgttccagttccagcacatcatggtgggcctgatcctgcccggcatcgtgatcctgagctgctactgcatcatcatcagcaagctgagccacagcaagggccaccagaagagaaaggccctgaagaccaccgtgatcctgatcctggccttcttcgcctgctggctgccctactacatcggcatcagcatcgacagcttcatcctgctggagatcatcaagcagggctgcgagttcgagaacaccgtgcacaagtggatcagcatcaccgaggccctggccttcttccactgctgcctgaaccccatcctgtacgccttcctgggcgccaagttcaagaccagcgcccagcacgccctgaccagcgtgagcagaggcagcagcctgaagatcctgagcaagggcaagagaggcggccacagcagcgtgagcaccgagagcgagagcagcagcttccacagcagctag

SEQ ID NO: 10097 - DNA, 2832 bp, Artificial Sequence
  Description of Artificial Sequence: Synthetic coding sequence
atgacccagagaagcatcgccggccccatctgcaacctgaagttcgtgaccctgctggtggccctgagcagcgagctgcccttcctgggcgccggcgtgcagctgcaggacaacggctacaacggcctgctgatcgccatcaacccccaggtgcccgagaaccagaacctgatcagcaacatcaaggagatgatcaccgaggccagcttctacctgttcaacgccaccaagagaagagtgttcttcagaaacatcaagatcctgatccccgccacctggaaggccaacaacaacagcaagatcaagcaggagagctacgagaaggccaacgtgatcgtgaccgactggtacggcgcccacggcgacgacccctacaccctgcagtacagaggctgcggcaaggagggcaagtacatccacttcacccccaacttcctgctgaacgacaacctgaccgccggctacggcagcagaggcagagtgttcgtgcacgagtgggcccacctgagatggggcgtgttcgacgagtacaacaacgacaagcccttctacatcaacggccagaaccagatcaaggtgaccagatgcagcagcgacatcaccggcatcttcgtgtgcgagaagggcccctgcccccaggagaactgcatcatcagcaagctgttcaaggagggctgcaccttcatctacaacagcacccagaacgccaccgccagcatcatgttcatgcagagcctgagcagcgtggtggagttctgcaacgccagcacccacaaccaggaggcccccaacctgcagaaccagatgtgcagcctgagaagcgcctgggacgtgatcaccgacagcgccgacttccaccacagcttccccatgaacggcaccgagctgccccccccccccaccttcagcctggtgcaggccggcgacaaggtggtgtgcctggtgctggacgtgagcagcaagatggccgaggccgacagactgctgcagctgcagcaggccgccgagttctacctgatgcagatcgtggagatccacaccttcgtgggcatcgccagcttcgacagcaagggcgagatcagagcccagctgcaccagatcaacagcaacgacgacagaaagctgctggtgagctacctgcccaccaccgtgagcgccaagaccgacatcagcatctgcagcggcctgaagaagggcttcgaggtggtggagaagctgaacggcaaggcctacggcagcgtgatgatcctggtgaccagcggcgacgacaagctgctgggcaactgcctgcccaccgtgctgagcagcggcagcaccatccacagcatcgccctgggcagcagcgccgcccccaacctggaggagctgagcagactgaccggcggcctgaagttcttcgtgcccgacatcagcaacagcaacagcatgatcgacgccttcagcagaatcagcagcggcaccggcgacatcttccagcagcacatccagctggagagcaccggcgagaacgtgaagccccaccaccagctgaagaacaccgtgaccgtggacaacaccgtgggcaacgacaccatgttcctggtgacctggcaggccagcggcccccccgagatcatcctgttcgaccccgacggcagaaagtactacaccaacaacttcatcaccaacctgaccttcagaaccgccagcctgtggatccccggcaccgccaagcccggccactggacctacaccctgaacaacacccaccacagcctgcaggccctgaaggtgaccgtgaccagcagagccagcaacagcgccgtgccccccgccaccgtggaggccttcgtggagagagacagcctgcacttcccccaccccgtgatgatctacgccaacgtgaagcagggcttctaccccatcctgaacgccaccgtgaccgccaccgtggagcccgagaccggcgaccccgtgaccctgagactgctggacgacggcgccggcgccgacgtgatcaagaacgacggcatctacagcagatacttcttcagcttcgccgccaacggcagatacagcctgaaggtgcacgtgaaccacagccccagcatcagcacccccgcccacagcatccccggcagccacgccatgtacgtgcccggctacaccgccaacggcaacatccagatgaacgcccccagaaagagcgtgggcagaaacgaggaggagagaaagtggggcttcagcagagtgagcagcggcggcagcttcagcgtgctgggcgtgcccgccggcccccaccccgacgtgttccccccctgcaagatcatcgacctggaggccgtgaaggtggaggaggagctgaccctgagctggaccgcccccggcgaggacttcgaccagggccaggccaccagctacgagatcagaatgagcaagagcctgcagaacatccaggacgacttcaacaacgccatcctggtgaacaccagcaagagaaacccccagcaggccggcatcagagagatcttcaccttcagcccccagatcagcaccaacggccccgagcaccagcccaacggcgagacccacgagagccacagaatctacgtggccatcagagccatggacagaaacagcctgcagagcgccgtgagcaacatcgcccaggcccccctgttcatcccccccaacagcgaccccgtgcccgccagagactacctgatcctgaagggcgtgctgaccgccatgggcctgatcggcatcatctgcctgatcatcgtggtgacccaccacaccctgagcagaaagaagagagccgacaagaaggagaacggcaccaagctgctgtag

SEQ ID NO: 10098 - DNA, 423 bp, Artificial Sequence
  Description of Artificial Sequence: Synthetic coding sequence
atgacccagagaagcatcgccggccccatctgcaacctgaagttcgtgaccctgctggtggccctgagcagcgagctgcccttcctgggcgccggcgtgcagctgcaggacaacggctacaacggcctgctgatcgccatcaacccccaggtgcccgagaaccagaacctgatcagcaacatcaaggagatgatcaccgaggccagcttctacctgttcaacgccaccaagagaagagtgttcttcagaaacatcaagatcctgatccccgccacctggaaggccaacaacaacagcaagatcaagcaggagagctacgagaaggccaacgtgatcgtgaccgactggtacggcgcccacggcgacgaccagggcgtggagaagagagagaacaccttcatcagccacctgatcagctactag

SEQ ID NO: 10099 - DNA, 1233 bp, Artificial Sequence
  Description of Artificial Sequence: Synthetic coding sequence
atgaacgacgaggactacagcaccatctacgacaccatccagaacgagagaacctacgaggtgcccgaccagcccgaggagaacgagagcccccactacgacgacgtgcacgagtacctgagacccgagaacgacctgtacgccacccagctgaacacccacgagtacgacttcgtgagcgtgtacaccatcaagggcgaggagaccagcctggccagcgtgcagagcgaggacagaggctacctgctgcccgacgagatctacagcgagctgcaggaggcccaccccggcgagccccaggaggacagaggcatcagcatggagggcctgtacagcagcacccaggaccagcagctgtgcgccgccgagctgcaggagaacggcagcgtgatgaaggaggacctgcccagccccagcagcttcaccatccagcacagcaaggccttcagcaccaccaagtacagctgctacagcgacgccgagggcctggaggagaaggagggcgcccacatgaaccccgagatctacctgttcgtgaaggccggcatcgacggcgagagcatcggcaactgccccttcagccagagactgttcatgatcctgtggctgaagggcgtggtgttcaacgtgaccaccgtggacctgaagagaaagcccgccgacctgcacaacctggcccccggcacccacccccccttcctgaccttcaacggcgacgtgaagaccgacgtgaacaagatcgaggagttcctggaggagaccctgacccccgagaagtaccccaagctggccgccaagcacagagagagcaacaccgccggcatcgacatcttcagcaagttcagcgcctacatcaagaacaccaagcagcagaacaacgccgccctggagagaggcctgaccaaggccctgaagaagctggacgactacctgaacacccccctgcccgaggagatcgacgccaacacctgcggcgaggacaagggcagcagaagaaagttcctggacggcgacgagctgaccctggccgactgcaacctgctgcccaagctgcacgtggtgaagatcgtggccaagaagtacagaaactacgacatccccgccgagatgaccggcctgtggagatacctgaagaacgcctacgccagagacgagttcaccaacacctgcgccgccgacagcgagatcgagctggcctacgccgacgtggccaagagactgagcagaagctag

SEQ ID NO: 10100 - DNA, 756 bp, Artificial Sequence
  Description of Artificial Sequence: Synthetic coding sequence
atgaccgacagcgccaccgccaacggcgacgacagagaccccgagatcgagctgttcgtgaaggccggcatcgacggcgagagcatcggcaactgccccttcagccagagactgttcatgatcctgtggctgaagggcgtggtgttcaacgtgaccaccgtggacctgaagagaaagcccgccgacctgcacaacctggcccccggcacccacccccccttcctgaccttcaacggcgacgtgaagaccgacgtgaacaagatcgaggagttcctggaggagaccctgacccccgagaagtaccccaagctggccgccaagcacagagagagcaacaccgccggcatcgacatcttcagcaagttcagcgcctacatcaagaacaccaagcagcagaacaacgccgccctggagagaggcctgaccaaggccctgaagaagctggacgactacctgaacacccccctgcccgaggagatcgacgccaacacctgcggcgaggacaagggcagcagaagaaagttcctggacggcgacgagctgaccctggccgactgcaacctgctgcccaagctgcacgtggtgaagatcgtggccaagaagtacagaaactacgacatccccgccgagatgaccggcctgtggagatacctgaagaacgcctacgccagagacgagttcaccaacacctgcgccgccgacagcgagatcgagctggcctacgccgacgtggccaagagactgagcagaagctag

SEQ ID NO: 10101 - DNA, 618 bp, Artificial Sequence
  Description of Artificial Sequence: Synthetic coding sequence
atgaccgacagcgccaccgccaacggcgacgacagagaccccgagatcgagctgttcgtgaaggccggcatcgacggcgagagcatcggcaactgccccttcagccagagactgttcatgatcctgtggctgaagggcgtggtgttcaacgtgaccaccgtggacctgaagagaaagcccgccgacctgcacaacctggcccccggcacccacccccccttcctgaccttcaacggcgacgtgaagaccgacgtgaacaagatcgaggagttcctggaggagaccctgacccccgagaagtaccccaagctggccgccaagcacagagagagcaacaccgccggcatcgacatcttcagcaagttcagcgcctacatcaagaacaccaagcagcagaacaacgccgccctggagagaggcctgaccaaggccctgaagaagctggacgactacctgaacacccccctgcccgaggagatcgacgccaacacctgcggcgaggacaagggcagcagaagaaagttcctggacggcgacgagctgaccctggccgactgcaacctgctgcccaagctgcacgtggtgaaggagcaggtgcccctgaagggcatgatctag

SEQ ID NO: 10102 - DNA, 5823 bp, Artificial Sequence
  Description of Artificial Sequence: Synthetic coding sequence
atggccagcggcctgggcagccccagcccctgcagcgccggcagcgaggaggaggacatggacgccctgctgaacaacagcctgccccccccccaccccgagaacgaggaggaccccgaggaggacctgagcgagaccgagacccccaagctgaagaagaagaagaagcccaagaagcccagagaccccaagatccccaagagcaagagacagaagaaggagagaatgctgctgtgcagacagctgggcgacagcagcggcgagggccccgagttcgtggaggaggaggaggaggtggccctgagaagcgacagcgagggcagcgactacacccccggcaagaagaagaagaagaagctgggccccaagaaggagaagaagagcaagagcaagagaaaggaggaggaggaggaggaggacgacgacgacgacagcaaggagcccaagagcagcgcccagctgctggaggactggggcatggaggacatcgaccacgtgttcagcgaggaggactacagaaccctgaccaactacaaggccttcagccagttcgtgagacccctgatcgccgccaagaaccccaagatcgccgtgagcaagatgatgatggtgctgggcgccaagtggagagagttcagcaccaacaaccccttcaagggcagcagcggcgccagcgtggccgccgccgccgccgccgccgtggccgtggtggagagcatggtgaccgccaccgaggtggcccccccccccccccccgtggaggtgcccatcagaaaggccaagaccaaggagggcaagggccccaacgccagaagaaagcccaagggcagccccagagtgcccgacgccaagaagcccaagcccaagaaggtggcccccctgaagatcaagctgggcggcttcggcagcaagagaaagagaagcagcagcgaggacgacgacctggacgtggagagcgacttcgacgacgccagcatcaacagctacagcgtgagcgacggcagcaccagcagaagcagcagaagcagaaagaagctgagaaccaccaagaagaagaagaagggcgaggaggaggtgaccgccgtggacggctacgagaccgaccaccaggactactgcgaggtgtgccagcagggcggcgagatcatcctgtgcgacacctgccccagagcctaccacatggtgtgcctggaccccgacatggagaaggcccccgagggcaagtggagctgcccccactgcgagaaggagggcatccagtgggaggccaaggaggacaacagcgagggcgaggagatcctggaggaggtgggcggcgacctggaggaggaggacgaccaccacatggagttctgcagagtgtgcaaggacggcggcgagctgctgtgctgcgacacctgccccagcagctaccacatccactgcctgaacccccccctgcccgagatccccaacggcgagtggctgtgccccagatgcacctgccccgccctgaagggcaaggtgcagaagatcctgatctggaagtggggccagccccccagccccacccccgtgcccagaccccccgacgccgaccccaacacccccagccccaagcccctggagggcagacccgagagacagttcttcgtgaagtggcagggcatgagctactggcactgcagctgggtgagcgagctgcagctggagctgcactgccaggtgatgttcagaaactaccagagaaagaacgacatggacgagccccccagcggcgacttcggcggcgacgaggagaagagcagaaagagaaagaacaaggaccccaagttcgccgagatggaggagagattctacagatacggcatcaagcccgagtggatgatgatccacagaatcctgaaccacagcgtggacaagaagggccacgtgcactacctgatcaagtggagagacctgccctacgaccaggccagctgggagagcgaggacgtggagatccaggactacgacctgttcaagcagagctactggaaccacagagagctgatgagaggcgaggagggcagacccggcaagaagctgaagaaggtgaagctgagaaagctggagagaccccccgagacccccaccgtggaccccaccgtgaagtacgagagacagcccgagtacctggacgccaccggcggcaccctgcacccctaccagatggagggcctgaactggctgagattcagctgggcccagggcaccgacaccatcctggccgacgagatgggcctgggcaagaccgtgcagaccgccgtgttcctgtacagcctgtacaaggagggccacagcaagggccccttcctggtgagcgcccccctgagcaccatcatcaactgggagagagagttcgagatgtgggcccccgacatgtacgtggtgacctacgtgggcgacaaggacagcagagccatcatcagagagaacgagttcagcttcgaggacaacgccatcagaggcggcaagaaggccagcagaatgaagaaggaggccagcgtgaagttccacgtgctgctgaccagctacgagctgatcaccatcgacatggccatcctgggcagcatcgactgggcctgcctgatcgtggacgaggcccacagactgaagaacaaccagagcaagttcttcagagtgctgaacggctacagcctgcagcacaagctgctgctgaccggcacccccctgcagaacaacctggaggagctgttccacctgctgaacttcctgacccccgagagattccacaacctggagggcttcctggaggagttcgccgacatcgccaaggaggaccagatcaagaagctgcacgacatgctgggcccccacatgctgagaagactgaaggccgacgtgttcaagaacatgcccagcaagaccgagctgatcgtgagagtggagctgagccccatgcagaagaagtactacaagtacatcctgaccagaaacttcgaggccctgaacgccagaggcggcggcaaccaggtgagcctgctgaacgtggtgatggacctgaagaagtgctgcaaccacccctacctgttccccgtggccgccatggaggcccccaagatgcccaacggcatgtacgacggcagcgccctgatcagagccagcggcaagctgctgctgctgcagaagatgctgaagaacctgaaggagggcggccacagagtgctgatcttcagccagatgaccaagatgctggacctgctggaggacttcctggagcacgagggctacaagtacgagagaatcgacggcggcatcaccggcaacatgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagaagaagatgatgctgacccacctggtggtgagacccggcctgggcagcaagaccggcagcatgagcaagcaggagctggacgacatcctgaagttcggcaccgaggagctgttcaaggacgaggccaccgacggcggcggcgacaacaaggagggcgaggacagcagcgtgatccactacgacgacaaggccatcgagagactgctggacagaaaccaggacgagaccgaggacaccgagctgcagggcatgaacgagtacctgagcagcttcaaggtggcccagtacgtggtgagagaggaggagatgggcgaggaggaggaggtggagagagagatcatcaagcaggaggagagcgtggaccccgactactgggagaagctgctgagacaccactacgagcagcagcaggaggacctggccagaaacctgggcaagggcaagagaatcagaaagcaggtgaactacaacgacggcagccaggaggacagaggcgtgtgcggcagacccagacccccccccatgggcagaagcaccagagccgtgggccccgcccacctgcccagcctgccccccgactggcaggacgaccagagcgacaaccagagcgactacagcgtggccagcgaggagggcgacgaggacttcgacgagagaagcgaggcccccagaagacccagcagaaagggcctgagaaacgacaaggacaagcccctgccccccctgctggccagagtgggcggcaacatcgaggtgctgggcttcaacgccagacagagaaaggccttcctgaacgccatcatgagatacggcatgcccccccaggacgccttcaccacccagtggctggtgagagacctgagaggcaagagcgagaaggagttcaaggcctacgtgagcctgttcatgagacacctgtgcgagcccggcgccgacggcgccgagaccttcgccgacggcgtgcccagagagggcctgagcagacagcacgtgctgaccagaatcggcgtgatgagcctgatcagaaagaaggtgcaggagttcgagcacgtgaacggcagatggagcatgcccgagctggccgaggtggaggagaacaagaagatgagccagcccggcagccccagccccaagacccccacccccagcacccccggcgacacccagcccaacacccccgcccccgtgccccccgccgaggacggcatcaagatcgaggagaacagcctgaaggaggaggagagcatcgagggcgagaaggaggtgaagagcaccgcccccgagaccgccatcgagtgcacccaggcccccgcccccgccagcgaggacgagaaggtggtggtggagccccccgagggcgaggagaaggtggagaaggccgaggtgaaggagagaaccgaggagcccatggagaccgagcccaagggcgccgccgacgtggagaaggtggaggagaagagcgccatcgacctgacccccatcgtggtggaggacaaggaggagaagaaggaggaggaggagaagaaggaggtgatgctgcagaacggcgagacccccaaggacctgaacgacgagaagcagaagaagaacatcaagcagagattcatgttcaacatcgccgacggcggcttcaccgagctgcacagcctgtggcagaacgaggagagagccgccaccgtgaccaagaagacctacgagatctggcacagaagacacgactactggctgctggccggcatcatcaaccacggctacgccagatggcaggacatccagaacgaccccagatacgccatcctgaacgagcccttcaagggcgagatgaacagaggcaacttcctggagatcaagaacaagttcctggccagaagattcaagctgctggagcaggccctggtgatcgaggagcagctgagaagagccgcctacctgaacatgagcgaggaccccagccaccccagcatggccctgaacaccagattcgccgaggtggagtgcctggccgagagccaccagcacctgagcaaggagagcatggccggcaacaagcccgccaacgccgtgctgcacaaggtgctgaagcagctggaggagctgctgagcgacatgaaggccgacgtgaccagactgcccgccaccatcgccagaatcccccccgtggccgtgagactgcagatgagcgagagaaacatcctgagcagactggccaacagagcccccgagcccaccccccagcaggtggcccagcagcagtag

SEQ ID NO: 10103 - DNA, 5739 bp, Artificial Sequence
  Description of Artificial Sequence: Synthetic coding sequence
atggccagcggcctgggcagccccagcccctgcagcgccggcagcgaggaggaggacatggacgccctgctgaacaacagcctgccccccccccaccccgagaacgaggaggaccccgaggaggacctgagcgagaccgagacccccaagctgaagaagaagaagaagcccaagaagcccagagaccccaagatccccaagagcaagagacagaagaaggagagaatgctgctgtgcagacagctgggcgacagcagcggcgagggccccgagttcgtggaggaggaggaggaggtggccctgagaagcgacagcgagggcagcgactacacccccggcaagaagaagaagaagaagctgggccccaagaaggagaagaagagcaagagcaagagaaaggaggaggaggaggaggaggacgacgacgacgacagcaaggagcccaagagcagcgcccagctgctggaggactggggcatggaggacatcgaccacgtgttcagcgaggaggactacagaaccctgaccaactacaaggccttcagccagttcgtgagacccctgatcgccgccaagaaccccaagatcgccgtgagcaagatgatgatggtgctgggcgccaagtggagagagttcagcaccaacaaccccttcaagggcagcagcggcgccagcgtggccgccgccgccgccgccgccgtggccgtggtggagagcatggtgaccgccaccgaggtggcccccccccccccccccgtggaggtgcccatcagaaaggccaagaccaaggagggcaagggccccaacgccagaagaaagcccaagggcagccccagagtgcccgacgccaagaagcccaagcccaagaaggtggcccccctgaagatcaagctgggcggcttcggcagcaagagaaagagaagcagcagcgaggacgacgacctggacgtggagagcgacttcgacgacgccagcatcaacagctacagcgtgagcgacggcagcaccagcagaagcagcagaagcagaaagaagctgagaaccaccaagaagaagaagaagggcgaggaggaggtgaccgccgtggacggctacgagaccgaccaccaggactactgcgaggtgtgccagcagggcggcgagatcatcctgtgcgacacctgccccagagcctaccacatggtgtgcctggaccccgacatggagaaggcccccgagggcaagtggagctgcccccactgcgagaaggagggcatccagtgggaggccaaggaggacaacagcgagggcgaggagatcctggaggaggtgggcggcgacctggaggaggaggacgaccaccacatggagttctgcagagtgtgcaaggacggcggcgagctgctgtgctgcgacacctgccccagcagctaccacatccactgcctgaacccccccctgcccgagatccccaacggcgagtggctgtgccccagatgcacctgccccgccctgaagggcaaggtgcagaagatcctgatctggaagtggggccagccccccagccccacccccgtgcccagaccccccgacgccgaccccaacacccccagccccaagcccctggagggcagacccgagagacagttcttcgtgaagtggcagggcatgagctactggcactgcagctgggtgagcgagctgcagctggagctgcactgccaggtgatgttcagaaactaccagagaaagaacgacatggacgagccccccagcggcgacttcggcggcgacgaggagaagagcagaaagagaaagaacaaggaccccaagttcgccgagatggaggagagattctacagatacggcatcaagcccgagtggatgatgatccacagaatcctgaaccacagcgtggacaagaagggccacgtgcactacctgatcaagtggagagacctgccctacgaccaggccagctgggagagcgaggacgtggagatccaggactacgacctgttcaagcagagctactggaaccacagagagctgatgagaggcgaggagggcagacccggcaagaagctgaagaaggtgaagctgagaaagctggagagaccccccgagacccccaccgtggaccccaccgtgaagtacgagagacagcccgagtacctggacgccaccggcggcaccctgcacccctaccagatggagggcctgaactggctgagattcagctgggcccagggcaccgacaccatcctggccgacgagatgggcctgggcaagaccgtgcagaccgccgtgttcctgtacagcctgtacaaggagggccacagcaagggccccttcctggtgagcgcccccctgagcaccatcatcaactgggagagagagttcgagatgtgggcccccgacatgtacgtggtgacctacgtgggcgacaaggacagcagagccatcatcagagagaacgagttcagcttcgaggacaacgccatcagaggcggcaagaaggccagcagaatgaagaaggaggccagcgtgaagttccacgtgctgctgaccagctacgagctgatcaccatcgacatggccatcctgggcagcatcgactgggcctgcctgatcgtggacgaggcccacagactgaagaacaaccagagcaagttcttcagagtgctgaacggctacagcctgcagcacaagctgctgctgaccggcacccccctgcagaacaacctggaggagctgttccacctgctgaacttcctgacccccgagagattccacaacctggagggcttcctggaggagttcgccgacatcgccaaggaggaccagatcaagaagctgcacgacatgctgggcccccacatgctgagaagactgaaggccgacgtgttcaagaacatgcccagcaagaccgagctgatcgtgagagtggagctgagccccatgcagaagaagtactacaagtacatcctgaccagaaacttcgaggccctgaacgccagaggcggcggcaaccaggtgagcctgctgaacgtggtgatggacctgaagaagtgctgcaaccacccctacctgttccccgtggccgccatggaggcccccaagatgcccaacggcatgtacgacggcagcgccctgatcagagccagcggcaagctgctgctgctgcagaagatgctgaagaacctgaaggagggcggccacagagtgctgatcttcagccagatgaccaagatgctggacctgctggaggacttcctggagcacgagggctacaagtacgagagaatcgacggcggcatcaccggcaacatgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagaagaagatgatgctgacccacctggtggtgagacccggcctgggcagcaagaccggcagcatgagcaagcaggagctggacgacatcctgaagttcggcaccgaggagctgttcaaggacgaggccaccgacggcggcggcgacaacaaggagggcgaggacagcagcgtgatccactacgacgacaaggccatcgagagactgctggacagaaaccaggacgagaccgaggacaccgagctgcagggcatgaacgagtacctgagcagcttcaaggtggcccagtacgtggtgagagaggaggagatgggcgaggaggaggaggtggagagagagatcatcaagcaggaggagagcgtggaccccgactactgggagaagctgctgagacaccactacgagcagcagcaggaggacctggccagaaacctgggcaagggcaagagaatcagaaagcaggtgaactacaacgacggcagccaggaggacagagactggcaggacgaccagagcgacaaccagagcgactacagcgtggccagcgaggagggcgacgaggacttcgacgagagaagcgaggcccccagaagacccagcagaaagggcctgagaaacgacaaggacaagcccctgccccccctgctggccagagtgggcggcaacatcgaggtgctgggcttcaacgccagacagagaaaggccttcctgaacgccatcatgagatacggcatgcccccccaggacgccttcaccacccagtggctggtgagagacctgagaggcaagagcgagaaggagttcaaggcctacgtgagcctgttcatgagacacctgtgcgagcccggcgccgacggcgccgagaccttcgccgacggcgtgcccagagagggcctgagcagacagcacgtgctgaccagaatcggcgtgatgagcctgatcagaaagaaggtgcaggagttcgagcacgtgaacggcagatggagcatgcccgagctggccgaggtggaggagaacaagaagatgagccagcccggcagccccagccccaagacccccacccccagcacccccggcgacacccagcccaacacccccgcccccgtgccccccgccgaggacggcatcaagatcgaggagaacagcctgaaggaggaggagagcatcgagggcgagaaggaggtgaagagcaccgcccccgagaccgccatcgagtgcacccaggcccccgcccccgccagcgaggacgagaaggtggtggtggagccccccgagggcgaggagaaggtggagaaggccgaggtgaaggagagaaccgaggagcccatggagaccgagcccaagggcgccgccgacgtggagaaggtggaggagaagagcgccatcgacctgacccccatcgtggtggaggacaaggaggagaagaaggaggaggaggagaagaaggaggtgatgctgcagaacggcgagacccccaaggacctgaacgacgagaagcagaagaagaacatcaagcagagattcatgttcaacatcgccgacggcggcttcaccgagctgcacagcctgtggcagaacgaggagagagccgccaccgtgaccaagaagacctacgagatctggcacagaagacacgactactggctgctggccggcatcatcaaccacggctacgccagatggcaggacatccagaacgaccccagatacgccatcctgaacgagcccttcaagggcgagatgaacagaggcaacttcctggagatcaagaacaagttcctggccagaagattcaagctgctggagcaggccctggtgatcgaggagcagctgagaagagccgcctacctgaacatgagcgaggaccccagccaccccagcatggccctgaacaccagattcgccgaggtggagtgcctggccgagagccaccagcacctgagcaaggagagcatggccggcaacaagcccgccaacgccgtgctgcacaaggtgctgaagcagctggaggagctgctgagcgacatgaaggccgacgtgaccagactgcccgccaccatcgccagaatcccccccgtggccgtgagactgcagatgagcgagagaaacatcctgagcagactggccaacagagcccccgagcccaccccccagcaggtggcccagcagcagtag

SEQ ID NO: 10104 - DNA, 5661 bp, Artificial Sequence
  Description of Artificial Sequence: Synthetic coding sequence
atggacgccctgctgaacaacagcctgccccccccccaccccgagaacgaggaggaccccgaggaggacctgagcgagaccgagacccccaagctgaagaagaagaagaagcccaagaagcccagagaccccaagatccccaagagcaagagacagaagaaggagctgggcgacagcagcggcgagggccccgagttcgtggaggaggaggaggaggtggccctgagaagcgacagcgagggcagcgactacacccccggcaagaagaagaagaagaagctgggccccaagaaggagaagaagagcaagagcaagagaaaggaggaggaggaggaggaggacgacgacgacgacagcaaggagcccaagagcagcgcccagctgctggaggactggggcatggaggacatcgaccacgtgttcagcgaggaggactacagaaccctgaccaactacaaggccttcagccagttcgtgagacccctgatcgccgccaagaaccccaagatcgccgtgagcaagatgatgatggtgctgggcgccaagtggagagagttcagcaccaacaaccccttcaagggcagcagcggcgccagcgtggccgccgccgccgccgccgccgtggccgtggtggagagcatggtgaccgccaccgaggtggcccccccccccccccccgtggaggtgcccatcagaaaggccaagaccaaggagggcaagggccccaacgccagaagaaagcccaagggcagccccagagtgcccgacgccaagaagcccaagcccaagaaggtggcccccctgaagatcaagctgggcggcttcggcagcaagagaaagagaagcagcagcgaggacgacgacctggacgtggagagcgacttcgacgacgccagcatcaacagctacagcgtgagcgacggcagcaccagcagaagcagcagaagcagaaagaagctgagaaccaccaagaagaagaagaagggcgaggaggaggtgaccgccgtggacggctacgagaccgaccaccaggactactgcgaggtgtgccagcagggcggcgagatcatcctgtgcgacacctgccccagagcctaccacatggtgtgcctggaccccgacatggagaaggcccccgagggcaagtggagctgcccccactgcgagaaggagggcatccagtgggaggccaaggaggacaacagcgagggcgaggagatcctggaggaggtgggcggcgacctggaggaggaggacgaccaccacatggagttctgcagagtgtgcaaggacggcggcgagctgctgtgctgcgacacctgccccagcagctaccacatccactgcctgaacccccccctgcccgagatccccaacggcgagtggctgtgccccagatgcacctgccccgccctgaagggcaaggtgcagaagatcctgatctggaagtggggccagccccccagccccacccccgtgcccagaccccccgacgccgaccccaacacccccagccccaagcccctggagggcagacccgagagacagttcttcgtgaagtggcagggcatgagctactggcactgcagctgggtgagcgagctgcagctggagctgcactgccaggtgatgttcagaaactaccagagaaagaacgacatggacgagccccccagcggcgacttcggcggcgacgaggagaagagcagaaagagaaagaacaaggaccccaagttcgccgagatggaggagagattctacagatacggcatcaagcccgagtggatgatgatccacagaatcctgaaccacagcgtggacaagaagggccacgtgcactacctgatcaagtggagagacctgccctacgaccaggccagctgggagagcgaggacgtggagatccaggactacgacctgttcaagcagagctactggaaccacagagagctgatgagaggcgaggagggcagacccggcaagaagctgaagaaggtgaagctgagaaagctggagagaccccccgagacccccaccgtggaccccaccgtgaagtacgagagacagcccgagtacctggacgccaccggcggcaccctgcacccctaccagatggagggcctgaactggctgagattcagctgggcccagggcaccgacaccatcctggccgacgagatgggcctgggcaagaccgtgcagaccgccgtgttcctgtacagcctgtacaaggagggccacagcaagggccccttcctggtgagcgcccccctgagcaccatcatcaactgggagagagagttcgagatgtgggcccccgacatgtacgtggtgacctacgtgggcgacaaggacagcagagccatcatcagagagaacgagttcagcttcgaggacaacgccatcagaggcggcaagaaggccagcagaatgaagaaggaggccagcgtgaagttccacgtgctgctgaccagctacgagctgatcaccatcgacatggccatcctgggcagcatcgactgggcctgcctgatcgtggacgaggcccacagactgaagaacaaccagagcaagttcttcagagtgctgaacggctacagcctgcagcacaagctgctgctgaccggcacccccctgcagaacaacctggaggagctgttccacctgctgaacttcctgacccccgagagattccacaacctggagggcttcctggaggagttcgccgacatcgccaaggaggaccagatcaagaagctgcacgacatgctgggcccccacatgctgagaagactgaaggccgacgtgttcaagaacatgcccagcaagaccgagctgatcgtgagagtggagctgagccccatgcagaagaagtactacaagtacatcctgaccagaaacttcgaggccctgaacgccagaggcggcggcaaccaggtgagcctgctgaacgtggtgatggacctgaagaagtgctgcaaccacccctacctgttccccgtggccgccatggaggcccccaagatgcccaacggcatgtacgacggcagcgccctgatcagagccagcggcaagctgctgctgctgcagaagatgctgaagaacctgaaggagggcggccacagagtgctgatcttcagccagatgaccaagatgctggacctgctggaggacttcctggagcacgagggctacaagtacgagagaatcgacggcggcatcaccggcaacatgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagaagaagatgatgctgacccacctggtggtgagacccggcctgggcagcaagaccggcagcatgagcaagcaggagctggacgacatcctgaagttcggcaccgaggagctgttcaaggacgaggccaccgacggcggcggcgacaacaaggagggcgaggacagcagcgtgatccactacgacgacaaggccatcgagagactgctggacagaaaccaggacgagaccgaggacaccgagctgcagggcatgaacgagtacctgagcagcttcaaggtggcccagtacgtggtgagagaggaggagatgggcgaggaggaggaggtggagagagagatcatcaagcaggaggagagcgtggaccccgactactgggagaagctgctgagacaccactacgagcagcagcaggaggacctggccagaaacctgggcaagggcaagagaatcagaaagcaggtgaactacaacgacggcagccaggaggacagagactggcaggacgaccagagcgacaaccagagcgactacagcgtggccagcgaggagggcgacgaggacttcgacgagagaagcgaggcccccagaagacccagcagaaagggcctgagaaacgacaaggacaagcccctgccccccctgctggccagagtgggcggcaacatcgaggtgctgggcttcaacgccagacagagaaaggccttcctgaacgccatcatgagatacggcatgcccccccaggacgccttcaccacccagtggctggtgagagacctgagaggcaagagcgagaaggagttcaaggcctacgtgagcctgttcatgagacacctgtgcgagcccggcgccgacggcgccgagaccttcgccgacggcgtgcccagagagggcctgagcagacagcacgtgctgaccagaatcggcgtgatgagcctgatcagaaagaaggtgcaggagttcgagcacgtgaacggcagatggagcatgcccgagctggccgaggtggaggagaacaagaagatgagccagcccggcagccccagccccaagacccccacccccagcacccccggcgacacccagcccaacacccccgcccccgtgccccccgccgaggacggcatcaagatcgaggagaacagcctgaaggaggaggagagcatcgagggcgagaaggaggtgaagagcaccgcccccgagaccgccatcgagtgcacccaggcccccgcccccgccagcgaggacgagaaggtggtggtggagccccccgagggcgaggagaaggtggagaaggccgaggtgaaggagagaaccgaggagcccatggagaccgagcccaagggcgccgccgacgtggagaaggtggaggagaagagcgccatcgacctgacccccatcgtggtggaggacaaggaggagaagaaggaggaggaggagaagaaggaggtgatgctgcagaacggcgagacccccaaggacctgaacgacgagaagcagaagaagaacatcaagcagagattcatgttcaacatcgccgacggcggcttcaccgagctgcacagcctgtggcagaacgaggagagagccgccaccgtgaccaagaagacctacgagatctggcacagaagacacgactactggctgctggccggcatcatcaaccacggctacgccagatggcaggacatccagaacgaccccagatacgccatcctgaacgagcccttcaagggcgagatgaacagaggcaacttcctggagatcaagaacaagttcctggccagaagattcaagctgctggagcaggccctggtgatcgaggagcagctgagaagagccgcctacctgaacatgagcgaggaccccagccaccccagcatggccctgaacaccagattcgccgaggtggagtgcctggccgagagccaccagcacctgagcaaggagagcatggccggcaacaagcccgccaacgccgtgctgcacaaggtgctgaagcagctggaggagctgctgagcgacatgaaggccgacgtgaccagactgcccgccaccatcgccagaatcccccccgtggccgtgagactgcagatgagcgagagaaacatcctgagcagactggccaacagagcccccgagcccaccccccagcaggtggcccagcagcagtag

SEQ ID NO: 10105 - DNA, 5718 bp, Artificial Sequence
  Description of Artificial Sequence: Synthetic coding sequence
atggccagcggcctgggcagccccagcccctgcagcgccggcagcgaggaggaggacatggacgccctgctgaacaacagcctgccccccccccaccccgagaacgaggaggaccccgaggaggacctgagcgagaccgagacccccaagctgaagaagaagaagaagcccaagaagcccagagaccccaagatccccaagagcaagagacagaagaaggagctgggcgacagcagcggcgagggccccgagttcgtggaggaggaggaggaggtggccctgagaagcgacagcgagggcagcgactacacccccggcaagaagaagaagaagaagctgggccccaagaaggagaagaagagcaagagcaagagaaaggaggaggaggaggaggaggacgacgacgacgacagcaaggagcccaagagcagcgcccagctgctggaggactggggcatggaggacatcgaccacgtgttcagcgaggaggactacagaaccctgaccaactacaaggccttcagccagttcgtgagacccctgatcgccgccaagaaccccaagatcgccgtgagcaagatgatgatggtgctgggcgccaagtggagagagttcagcaccaacaaccccttcaagggcagcagcggcgccagcgtggccgccgccgccgccgccgccgtggccgtggtggagagcatggtgaccgccaccgaggtggcccccccccccccccccgtggaggtgcccatcagaaaggccaagaccaaggagggcaagggccccaacgccagaagaaagcccaagggcagccccagagtgcccgacgccaagaagcccaagcccaagaaggtggcccccctgaagatcaagctgggcggcttcggcagcaagagaaagagaagcagcagcgaggacgacgacctggacgtggagagcgacttcgacgacgccagcatcaacagctacagcgtgagcgacggcagcaccagcagaagcagcagaagcagaaagaagctgagaaccaccaagaagaagaagaagggcgaggaggaggtgaccgccgtggacggctacgagaccgaccaccaggactactgcgaggtgtgccagcagggcggcgagatcatcctgtgcgacacctgccccagagcctaccacatggtgtgcctggaccccgacatggagaaggcccccgagggcaagtggagctgcccccactgcgagaaggagggcatccagtgggaggccaaggaggacaacagcgagggcgaggagatcctggaggaggtgggcggcgacctggaggaggaggacgaccaccacatggagttctgcagagtgtgcaaggacggcggcgagctgctgtgctgcgacacctgccccagcagctaccacatccactgcctgaacccccccctgcccgagatccccaacggcgagtggctgtgccccagatgcacctgccccgccctgaagggcaaggtgcagaagatcctgatctggaagtggggccagccccccagccccacccccgtgcccagaccccccgacgccgaccccaacacccccagccccaagcccctggagggcagacccgagagacagttcttcgtgaagtggcagggcatgagctactggcactgcagctgggtgagcgagctgcagctggagctgcactgccaggtgatgttcagaaactaccagagaaagaacgacatggacgagccccccagcggcgacttcggcggcgacgaggagaagagcagaaagagaaagaacaaggaccccaagttcgccgagatggaggagagattctacagatacggcatcaagcccgagtggatgatgatccacagaatcctgaaccacagcgtggacaagaagggccacgtgcactacctgatcaagtggagagacctgccctacgaccaggccagctgggagagcgaggacgtggagatccaggactacgacctgttcaagcagagctactggaaccacagagagctgatgagaggcgaggagggcagacccggcaagaagctgaagaaggtgaagctgagaaagctggagagaccccccgagacccccaccgtggaccccaccgtgaagtacgagagacagcccgagtacctggacgccaccggcggcaccctgcacccctaccagatggagggcctgaactggctgagattcagctgggcccagggcaccgacaccatcctggccgacgagatgggcctgggcaagaccgtgcagaccgccgtgttcctgtacagcctgtacaaggagggccacagcaagggccccttcctggtgagcgcccccctgagcaccatcatcaactgggagagagagttcgagatgtgggcccccgacatgtacgtggtgacctacgtgggcgacaaggacagcagagccatcatcagagagaacgagttcagcttcgaggacaacgccatcagaggcggcaagaaggccagcagaatgaagaaggaggccagcgtgaagttccacgtgctgctgaccagctacgagctgatcaccatcgacatggccatcctgggcagcatcgactgggcctgcctgatcgtggacgaggcccacagactgaagaacaaccagagcaagttcttcagagtgctgaacggctacagcctgcagcacaagctgctgctgaccggcacccccctgcagaacaacctggaggagctgttccacctgctgaacttcctgacccccgagagattccacaacctggagggcttcctggaggagttcgccgacatcgccaaggaggaccagatcaagaagctgcacgacatgctgggcccccacatgctgagaagactgaaggccgacgtgttcaagaacatgcccagcaagaccgagctgatcgtgagagtggagctgagccccatgcagaagaagtactacaagtacatcctgaccagaaacttcgaggccctgaacgccagaggcggcggcaaccaggtgagcctgctgaacgtggtgatggacctgaagaagtgctgcaaccacccctacctgttccccgtggccgccatggaggcccccaagatgcccaacggcatgtacgacggcagcgccctgatcagagccagcggcaagctgctgctgctgcagaagatgctgaagaacctgaaggagggcggccacagagtgctgatcttcagccagatgaccaagatgctggacctgctggaggacttcctggagcacgagggctacaagtacgagagaatcgacggcggcatcaccggcaacatgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagaagaagatgatgctgacccacctggtggtgagacccggcctgggcagcaagaccggcagcatgagcaagcaggagctggacgacatcctgaagttcggcaccgaggagctgttcaaggacgaggccaccgacggcggcggcgacaacaaggagggcgaggacagcagcgtgatccactacgacgacaaggccatcgagagactgctggacagaaaccaggacgagaccgaggacaccgagctgcagggcatgaacgagtacctgagcagcttcaaggtggcccagtacgtggtgagagaggaggagatgggcgaggaggaggaggtggagagagagatcatcaagcaggaggagagcgtggaccccgactactgggagaagctgctgagacaccactacgagcagcagcaggaggacctggccagaaacctgggcaagggcaagagaatcagaaagcaggtgaactacaacgacggcagccaggaggacagagactggcaggacgaccagagcgacaaccagagcgactacagcgtggccagcgaggagggcgacgaggacttcgacgagagaagcgaggcccccagaagacccagcagaaagggcctgagaaacgacaaggacaagcccctgccccccctgctggccagagtgggcggcaacatcgaggtgctgggcttcaacgccagacagagaaaggccttcctgaacgccatcatgagatacggcatgcccccccaggacgccttcaccacccagtggctggtgagagacctgagaggcaagagcgagaaggagttcaaggcctacgtgagcctgttcatgagacacctgtgcgagcccggcgccgacggcgccgagaccttcgccgacggcgtgcccagagagggcctgagcagacagcacgtgctgaccagaatcggcgtgatgagcctgatcagaaagaaggtgcaggagttcgagcacgtgaacggcagatggagcatgcccgagctggccgaggtggaggagaacaagaagatgagccagcccggcagccccagccccaagacccccacccccagcacccccggcgacacccagcccaacacccccgcccccgtgccccccgccgaggacggcatcaagatcgaggagaacagcctgaaggaggaggagagcatcgagggcgagaaggaggtgaagagcaccgcccccgagaccgccatcgagtgcacccaggcccccgcccccgccagcgaggacgagaaggtggtggtggagccccccgagggcgaggagaaggtggagaaggccgaggtgaaggagagaaccgaggagcccatggagaccgagcccaagggcgccgccgacgtggagaaggtggaggagaagagcgccatcgacctgacccccatcgtggtggaggacaaggaggagaagaaggaggaggaggagaagaaggaggtgatgctgcagaacggcgagacccccaaggacctgaacgacgagaagcagaagaagaacatcaagcagagattcatgttcaacatcgccgacggcggcttcaccgagctgcacagcctgtggcagaacgaggagagagccgccaccgtgaccaagaagacctacgagatctggcacagaagacacgactactggctgctggccggcatcatcaaccacggctacgccagatggcaggacatccagaacgaccccagatacgccatcctgaacgagcccttcaagggcgagatgaacagaggcaacttcctggagatcaagaacaagttcctggccagaagattcaagctgctggagcaggccctggtgatcgaggagcagctgagaagagccgcctacctgaacatgagcgaggaccccagccaccccagcatggccctgaacaccagattcgccgaggtggagtgcctggccgagagccaccagcacctgagcaaggagagcatggccggcaacaagcccgccaacgccgtgctgcacaaggtgctgaagcagctggaggagctgctgagcgacatgaaggccgacgtgaccagactgcccgccaccatcgccagaatcccccccgtggccgtgagactgcagatgagcgagagaaacatcctgagcagactggccaacagagcccccgagcccaccccccagcaggtggcccagcagcagtag

SEQ ID NO: 10106 - DNA, 5814 bp, Artificial Sequence
  Description of Artificial Sequence: Synthetic coding sequence
atggccagcggcctgggcagccccagcccctgcagcgccggcagcgaggaggaggacatggacgccctgctgaacaacagcctgccccccccccaccccgaggaccccgaggaggacctgagcgagaccgagacccccaagctgaagaagaagaagaagcccaagaagcccagagaccccaagatccccaagagcaagagacagaagaaggagagaatgctgctgtgcagacagctgggcgacagcagcggcgagggccccgagttcgtggaggaggaggaggaggtggccctgagaagcgacagcgagggcagcgactacacccccggcaagaagaagaagaagaagctgggccccaagaaggagaagaagagcaagagcaagagaaaggaggaggaggaggaggaggacgacgacgacgacagcaaggagcccaagagcagcgcccagctgctggaggactggggcatggaggacatcgaccacgtgttcagcgaggaggactacagaaccctgaccaactacaaggccttcagccagttcgtgagacccctgatcgccgccaagaaccccaagatcgccgtgagcaagatgatgatggtgctgggcgccaagtggagagagttcagcaccaacaaccccttcaagggcagcagcggcgccagcgtggccgccgccgccgccgccgccgtggccgtggtggagagcatggtgaccgccaccgaggtggcccccccccccccccccgtggaggtgcccatcagaaaggccaagaccaaggagggcaagggccccaacgccagaagaaagcccaagggcagccccagagtgcccgacgccaagaagcccaagcccaagaaggtggcccccctgaagatcaagctgggcggcttcggcagcaagagaaagagaagcagcagcgaggacgacgacctggacgtggagagcgacttcgacgacgccagcatcaacagctacagcgtgagcgacggcagcaccagcagaagcagcagaagcagaaagaagctgagaaccaccaagaagaagaagaagggcgaggaggaggtgaccgccgtggacggctacgagaccgaccaccaggactactgcgaggtgtgccagcagggcggcgagatcatcctgtgcgacacctgccccagagcctaccacatggtgtgcctggaccccgacatggagaaggcccccgagggcaagtggagctgcccccactgcgagaaggagggcatccagtgggaggccaaggaggacaacagcgagggcgaggagatcctggaggaggtgggcggcgacctggaggaggaggacgaccaccacatggagttctgcagagtgtgcaaggacggcggcgagctgctgtgctgcgacacctgccccagcagctaccacatccactgcctgaacccccccctgcccgagatccccaacggcgagtggctgtgccccagatgcacctgccccgccctgaagggcaaggtgcagaagatcctgatctggaagtggggccagccccccagccccacccccgtgcccagaccccccgacgccgaccccaacacccccagccccaagcccctggagggcagacccgagagacagttcttcgtgaagtggcagggcatgagctactggcactgcagctgggtgagcgagctgcagctggagctgcactgccaggtgatgttcagaaactaccagagaaagaacgacatggacgagccccccagcggcgacttcggcggcgacgaggagaagagcagaaagagaaagaacaaggaccccaagttcgccgagatggaggagagattctacagatacggcatcaagcccgagtggatgatgatccacagaatcctgaaccacagcgtggacaagaagggccacgtgcactacctgatcaagtggagagacctgccctacgaccaggccagctgggagagcgaggacgtggagatccaggactacgacctgttcaagcagagctactggaaccacagagagctgatgagaggcgaggagggcagacccggcaagaagctgaagaaggtgaagctgagaaagctggagagaccccccgagacccccaccgtggaccccaccgtgaagtacgagagacagcccgagtacctggacgccaccggcggcaccctgcacccctaccagatggagggcctgaactggctgagattcagctgggcccagggcaccgacaccatcctggccgacgagatgggcctgggcaagaccgtgcagaccgccgtgttcctgtacagcctgtacaaggagggccacagcaagggccccttcctggtgagcgcccccctgagcaccatcatcaactgggagagagagttcgagatgtgggcccccgacatgtacgtggtgacctacgtgggcgacaaggacagcagagccatcatcagagagaacgagttcagcttcgaggacaacgccatcagaggcggcaagaaggccagcagaatgaagaaggaggccagcgtgaagttccacgtgctgctgaccagctacgagctgatcaccatcgacatggccatcctgggcagcatcgactgggcctgcctgatcgtggacgaggcccacagactgaagaacaaccagagcaagttcttcagagtgctgaacggctacagcctgcagcacaagctgctgctgaccggcacccccctgcagaacaacctggaggagctgttccacctgctgaacttcctgacccccgagagattccacaacctggagggcttcctggaggagttcgccgacatcgccaaggaggaccagatcaagaagctgcacgacatgctgggcccccacatgctgagaagactgaaggccgacgtgttcaagaacatgcccagcaagaccgagctgatcgtgagagtggagctgagccccatgcagaagaagtactacaagtacatcctgaccagaaacttcgaggccctgaacgccagaggcggcggcaaccaggtgagcctgctgaacgtggtgatggacctgaagaagtgctgcaaccacccctacctgttccccgtggccgccatggaggcccccaagatgcccaacggcatgtacgacggcagcgccctgatcagagccagcggcaagctgctgctgctgcagaagatgctgaagaacctgaaggagggcggccacagagtgctgatcttcagccagatgaccaagatgctggacctgctggaggacttcctggagcacgagggctacaagtacgagagaatcgacggcggcatcaccggcaacatgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagaagaagatgatgctgacccacctggtggtgagacccggcctgggcagcaagaccggcagcatgagcaagcaggagctggacgacatcctgaagttcggcaccgaggagctgttcaaggacgaggccaccgacggcggcggcgacaacaaggagggcgaggacagcagcgtgatccactacgacgacaaggccatcgagagactgctggacagaaaccaggacgagaccgaggacaccgagctgcagggcatgaacgagtacctgagcagcttcaaggtggcccagtacgtggtgagagaggaggagatgggcgaggaggaggaggtggagagagagatcatcaagcaggaggagagcgtggaccccgactactgggagaagctgctgagacaccactacgagcagcagcaggaggacctggccagaaacctgggcaagggcaagagaatcagaaagcaggtgaactacaacgacggcagccaggaggacagaggcgtgtgcggcagacccagacccccccccatgggcagaagcaccagagccgtgggccccgcccacctgcccagcctgccccccgactggcaggacgaccagagcgacaaccagagcgactacagcgtggccagcgaggagggcgacgaggacttcgacgagagaagcgaggcccccagaagacccagcagaaagggcctgagaaacgacaaggacaagcccctgccccccctgctggccagagtgggcggcaacatcgaggtgctgggcttcaacgccagacagagaaaggccttcctgaacgccatcatgagatacggcatgcccccccaggacgccttcaccacccagtggctggtgagagacctgagaggcaagagcgagaaggagttcaaggcctacgtgagcctgttcatgagacacctgtgcgagcccggcgccgacggcgccgagaccttcgccgacggcgtgcccagagagggcctgagcagacagcacgtgctgaccagaatcggcgtgatgagcctgatcagaaagaaggtgcaggagttcgagcacgtgaacggcagatggagcatgcccgagctggccgaggtggaggagaacaagaagatgagccagcccggcagccccagccccaagacccccacccccagcacccccggcgacacccagcccaacacccccgcccccgtgccccccgccgaggacggcatcaagatcgaggagaacagcctgaaggaggaggagagcatcgagggcgagaaggaggtgaagagcaccgcccccgagaccgccatcgagtgcacccaggcccccgcccccgccagcgaggacgagaaggtggtggtggagccccccgagggcgaggagaaggtggagaaggccgaggtgaaggagagaaccgaggagcccatggagaccgagcccaagggcgccgccgacgtggagaaggtggaggagaagagcgccatcgacctgacccccatcgtggtggaggacaaggaggagaagaaggaggaggaggagaagaaggaggtgatgctgcagaacggcgagacccccaaggacctgaacgacgagaagcagaagaagaacatcaagcagagattcatgttcaacatcgccgacggcggcttcaccgagctgcacagcctgtggcagaacgaggagagagccgccaccgtgaccaagaagacctacgagatctggcacagaagacacgactactggctgctggccggcatcatcaaccacggctacgccagatggcaggacatccagaacgaccccagatacgccatcctgaacgagcccttcaagggcgagatgaacagaggcaacttcctggagatcaagaacaagttcctggccagaagattcaagctgctggagcaggccctggtgatcgaggagcagctgagaagagccgcctacctgaacatgagcgaggaccccagccaccccagcatggccctgaacaccagattcgccgaggtggagtgcctggccgagagccaccagcacctgagcaaggagagcatggccggcaacaagcccgccaacgccgtgctgcacaaggtgctgaagcagctggaggagctgctgagcgacatgaaggccgacgtgaccagactgcccgccaccatcgccagaatcccccccgtggccgtgagactgcagatgagcgagagaaacatcctgagcagactggccaacagagcccccgagcccaccccccagcaggtggcccagcagcagtag

SEQ ID NO: 10107 - DNA, 1065 bp, Artificial Sequence
  Description of Artificial Sequence: Synthetic coding sequence
atggccagcggcctgggcagccccagcccctgcagcgccggcagcgaggaggaggacatggacgccctgctgaacaacagcctgccccccccccaccccgagaacgaggaggaccccgaggaggacctgagcgagaccgagacccccaagctgaagaagaagaagaagcccaagaagcccagagaccccaagatccccaagagcaagagacagaagaaggagagaatgctgctgtgcagacagctgggcgacagcagcggcgagggccccgagttcgtggaggaggaggaggaggtggccctgagaagcgacagcgagggcagcgactacacccccggcaagaagaagaagaagaagctgggccccaagaaggagaagaagagcaagagcaagagaaaggaggaggaggaggaggaggacgacgacgacgacagcaaggagcccaagagcagcgcccagctgctggaggactggggcatggaggacatcgaccacgtgttcagcgaggaggactacagaaccctgaccaactacaaggccttcagccagttcgtgagacccctgatcgccgccaagaaccccaagatcgccgtgagcaagatgatgatggtgctgggcgccaagtggagagagttcagcaccaacaaccccttcaagggcagcagcggcgccagcgtggccgccgccgccgccgccgccgtggccgtggtggagagcatggtgaccgccaccgaggtggcccccccccccccccccgtggaggtgcccatcagaaaggccaagaccaaggagggcaagggccccaacgccagaagaaagcccaagggcagccccagagtgcccgacgccaagaagcccaagcccaagaaggtggcccccctgaagatcaagctgggcggcttcggcagcaagagaaagagaagcagcagcgaggacgacgacctggacgtggagagcgacttcgacgacgccagcatcaacagctacagcgtgagcgacggcagcaccagcagaagcagcagaagcagaaagaagctgagaaccaccaagaagaagaagaagtag

SEQ ID NO: 10108 - DNA, 1065 bp, Artificial Sequence; identical to SEQ ID NO: 10107
  Description of Artificial Sequence: Synthetic coding sequence

SEQ ID NO: 10109 - DNA, 2562 bp, Artificial Sequence
  Description of Artificial Sequence: Synthetic coding sequence
atgttcctgccccacatgaaccacctgaccctggagcagaccttcttcagccaggtgctgcccaagaccgtgaagctgttcgacgacatgatgtacgagctgaccagccaggccagaggcctgagcagccagaacctggagatccagaccaccctgagaaacatcctgcagaccatggtgcagctgctgggcgccctgaccggctgcgtgcagcacatctgcgccacccaggagagcatcatcctggagaacatccagagcctgcccagcagcgtgctgcacatcatcaagagcaccttcgtgcactgcaagaacagcgagagcgtgtacagcggctgcctgcacctggtgagcgacctgctgcaggccctgttcaaggaggcctacagcctgcagaagcagctgatggagctgctggacatggtgtgcatggaccccctggtggacgacaacgacgacatcctgaacatggtgatcgtgatccacagcctgctggacatctgcagcgtgatcagcagcatggaccacgccttccacgccaacacctggaagttcatcatcaagcagagcctgaagcaccagagcatcatcaagagccagctgaagcacaaggacatcatcaccagcctgtgcgaggacatcctgttcagcttccacagctgcctgcagctggccgagcagatgacccagagcgacgcccaggacaacgccgactacagactgttccagaagaccctgaagctgtgcagattcttcgccaacagcctgctgcactacgccaaggagttcctgcccttcctgagcgacagctgctgcaccctgcaccagctgtacctgcagatccacagcaagttcccccccagcctgtacgccaccagaatcagcaaggcccaccaggaggagatcgccggcgccttcctggtgaccctggaccccctgatcagccagctgctgaccttccagcccttcatgcaggtggtgctggacagcaagctggacctgccctgcgagctgcagttcccccagtgcctgctgctggtggtggtgatggacaagctgcccagccagcccaaggaggtgcagaccctgtggtgcaccgacagccaggtgagcgagaccaccaccagaatcagcctgctgaaggccgtgttctacagcttcgagcagtgcagcggcgagctgagcctgcccgtgcacctgcagggcctgaagagcaagggcaaggccgaggtggccgtgaccctgtaccagcacgtgtgcgtgcacctgtgcaccttcatcaccagcttccaccccagcctgttcgccgagctggacgccgccctgctgaacgccgtgctgagcgccaacatgatcaccagcctgctggccatggacgcctggtgcttcctggccagatacggcaccgccgagctgtgcgcccaccacgtgaccatcgtggcccacctgatcaagagctgccccggcgagtgctaccagctgatcaacctgagcatcctgctgaagagactgttcttcttcatggcccccccccaccagctggagttcatccagaagttcagccccaaggaggccgagaacctgcccctgtggcagcacatcagcttccaggccctgccccccgagctgagagagcagaccgtgcacgaggtgaccaccgtgggcaccgccgagtgcagaaagtggctgagcagaagcagaaccctgggcgagctggagagcctgaacaccgtgctgagcgccctgctggccgtgtgcaacagcgccggcgaggccctggacaccggcaagcagaccgccatcatcgaggtggtgagccagctgtgggccttcctgaacatcaagcaggtggccgaccagccctacgtgcagcagaccttcagcctgctgctgcccctgctgggcttcttcatccagaccctggaccccaagctgatcctgcaggccgtgaccctgcagaccagcctgctgaagctggagctgcccgactacgtgagactggccatgctggacttcgtgagcagcctgggcaagctgttcatccccgaggccatccaggacagaatcctgcccaacctgagctgcatgttcgccctgctgctggccgacagaagctggctgctggagcagcacaccctggaggccttcacccagttcgccgagggcaccaaccacgaggagatcgtgccccagtgcctgagcagcgaggagaccaagaacaaggtggtgagcttcctggagaagaccggcttcgtggacgagaccgaggccgccaaggtggagagagtgaagcaggagaagggcatcttctgggagcccttcgccaacgtgaccgtggaggaggccaagagaagcagcctgcagccctacgccaagagagccagacaggagttcccctgggaggaggagtacagaagcgccctgcacaccatcgccggcgccctggaggccaccgagagcctgctgcagaagggccccgcccccgcctggctgagcatggagatggaggccctgcaggagagaatggacaagctgaagagatacatccacaccctgggctag

SEQ ID NO: 10110 - DNA, 2562 bp, Artificial Sequence; identical to SEQ ID NO: 10109
  Description of Artificial Sequence: Synthetic coding sequence

SEQ ID NO: 10111 - DNA, 993 bp, Artificial Sequence
  Description of Artificial Sequence: Synthetic coding sequence
atgatgtacgagctgaccagccaggccagaggcctgagcagccagaacctggagatccagaccaccctgagaaacatcctgcagaccatggtgcagctgctgggcgccctgaccggctgcgtgcagcacatctgcgccacccaggagagcatcatcctggagaacatccagagcctgcccagcagcgtgctgcacatcatcaagagcaccttcgtgcactgcaagaacagcgagagcgtgtacagcggctgcctgcacctggtgagcgacctgctgcaggccctgttcaaggaggcctacagcctgcagaagcagctgatggagctgctggacatggtgtgcatggaccccctggtggacgacaacgacgacatcctgaacatggtgatcgtgatccacagcctgctggacatctgcagcgtgatcagcagcatggaccacgccttccacgccaacacctggaagttcatcatcaagcagagcctgaagcaccagagcatcatcaagagccagctgaagcacaaggacatcatcaccagcctgtgcgaggacatcctgttcagcttccacagctgcctgcagctggccgagcagatgacccagagcgacgcccaggacaacgccgactacagactgttccagaagaccctgaagctgtgcagattcttcgccaacagcctgctgcactacgccaaggagttcctgcccttcctgagcgacagctgctgcaccctgcaccagctgtacctgcagatccacagcaagttcccccccagcctgtacgccaccagaatcagcaaggcccaccaggaggagatcgccggcgccttcctggtgaccctggaccccctgatcagccagctgctgaccttccagcccttcatgcaggtggtgctggacagcaagctgggctacctgtacagcaagcccttcagcaccgtgctgagcagcgtgctggtgaacagcctgtacctgttcatctacagagactag

SEQ ID NO: 10112 - DNA, 1047 bp, Artificial Sequence
  Description of Artificial Sequence: Synthetic coding sequence
atgagccaggagggcgccgtgcccgccagcgccgtgcccctggaggagctgagcagctggcccgaggagctgtgcagaagagagctgcccagcgtgctgcccagactgctgagcctgagccagcacagcgacagctggatcgagcacatccagatcctgaagatcatcgtggagatgttcctgccccacatgaaccacctgaccctggagcagaccttcttcagccaggtgctgcccaagaccgtgaagctgttcgacgacatgatgtacgagctgaccagccaggccagaggcctgagcagccagaacctggagatccagaccaccctgagaaacatcctgcagaccatggtgcagctgctgggcgccctgaccggctgcgtgcagcacatctgcgccacccaggagagcatcatcctggagaacatccagagcctgcccagcagcgtgctgcacatcatcaagagcaccttcgtgcactgcaagaacagcgagagcgtgtacagcggctgcctgcacctggtgagcgacctgctgcaggccctgttcaaggaggcctacagcctgcagaagcagctgatggagctgctggacatggtgtgcatggaccccctggtggacgacaacgacgacatcctgaacatggtgatcgtgatccacagcctgctggacatctgcagcgtgatcagcagcatggaccacgccttccacgccaacacctggaagttcatcatcaagcagagcctgaagcaccagagcatcatcaagagccagctgaagcacaaggacatcatcaccagcctgtgcgaggacatcctgttcagcttccacagctgcctgcagctggccgagcagatgacccagagcgacgcccaggacaacgccgactacagactgttccagaagaccctgaagctgtgcagattcttcgccaacagcctgctgcactacgccaaggagttcctgcccttcctgagcgacagctgctgcaccctgcaccagctgtacctgcagatccacagatggagcttcgccctggccgtgtag

SEQ ID NO: 10113 - DNA, 2100 bp, Artificial Sequence
  Description of Artificial Sequence: Synthetic coding sequence
atgctgaagctgagcggcgagggcctgagagacagctaccacagcagaagagaccagatcgccctgaagaacctgcagagcgacgtgaccgaggccaagagcgacttcaccaaggagaccctggccagccagaacaccaagatgatcagcagcatcgtgatcagccagatgatcgacgagaacaagagcagagagaacagagccagcctgcccctgccctgcgccatcgcccagagcagagcccaccacgccaagcagagcctggccaacagaagcggcgtgaacatccacagagccttcgccctgctgcccggcagactgggcatccccgcccccagcgacgagagaggccccgaggccgagctgccccccaaggaggagagaccctgcggcggccccagaagaggcttcgccagcatcaccatcaccgccagaagagtgggcccccccgccagagccctggtgtggggcaccgccggcgacagcctgtgccccaagtgcagagccgaggacaccctgttccaggccccccccgccctggccaacggcgcccaccccggcagacaccagagaagcttcgcctgcaccgagttcagcagaaacagcagcgtggtgagactgaaggtgcccgaggcccacaccggcctgtgcgagagaagaaagtactgggtgacccacgccgacgacaaggagaccagcttcagccccgacacccccctgagcggcaagagccccctggtgttcagcagctgcgtgcacctgagagtgagccagcagtgccccgacagcatctactacgtggacaagagcctgagcgtgcccatcgagcccccccagatcgccagccccaagatgcacagaagcgtgctgagcctgaacctgaactgcagcagccacagactgaccgccgacggcgtggacggcctggtgaacagagagcccatcagcgaggccctgaagcaggagctgctggagggcgaccaggacctggtgggccagagatggaaccccggcctgcaggagagccacctgaaggagacccccagcctgagaagagtgcacctgggcaccggcgcctgcccctggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccgtgcacaccaaggtgttcagcggcagcagcaagagacagcagggcgaggtgtgcatgaccgtgagcgccccccccgtggagcagaagcccaccagacacttcctgcccatcggcgacagcagccccagcgacgactgcctgagcagagacctgagcgagcccaccgagagaagacaccagagcttcctgaagcccagaatcctgttccccggcttcctgtgccccctgcaggacgtgtgcgccagcctgcaggaggacaacggcgtgcagatcgagagcaagttccccaagggcgactacacctgctgcgacctggtggtgaagatcaaggagtgcaagaagagcgaggaccccaccacccccgagcccagccccgccgcccccagccccgcccccagagacggcgccggcagccccggcctgagcgaggactgcagcgagagccagcagacccccgccagaagcctgaccctgcaggaggccctggaggtgagaaagccccagttcatcagcagaagccaggagagactgaagaagctggagcacatggtgcagcagagaaaggcccagagaaaggaggacctgagacagaagcagagcctgctgcccatcagaaccagcaagaagcagttcaccatcccccaccccctgagcgacaacctgttcaagcccaaggagagatgcatcagcgagaaggagatgcacatgagaagcaagagaatctacgacaacctgcccgaggtgaagaagaagaaggaggagcagagaaagagagtgatcctgcagagcaacagactgagagccgaggtgttcaagaagcagctgctggaccagctgctgcagagaaacgccgtgtag

SEQ ID NO: 10114 - DNA, 1959 bp, Artificial Sequence
  Description of Artificial Sequence: Synthetic coding sequence
atgatcagcagcatcgtgatcagccagatgatcgacgagaacaagagcagagagaacagagccagcctgcccctgccctgcgccatcgcccagagcagagcccaccacgccaagcagagcctggccaacagaagcggcgtgaacatccacagagccttcgccctgctgcccggcagactgggcatccccgcccccagcgacgagagaggccccgaggccgagctgccccccaaggaggagagaccctgcggcggccccagaagaggcttcgccagcatcaccatcaccgccagaagagtgggcccccccgccagagccctggtgtggggcaccgccggcgacagcctgtgccccaagtgcagagccgaggacaccctgttccaggccccccccgccctggccaacggcgcccaccccggcagacaccagagaagcttcgcctgcaccgagttcagcagaaacagcagcgtggtgagactgaaggtgcccgaggcccacaccggcctgtgcgagagaagaaagtactgggtgacccacgccgacgacaaggagaccagcttcagccccgacacccccctgagcggcaagagccccctggtgttcagcagctgcgtgcacctgagagtgagccagcagtgccccgacagcatctactacgtggacaagagcctgagcgtgcccatcgagcccccccagatcgccagccccaagatgcacagaagcgtgctgagcctgaacctgaactgcagcagccacagactgaccgccgacggcgtggacggcctggtgaacagagagcccatcagcgaggccctgaagcaggagctgctggagggcgaccaggacctggtgggccagagatggaaccccggcctgcaggagagccacctgaaggagacccccagcctgagaagagtgcacctgggcaccggcgcctgcccctggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccgtgcacaccaaggtgttcagcggcagcagcaagagacagcagggcgaggtgtgcatgaccgtgagcgccccccccgtggagcagaagcccaccagacacttcctgcccatcggcgacagcagccccagcgacgactgcctgagcagagacctgagcgagcccaccgagagaagacaccagagcttcctgaagcccagaatcctgttccccggcttcctgtgccccctgcaggacgtgtgcgccagcctgcaggaggacaacggcgtgcagatcgagagcaagttccccaagggcgactacacctgctgcgacctggtggtgaagatcaaggagtgcaagaagagcgaggaccccaccacccccgagcccagccccgccgcccccagccccgcccccagagacggcgccggcagccccggcctgagcgaggactgcagcgagagccagcagacccccgccagaagcctgaccctgcaggaggccctggaggtgagaaagccccagttcatcagcagaagccaggagagactgaagaagctggagcacatggtgcagcagagaaaggcccagagaaaggaggacctgagacagaagcagagcctgctgcccatcagaaccagcaagaagcagttcaccatcccccaccccctgagcgacaacctgttcaagcccaaggagagatgcatcagcgagaaggagatgcacatgagaagcaagagaatctacgacaacctgcccgaggtgaagaagaagaaggaggagcagagaaagagagtgatcctgcagagcaacagactgagagccgaggtgttcaagaagcagctgctggaccagctgctgcagagaaacgccgtgtag

SEQ ID NO: 10115 - DNA, 1152 bp, Artificial Sequence
  Description of Artificial Sequence: Synthetic coding sequence
atgatcagcagcatcgtgatcagccagatgatcgacgagaacaagagcagagagaacagagccagcctgcccctgccctgcgccatcgcccagagcagagcccaccacgccaagcagagcctggccaacagaagcggcgtgaacatccacagagccttcgccctgctgcccggcagactgggcatccccgcccccagcgacgagagaggccccgaggccgagctgccccccaaggaggagagaccctgcggcggccccagaagaggcttcgccagcatcaccatcaccgccagaagagtgggcccccccgccagagccctggtgtggggcaccgccggcgacagcctgtgccccaagtgcagagccgaggacaccctgttccaggccccccccgccctggccaacggcgcccaccccggcagacaccagagaagcttcgcctgcaccgagttcagcagaaacagcagcgtggtgagactgaaggtgcccgaggcccacaccggcctgtgcgagagaagaaagtactgggtgacccacgccgacgacaaggagaccagcttcagccccgacacccccctgagcggcaagagccccctggtgttcagcagctgcgtgcacctgagagtgagccagcagtgccccgacagcatctactacgtggacaagagcctgagcgtgcccatcgagcccccccagatcgccagccccaagatgcacagaagcgtgctgagcctgaacctgaactgcagcagccacagactgaccgccgacggcgtggacggcctggtgaacagagagcccatcagcgaggccctgaagcaggagctgctggagggcgaccaggacctggtgggccagagatggaaccccggcctgcaggagagccacctgaaggagacccccagcctgagaagagtgcacctgggcaccggcgcctgcccctggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccgacctgctgcaggagggccagcacaagcagctgagcatgttccagagatag

SEQ ID NO: 10116 - DNA, 1152 bp, Artificial Sequence; identical to SEQ ID NO: 10115
  Description of Artificial Sequence: Synthetic coding sequence

SEQ ID NO: 10117 - DNA, 729 bp, Artificial Sequence
  Description of Artificial Sequence: Synthetic coding sequence
tgatggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccggcgactacacctgctgcgacctggtggtgaagatcaaggagtgcaagaagagcgaggaccccaccacccccgagcccagccccgccgcccccagccccgcccccagagacggcgccggcagccccggcctgagcgaggactgcagcgagagccagcagacccccgccagaagcctgaccctgcaggaggccctggaggtgagaaagccccagttcatcagcagaagccaggagagactgaagaagctggagcacatggtgcagcagagaaaggcccagagaaaggaggacctgagacagaagcagagcctgctgcccatcagaaccagcaagaagcagttcaccatcccccaccccctgagcgacaacctgttcaagcccaaggagagatgcatcagcgagaaggagatgcacatgagaagcaagagaatctacgacaacctgcccgaggtgaagaagaagaaggaggagcagagaaagagagtgatcctgcagagcaacagactgagagccgaggtgttcaagaagcagctgctggaccagctgctgcagagaaacgccgtgtag

SEQ ID NO: 10118 - DNA, 1989 bp, Artificial Sequence
  Description of Artificial Sequence: Synthetic coding sequence
atgctgaagctgagcggcgagggcctgagagacagctaccacagcagaagagaccagatcgccctgaagaacctgcagagcgacgtgaccgaggccaagagcgacttcaccaaggagaccctggccagccagaacaccaagatgatcagcagcatcgtgatcagccagatgatcgacgagaacaagagcagagagaacagagccagcctgcccctgccctgcgccatcgcccagagcagagcccaccacgccaagcagagcctggccaacagaagcggcgtgaacatccacagagccttcgccctgctgcccggcagactgggcatccccgcccccagcgacgagagaggccccgaggccgagctgccccccaaggaggagagaccctgcggcggccccagaagaggcttcgccagcatcaccatcaccgccagaagagtgggcccccccgccagagccctggtgtggggcaccgccggcgacagcctgtgccccaagtgcagagccgaggacaccctgttccaggccccccccgccctggccaacggcgcccaccccggcagacaccagagaagcttcgcctgcaccgagttcagcagaaacagcagcgtggtgagactgaaggtgcccgaggcccacaccggcctgtgcgagagaagaaagtactgggtgacccacgccgacgacaaggagaccagcttcagccccgacacccccctgagcggcaagagccccctggtgttcagcagctgcgtgcacctgagagtgagccagcagtgccccgacagcatctactacgtggacaagagcctgagcgtgcccatcgagcccccccagatcgccagccccaagatgcacagaagcgtgctgagcctgaacctgaactgcagcagccacagactgaccgccgacggcgtggacggcctggtgaacagagagcccatcagcgaggccctgaagcaggagctgctggagggcgaccaggacctggtgggccagagatggaaccccggcctgcaggagagccacctgaaggagacccccagcctgagaagagtgcacctgggcaccggcgcctgcccctggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccgtgcacaccaaggtgttcagcggcagcagcaagagacagcagggcgaggtgtgcatgaccgtgagcgccccccccgtggagcagaagcccaccagacacttcctgcccatcggcgacagcagccccagcgacgactgcctgagcagagacctgagcgagcccaccgagagaagacaccagagcttcctgaagcccagaatcctgttccccggcttcctgtgccccctgcaggacgtgtgcgccagcctgcaggaggacaacggcgtgcagatcgagagcaagttccccaagggcgactacacctgctgcgacctggtggtgaagatcaaggagtgcaagaagagcgaggaccccaccacccccgagcccagccccgccgcccccagccccgcccccagagacggcgccggcagccccggcctgagcgaggactgcagcgagagccagcagacccccgccagaagcctgaccctgcaggaggccctggaggtgagaaagccccagttcatcagcagaagccaggagagactgaagaagctggagcacatggtgcagcagagaaaggcccagagaaaggaggacctgagacagaagcagagcctgctgcccatcagaaccagcaagaagcagttcaccatcccccaccccctgagcgacaacctgttcaagcccaaggagagatgcatcagcgagaaggagatgcacatgagaagcaagagaatctacgacaacctgcccgaggtgtag

SEQ ID NO: 10119 - DNA, 1809 bp, Artificial Sequence
  Description of Artificial Sequence: Synthetic coding sequence
atgctgaagctgagcggcgagggcctgagagacagctaccacagcagaagagaccagatcgccctgaagaacctgcagagcgacgtgaccgaggccaagagcgacttcaccaaggagaccctggccagccagaacaccaagatgatcagcagcatcgtgatcagccagatgatcgacgagaacaagagcagagagaacagagccagcctgcccctgccctgcgccatcgcccagagcagagcccaccacgccaagcagagcctggccaacagaagcggcgtgaacatccacagagccttcgccctgctgcccggcagactgggcatccccgcccccagcgacgagagaggccccgaggccgagctgccccccaaggaggagagaccctgcggcggccccagaagaggcttcgccagcatcaccatcaccgccagaagagtgggcccccccgccagagccctggtgtggggcaccgccggcgacagcctgtgccccaagtgcagagccgaggacaccctgttccaggccccccccgccctggccaacggcgcccaccccggcagacaccagagaagcttcgcctgcaccgagttcagcagaaacagcagcgtggtgagactgaaggtgcccgaggcccacaccggcctgtgcgagagaagaaagtactgggtgacccacgccgacgacaaggagaccagcttcagccccgacacccccctgagcggcaagagccccctggtgttcagcagctgcgtgcacctgagagtgagccagcagtgccccgacagcatctactacgtggacaagagcctgagcgtgcccatcgagcccccccagatcgccagccccaagatgcacagaagcgtgctgagcctgaacctgaactgcagcagccacagactgaccgccgacggcgtggacggcctggtgaacagagagcccatcagcgaggccctgaagcaggagctgctggagggcgaccaggacctggtgggccagagatggaaccccggcctgcaggagagccacctgaaggagacccccagcctgagaagagtgcacctgggcaccggcgcctgcccctggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccggcgactacacctgctgcgacctggtggtgaagatcaaggagtgcaagaagagcgaggaccccaccacccccgagcccagccccgccgcccccagccccgcccccagagacggcgccggcagccccggcctgagcgaggactgcagcgagagccagcagacccccgccagaagcctgaccctgcaggaggccctggaggtgagaaagccccagttcatcagcagaagccaggagagactgaagaagctggagcacatggtgcagcagagaaaggcccagagaaaggaggacctgagacagaagcagagcctgctgcccatcagaaccagcaagaagcagttcaccatcccccaccccctgagcgacaacctgttcaagcccaaggagagatgcatcagcgagaaggagatgcacatgagaagcaagagaatctacgacaacctgcccgaggtgaagaagaagaaggaggagcagagaaagagagtgatcctgcagagcaacagactgagagccgaggtgttcaagaagcagctgctggaccagctgctgcagagaaacgccgtgtag

SEQ ID NO: 10120 - DNA, 2391 bp, Artificial Sequence
  Description of Artificial Sequence: Synthetic coding sequence
atgcagcacagcggcatccccaccaagacccacccccagggctacgccgccagatacaccgagaccgccgtgcacagaaccttccagatcaagaccttcagcaccgagctgaagaaccacgtgatggtgatggacttcgtgaagagcaactggttccccagccagagaagagccaaggtgtgcatcatccacatgtgccagggcctgaagaccgccgagcagaccgccagcagatacgagatccacagcagactgttcagcagccccaaggaccacagcgcctgggagagaaacgagagcctgagcaacgccggcctgagagacagctaccacagcagaagagaccagatcgccctgaagaacctgcagagcgacgtgaccgaggccaagagcgacttcaccaaggagaccctggccagccagaacaccaagatgatcagcagcatcgtgatcagccagatgatcgacgagaacaagagcagagagaacagagccagcctgcccctgccctgcgccatcgcccagagcagagcccaccacgccaagcagagcctggccaacagaagcggcgtgaacatccacagagccttcgccctgctgcccggcagactgggcatccccgcccccagcgacgagagaggccccgaggccgagctgccccccaaggaggagagaccctgcggcggccccagaagaggcttcgccagcatcaccatcaccgccagaagagtgggcccccccgccagagccctggtgtggggcaccgccggcgacagcctgtgccccaagtgcagagccgaggacaccctgttccaggccccccccgccctggccaacggcgcccaccccggcagacaccagagaagcttcgcctgcaccgagttcagcagaaacagcagcgtggtgagactgaaggtgcccgaggcccacaccggcctgtgcgagagaagaaagtactgggtgacccacgccgacgacaaggagaccagcttcagccccgacacccccctgagcggcaagagccccctggtgttcagcagctgcgtgcacctgagagtgagccagcagtgccccgacagcatctactacgtggacaagagcctgagcgtgcccatcgagcccccccagatcgccagccccaagatgcacagaagcgtgctgagcctgaacctgaactgcagcagccacagactgaccgccgacggcgtggacggcctggtgaacagagagcccatcagcgaggccctgaagcaggagctgctggagggcgaccaggacctggtgggccagagatggaaccccggcctgcaggagagccacctgaaggagacccccagcctgagaagagtgcacctgggcaccggcgcctgcccctggagcggcagcttccccctggagaacaccgagctggccaacgtgggcgccaaccaggtgaccgtgagaaagggcgagaaggaccacaccacccactgccacgccagcgaccacgccaaccagctgagcatccacatccccggctggagctacagagccgtgcacaccaaggtgttcagcggcagcagcaagagacagcagggcgaggtgtgcatgaccgtgagcgccccccccgtggagcagaagcccaccagacacttcctgcccatcggcgacagcagccccagcgacgactgcctgagcagagacctgagcgagcccaccgagagaagacaccagagcttcctgaagcccagaatcctgttccccggcttcctgtgccccctgcaggacgtgtgcgccagcctgcaggaggacaacggcgtgcagatcgagagcaagttccccaagggcgactacacctgctgcgacctggtggtgaagatcaaggagtgcaagaagagcgaggaccccaccacccccgagcccagccccgccgcccccagccccgcccccagagacggcgccggcagccccggcctgagcgaggactgcagcgagagccagcagacccccgccagaagcctgaccctgcaggaggccctggaggtgagaaagccccagttcatcagcagaagccaggagagactgaagaagctggagcacatggtgcagcagagaaaggcccagagaaaggaggacctgagacagaagcagagcctgctgcccatcagaaccagcaagaagcagttcaccatcccccaccccctgagcgacaacctgttcaagcccaaggagagatgcatcagcgagaaggagatgcacatgagaagcaagagaatctacgacaacctgcccgaggtgaagaagaagaaggaggagcagagaaagagagtgatcctgcagagcaacagactgagagccgaggtgttcaagaagcagctgctggaccagctgctgcagagaaacgccgtgtag

SEQ ID NO: 10121 - DNA, 786 bp, Artificial Sequence
  Description of Artificial Sequence: Synthetic coding sequence
atgagcaccaccacctgccaggtggtggccttcctgctgagcatcctgggcctggccggctgcatcgccgccaccggcatggacatgtggagcacccaggacctgtacgacaaccccgtgaccagcgtgttccagtacgagggcctgtggagaagctgcgtgagacagagcagcggcttcaccgagtgcagaccctacttcaccatcctgggcctgcccgccatgctgcaggccgtgagagccctgatgatcgtgggcatcgtgctgggcgccatcggcctgctggtgagcatcttcgccctgaagtgcatcagaatcggcagcatggaggacagcgccaaggccaacatgaccctgaccagcggcatcatgttcatcgtgagcggcctgtgcgccatcgccggcgtgagcgtgttcgccaacatgctggtgaccaacttctggatgagcaccgccaacatgtacaccggcatgggcggcatggtgcagaccgtgcagaccagatacaccttcggcgccgccctgttcgtgggctgggtggccggcggcctgaccctgatcggcggcgtgatgatgtgcatcgcctgcagaggcctggcccccgaggagaccaactacaaggccgtgagctaccacgccagcggccacagcgtggcctacaagcccggcggcttcaaggccagcaccggcttcggcagcaacaccaagaacaagaagatctacgacggcggcgccagaaccgaggacgaggtgcagagctaccccagcaagcacgactacgtgtag

SEQ ID NO: 10122 - DNA, 786 bp, Artificial Sequence
  Description of Artificial Sequence: Synthetic coding sequence
atggccgtgaccgcctgccagggcctgggcttcgtggtgagcctgatcggcatcgccggcatcatcgccgccacctgcatggaccagtggagcacccaggacctgtacaacaaccccgtgaccgccgtgttcaactaccagggcctgtggagaagctgcgtgagagagagcagcggcttcaccgagtgcagaggctacttcaccctgctgggcctgcccgccatgctgcaggccgtgagagccctgatgatcgtgggcatcgtgctgggcgccatcggcctgctggtgagcatcttcgccctgaagtgcatcagaatcggcagcatggaggacagcgccaaggccaacatgaccctgaccagcggcatcatgttcatcgtgagcggcctgtgcgccatcgccggcgtgagcgtgttcgccaacatgctggtgaccaacttctggatgagcaccgccaacatgtacaccggcatgggcggcatggtgcagaccgtgcagaccagatacaccttcggcgccgccctgttcgtgggctgggtggccggcggcctgaccctgatcggcggcgtgatgatgtgcatcgcctgcagaggcctggcccccgaggagaccaactacaaggccgtgagctaccacgccagcggccacagcgtggcctacaagcccggcggcttcaaggccagcaccggcttcggcagcaacaccaagaacaagaagatctacgacggcggcgccagaaccgaggacgaggtgcagagctaccccagcaagcacgactacgtgtag

SEQ ID NO: 10123 - DNA, 753 bp, Artificial Sequence
  Description of Artificial Sequence: Synthetic coding sequence
atgagcaccaccacctgccaggtggtggccttcctgctgagcatcctgggcctggccggctgcatcgccgccaccggcatggacatgtggagcacccaggacctgtacgacaaccccgtgaccagcgtgttccagtacgagggcctgtggagaagctgcgtgagacagagcagcggcttcaccgagtgcagaccctacttcaccatcctgggcctgcccgccatgctgcaggccgtgagagccctgatgatcgtggccatcttcgccctgaagtgcatcagaatcggcagcatggaggacagcgccaaggccaacatgaccctgaccagcggcatcatgttcatcgtgagcggcctgtgcgccatcgccggcgtgagcgtgttcgccaacatgctggtgaccaacttctggatgagcaccgccaacatgtacaccggcatgggcggcatggtgcagaccgtgcagaccagatacaccttcggcgccgccctgttcgtgggctgggtggccggcggcctgaccctgatcggcggcgtgatgatgtgcatcgcctgcagaggcctggcccccgaggagaccaactacaaggccgtgagctaccacgccagcggccacagcgtggcctacaagcccggcggcttcaaggccagcaccggcttcggcagcaacaccaagaacaagaagatctacgacggcggcgccagaaccgaggacgaggtgcagagctaccccagcaagcacgactacgtgtag

SEQ ID NO: 10124 - DNA, 3000 bp, Artificial Sequence
  Description of Artificial Sequence: Synthetic coding sequence
atgggccccgcccccctgcccctgctgctgggcctgttcctgcccgccctgtggagaagagccatcaccgaggccagagaggaggccaagccctaccccctgttccccggccccttccccggcagcctgcagaccgaccacacccccctgctgagcctgccccacgccagcggctaccagcccgccctgatgttcagccccacccagcccggcagaccccacaccggcaacgtggccatcccccaggtgaccagcgtggagagcaagcccctgccccccctggccttcaagcacaccgtgggccacatcatcctgagcgagcacaagggcgtgaagttcaactgcagcatcagcgtgcccaacatctaccaggacaccaccatcagctggtggaaggacggcaaggagctgctgggcgcccaccacgccatcacccagttctaccccgacgacgaggtgaccgccatcatcgccagcttcagcatcaccagcgtgcagagaagcgacaacggcagctacatctgcaagatgaagatcaacaacgaggagatcgtgagcgaccccatctacatcgaggtgcagggcctgccccacttcaccaagcagcccgagagcatgaacgtgaccagaaacaccgccttcaacctgacctgccaggccgtgggcccccccgagcccgtgaacatcttctgggtgcagaacagcagcagagtgaacgagcagcccgagaagagccccagcgtgctgaccgtgcccggcctgaccgagatggccgtgttcagctgcgaggcccacaacgacaagggcctgaccgtgagcaagggcgtgcagatcaacatcaaggccatccccagcccccccaccgaggtgagcatcagaaacagcaccgcccacagcatcctgatcagctgggtgcccggcttcgacggctacagccccttcagaaactgcagcatccaggtgaaggaggccgaccccctgagcaacggcagcgtgatgatcttcaacaccagcgccctgccccacctgtaccagatcaagcagctgcaggccctggccaactacagcatcggcgtgagctgcatgaacgagatcggctggagcgccgtgagcccctggatcctggccagcaccaccgagggcgcccccagcgtggcccccctgaacgtgaccgtgttcctgaacgagagcagcgacaacgtggacatcagatggatgaagccccccaccaagcagcaggacggcgagctggtgggctacagaatcagccacgtgtggcagagcgccggcatcagcaaggagctgctggaggaggtgggccagaacggcagcagagccagaatcagcgtgcaggtgcacaacgccacctgcaccgtgagaatcgccgccgtgaccagaggcggcgtgggccccttcagcgaccccgtgaagatcttcatccccgcccacggctgggtggactacgcccccagcagcacccccgcccccggcaacgccgaccccgtgctgatcatcttcggctgcttctgcggcttcatcctgatcggcctgatcctgtacatcagcctggccatcagaaagagagtgcaggagaccaagttcggcaacgccttcaccgaggaggacagcgagctggtggtgaactacatcgccaagaagagcttctgcagaagagccatcgagctgaccctgcacagcctgggcgtgagcgaggagctgcagaacaagctggaggacgtggtgatcgacagaaacctgctgatcctgggcaagatcctgggcgagggcgagttcggcagcgtgatggagggcaacctgaagcaggaggacggcaccagcctgaaggtggccgtgaagaccatgaagctggacaacagcagccagagagagatcgaggagttcctgagcgaggccgcctgcatgaaggacttcagccaccccaacgtgatcagactgctgggcgtgtgcatcgagatgagcagccagggcatccccaagcccatggtgatcctgcccttcatgaagtacggcgacctgcacacctacctgctgtacagcagactggagaccggccccaagcacatccccctgcagaccctgctgaagttcatggtggacatcgccctgggcatggagtacctgagcaacagaaacttcctgcacagagacctggccgccagaaactgcatgctgagagacgacatgaccgtgtgcgtggccgacttcggcctgagcaagaagatctacagcggcgactactacagacagggcagaatcgccaagatgcccgtgaagtggatcgccatcgagagcctggccgacagagtgtacaccagcaagagcgacgtgtgggccttcggcgtgaccatgtgggagatcgccaccagaggcatgaccccctaccccggcgtgcagaaccacgagatgtacgactacctgctgcacggccacagactgaagcagcccgaggactgcctggacgagctgtacgagatcatgtacagctgctggagaaccgaccccctggacagacccaccttcagcgtgctgagactgcagctggagaagctgctggagagcctgcccgacgtgagaaaccaggccgacgtgatctacgtgaacacccagctgctggagagcagcgagggcctggcccagggcagcaccctggcccccctggacctgaacatcgaccccgacagcatcatcgccagctgcacccccagagccgccatcagcgtggtgaccgccgaggtgcacgacagcaagccccacgagggcagatacatcctgaacggcggcagcgaggagtgggaggacctgaccagcgcccccagcgccgccgtgaccgccgagaagaacagcgtgctgcccggcgagagactggtgagaaacggcgtgagctggagccacagcagcatgctgcccctgggcagcagcctgcccgacgagctgctgttcgccgacgacagcagcgagggcagcgaggtgctgatgtag

SEQ ID NO: 10125 - DNA, 1671 bp, Artificial Sequence
  Description of Artificial Sequence: Synthetic coding sequence
atgaagccccccaccaagcagcaggacggcgagctggtgggctacagaatcagccacgtgtggcagagcgccggcatcagcaaggagctgctggaggaggtgggccagaacggcagcagagccagaatcagcgtgcaggtgcacaacgccacctgcaccgtgagaatcgccgccgtgaccagaggcggcgtgggccccttcagcgaccccgtgaagatcttcatccccgcccacggcgagagctacacccacgcccagatcgccagaaacctgcacaaggtgagacccgcctacatcagcctgaccatctgcagcagcctgctgcaggccagcgtgagccacatcttccagaccatgaccggcctgctggtgagcaccagactgggcagactgtgccccctgttcaacagcggcgcctggcagagaagaagctgcgcccaccacctgtggctgctgctgtggatcctgatcggcctgatcctgtacatcagcctggccatcagaaagagagtgcaggagaccaagttcggcaacgccttcaccgaggaggacagcgagctggtggtgaactacatcgccaagaagagcttctgcagaagagccatcgagctgaccctgcacagcctgggcgtgagcgaggagctgcagaacaagctggaggacgtggtgatcgacagaaacctgctgatcctgggcaagatcctgggcgagggcgagttcggcagcgtgatggagggcaacctgaagcaggaggacggcaccagcctgaaggtggccgtgaagaccatgaagctggacaacagcagccagagagagatcgaggagttcctgagcgaggccgcctgcatgaaggacttcagccaccccaacgtgatcagactgctgggcaccagcgagaagtgcagatgggtggccaagagagccctgctgatctgcagcgtgcccaaggagaagatcagcggcgtggacaagaactgcctgcagatccacatccccctgcagaccctgctgaagttcatggtggacatcgccctgggcatggagtacctgagcaacagaaacttcctgcacagagacctggccgccagaaactgcatgctgagagacgacatgaccgtgtgcgtggccgacttcggcctgagcaagaagatctacagcggcgactactacagacagggcagaatcgccaagatgcccgtgaagtggatcgccatcgagagcctggccgacagagtgtacaccagcaagagcgacgtgtgggccttcggcgtgaccatgtgggagatcgccaccagaggcatgaccccctaccccggcgtgcagaaccacgagatgtacgactacctgctgcacggccacagactgaagcagcccaccgcctggatgaactgcgaccaggtgggcatgtgcagaggcgtggagcccaccgacacccccgcccaggagcccttcctgatgtgggagatcgtgtacgagtgcaccctggccggcgagcccatccccgacagacccaccttcagcgtgctgagactgcagctggagaagctgctggagagcctgcccgacgtgagaaaccaggccgacgtgatctacgtgaacacccagctgctggagagcagcgagggcctggccctgcacccctgcagcaccggcctggagcacagaccctag

SEQ ID NO: 10126 - DNA, 2472 bp, Artificial Sequence
  Description of Artificial Sequence: Synthetic coding sequence
atgaagatcaacaacgaggagatcgtgagcgaccccatctacatcgaggtgcagggcctgccccacttcaccaagcagcccgagagcatgaacgtgaccagaaacaccgccttcaacctgacctgccaggccgtgggcccccccgagcccgtgaacatcttctgggtgcagaacagcagcagagtgaacgagcagcccgagaagagccccagcgtgctgaccgtgcccggcctgaccgagatggccgtgttcagctgcgaggcccacaacgacaagggcctgaccgtgagcaagggcgtgcagatcaacatcaaggccatccccagcccccccaccgaggtgagcatcagaaacagcaccgcccacagcatcctgatcagctgggtgcccggcttcgacggctacagccccttcagaaactgcagcatccaggtgaaggaggccgaccccctgagcaacggcagcgtgatgatcttcaacaccagcgccctgccccacctgtaccagatcaagcagctgcaggccctggccaactacagcatcggcgtgagctgcatgaacgagatcggctggagcgccgtgagcccctggatcctggccagcaccaccgagggcgcccccagcgtggcccccctgaacgtgaccgtgttcctgaacgagagcagcgacaacgtggacatcagatggatgaagccccccaccaagcagcaggacggcgagctggtgggctacagaatcagccacgtgtggcagagcgccggcatcagcaaggagctgctggaggaggtgggccagaacggcagcagagccagaatcagcgtgcaggtgcacaacgccacctgcaccgtgagaatcgccgccgtgaccagaggcggcgtgggccccttcagcgaccccgtgaagatcttcatccccgcccacggctgggtggactacgcccccagcagcacccccgcccccggcaacgccgaccccgtgctgatcatcttcggctgcttctgcggcttcatcctgatcggcctgatcctgtacatcagcctggccatcagaaagagagtgcaggagaccaagttcggcaacgccttcaccgaggaggacagcgagctggtggtgaactacatcgccaagaagagcttctgcagaagagccatcgagctgaccctgcacagcctgggcgtgagcgaggagctgcagaacaagctggaggacgtggtgatcgacagaaacctgctgatcctgggcaagatcctgggcgagggcgagttcggcagcgtgatggagggcaacctgaagcaggaggacggcaccagcctgaaggtggccgtgaagaccatgaagctggacaacagcagccagagagagatcgaggagttcctgagcgaggccgcctgcatgaaggacttcagccaccccaacgtgatcagactgctgggcgtgtgcatcgagatgagcagccagggcatccccaagcccatggtgatcctgcccttcatgaagtacggcgacctgcacacctacctgctgtacagcagactggagaccggccccaagcacatccccctgcagaccctgctgaagttcatggtggacatcgccctgggcatggagtacctgagcaacagaaacttcctgcacagagacctggccgccagaaactgcatgctgagagacgacatgaccgtgtgcgtggccgacttcggcctgagcaagaagatctacagcggcgactactacagacagggcagaatcgccaagatgcccgtgaagtggatcgccatcgagagcctggccgacagagtgtacaccagcaagagcgacgtgtgggccttcggcgtgaccatgtgggagatcgccaccagaggcatgaccccctaccccggcgtgcagaaccacgagatgtacgactacctgctgcacggccacagactgaagcagcccgaggactgcctggacgagctgtacgagatcatgtacagctgctggagaaccgaccccctggacagacccaccttcagcgtgctgagactgcagctggagaagctgctggagagcctgcccgacgtgagaaaccaggccgacgtgatctacgtgaacacccagctgctggagagcagcgagggcctggcccagggcagcaccctggcccccctggacctgaacatcgaccccgacagcatcatcgccagctgcacccccagagccgccatcagcgtggtgaccgccgaggtgcacgacagcaagccccacgagggcagatacatcctgaacggcggcagcgaggagtgggaggacctgaccagcgcccccagcgccgccgtgaccgccgagaagaacagcgtgctgcccggcgagagactggtgagaaacggcgtgagctggagccacagcagcatgctgcccctgggcagcagcctgcccgacgagctgctgttcgccgacgacagcagcgagggcagcgaggtgctgatgtag

SEQ ID NO: 10127 - DNA, 3000 bp, Artificial Sequence; identical to SEQ ID NO: 10124
  Description of Artificial Sequence: Synthetic coding sequence

SEQ ID NO: 10128 - DNA, 501 bp, Artificial Sequence
  Description of Artificial Sequence: Synthetic coding sequence
atggccagcggcgtggccgtgagcgacggcgtgatcaaggtgttcaacgacatgaaggtgagaaagagcagcacccccgaggaggtgaagaagagaaagaaggccgtgctgttctgcctgagcgaggacaagaagaacatcatcctggaggagggcaaggagatcctggtgggcgacgtgggccagaccgtggacgacccctacgccaccttcgtgaagatgctgcccgacaaggactgcagatacgccctgtacgacgccacctacgagaccaaggagagcaagaaggaggacctggtgttcatcttctgggcccccgagagcgcccccctgaagagcaagatgatctacgccagcagcaaggacgccatcaagaagaagctgaccggcatcaagcacgagctgcaggccaactgctacgaggaggtgaaggacagatgcaccctggccgagaagctgggcggcagcgccgtgatcagcctggagggcaagcccctgtag

SEQ ID NO: 10129 - DNA, 501 bp, Artificial Sequence; identical to SEQ ID NO: 10128
  Description of Artificial Sequence: Synthetic coding sequence

SEQ ID NO: 10130 - DNA, 276 bp, Artificial Sequence
  Description of Artificial Sequence: Synthetic coding sequence
atggccagcggcgtggccgtgagcgacggcgtgatcaaggtgttcaacgacatgaaggtgagaaagagcagcacccccgaggaggtgaagaagagaaagaaggccgtgctgttctgcctgagcgaggacaagaagaacatcatcctggaggagggcaaggagatcctggtgggcgacgtgggccagaccgtggacgacccctacgccaccttcgtgaagatgctgcccgacaaggactgcagatacgccctgtacgacgccacctacgagacctag

SEQ ID NO: 10131 - DNA, 4101 bp, Artificial Sequence
  Description of Artificial Sequence: Synthetic coding sequence
atgctgagcttcgtggacaccagaaccctgctgctgctggccgtgaccctgtgcctggccacctgccagagcctgcaggaggagaccgtgagaaagggccccgccggcgacagaggccccagaggcgagagaggcccccccggcccccccggcagagacggcgaggacggccccaccggcccccccggcccccccggcccccccggcccccccggcctgggcggcaacttcgccgcccagtacgacggcaagggcgtgggcctgggccccggccccatgggcctgatgggccccagaggcccccccggcgccgccggcgcccccggcccccagggcttccagggccccgccggcgagcccggcgagcccggccagaccggccccgccggcgccagaggccccgccggcccccccggcaaggccggcgaggacggccaccccggcaagcccggcagacccggcgagagaggcgtggtgggcccccagggcgccagaggcttccccggcacccccggcctgcccggcttcaagggcatcagaggccacaacggcctggacggcctgaagggccagcccggcgcccccggcgtgaagggcgagcccggcgcccccggcgagaacggcacccccggccagaccggcgccagaggcctgcccggcgagagaggcagagtgggcgcccccggccccgccggcgccagaggcagcgacggcagcgtgggccccgtgggccccgccggccccatcggcagcgccggcccccccggcttccccggcgcccccggccccaagggcgagatcggcgccgtgggcaacgccggccccgccggccccgccggccccagaggcgaggtgggcctgcccggcctgagcggccccgtgggcccccccggcaaccccggcgccaacggcctgaccggcgccaagggcgccgccggcctgcccggcgtggccggcgcccccggcctgcccggccccagaggcatccccggccccgtgggcgccgccggcgccaccggcgccagaggcctggtgggcgagcccggccccgccggcagcaagggcgagagcggcaacaagggcgagcccggcagcgccggcccccagggcccccccggccccagcggcgaggagggcaagagaggccccaacggcgaggccggcagcgccggcccccccggcccccccggcctgagaggcagccccggcagcagaggcctgcccggcgccgacggcagagccggcgtgatgggcccccccggcagcagaggcgccagcggccccgccggcgtgagaggccccaacggcgacgccggcagacccggcgagcccggcctgatgggccccagaggcctgcccggcagccccggcaacatcggccccgccggcaaggagggccccgtgggcctgcccggcatcgacggcagacccggccccatcggccccgccggcgccagaggcgagcccggcaacatcggcttccccggccccaagggccccaccggcgaccccggcaagaacggcgacaagggccacgccggcctggccggcgccagaggcgcccccggccccgacggcaacaacggcgcccagggcccccccggcccccagggcgtgcagggcggcaagggcgagcagggcccccccggcccccccggcttccagggcctgcccggccccagcggccccgccggcgaggtgggcaagcccggcgagagaggcctgcacggcgagttcggcctgcccggccccgccggccccagaggcgagagaggcccccccggcgagagcggcgccgccggccccaccggccccatcggcagcagaggccccagcggcccccccggccccgacggcaacaagggcgagcccggcgtggtgggcgccgtgggcaccgccggccccagcggccccagcggcctgcccggcgagagaggcgccgccggcatccccggcggcaagggcgagaagggcgagcccggcctgagaggcgagatcggcaaccccggcagagacggcgccagaggcgcccccggcgccgtgggcgcccccggccccgccggcgccaccggcgacagaggcgaggccggcgccgccggccccgccggccccgccggccccagaggcagccccggcgagagaggcgaggtgggccccgccggccccaacggcttcgccggccccgccggcgccgccggccagcccggcgccaagggcgagagaggcgccaagggccccaagggcgagaacggcgtggtgggccccaccggccccgtgggcgccgccggccccgccggccccaacggcccccccggccccgccggcagcagaggcgacggcggcccccccggcatgaccggcttccccggcgccgccggcagaaccggcccccccggccccagcggcatcagcggcccccccggcccccccggccccgccggcaaggagggcctgagaggccccagaggcgaccagggccccgtgggcagaaccggcgaggtgggcgccgtgggcccccccggcttcgccggcgagaagggccccagcggcgaggccggcaccgccggcccccccggcacccccggcccccagggcctgctgggcgcccccggcatcctgggcctgcccggcagcagaggcgagagaggcctgcccggcgtggccggcgccgtgggcgagcccggccccctgggcatcgccggcccccccggcgccagaggcccccccggcgccgtgggcagccccggcgtgaacggcgcccccggcgaggccggcagagacggcaaccccggcaacgacggcccccccggcagagacggccagcccggccacaagggcgagagaggctaccccggcaacatcggccccgtgggcgccgccggcgcccccggcccccacggccccgtgggccccgccggcaagcacggcaacagaggcgagaccggccccagcggccccgtgggccccgccggcgccgtgggccccagaggccccagcggcccccagggcatcagaggcgacaagggcgagcccggcgagaagggccccagaggcctgcccggcctgaagggccacaacggcctgcagggcctgcccggcatcgccggccaccacggcgaccagggcgcccccggcagcgtgggccccgccggccccagaggccccgccggccccagcggccccgccggcaaggacggcagaaccggccaccccggcaccgtgggccccgccggcatcagaggcccccagggccaccagggccccgccggcccccccggcccccccggcccccccggcccccccggcgtgagcggcggcggctacgacttcggctacgacggcgacttctacagagccgaccagcccagaagcgcccccagcctgagacccaaggactacgaggtggacgccaccctgaagagcctgaacaaccagatcgagaccctgctgacccccgagggcagcagaaagaaccccgccagaacctgcagagacctgagactgagccaccccgagtggagcagcggctactactggatcgaccccaaccagggctgcaccatggacgccatcaaggtgtactgcgacttcagcaccggcgagacctgcatcagagcccagcccgagaacatccccgccaagaactggtacagaagcagcaaggacaagaagcacgtgtggctgggcgagaccatcaacgccggcagccagttcgagtacaacgtggagggcgtgaccagcaaggagatggccacccagctggccttcatgagactgctggccaactacgccagccagaacatcacctaccactgcaagaacagcatcgcctacatggacgaggagaccggcaacctgaagaaggccgtgatcctgcagggcagcaacgacgtggagctggtggccgagggcaacagcagattcacctacaccgtgctggtggacggctgcagcaagaagaccaacgagtggggcaagaccatcatcgagtacaagaccaacaagcccagcagactgcccttcctggacatcgcccccctggacatcggcggcgccgaccaggagttcttcgtggacatcggccccgtgtgcttcaagtag

SEQ ID NO: 10132 - DNA, 4104 bp, Artificial Sequence
  Description of Artificial Sequence: Synthetic coding sequence
atgctgagcttcgtggacaccagaaccctgctgctgctggccgtgaccctgtgcctggccacctgccagtgcaccctgggcggccagaccctgagcaagttccccccctacctgcacatcgagagaagcgagcagggcccccccggcccccccggcagagacggcgaggacggccccaccggcccccccggcccccccggcccccccggcccccccggcctgggcggcaacttcgccgcccagtacgacggcaagggcgtgggcctgggccccggccccatgggcctgatgggccccagaggcccccccggcgccgccggcgcccccggcccccagggcttccagggccccgccggcgagcccggcgagcccggccagaccggccccgccggcgccagaggccccgccggcccccccggcaaggccggcgaggacggccaccccggcaagcccggcagacccggcgagagaggcgtggtgggcccccagggcgccagaggcttccccggcacccccggcctgcccggcttcaagggcatcagaggccacaacggcctggacggcctgaagggccagcccggcgcccccggcgtgaagggcgagcccggcgcccccggcgagaacggcacccccggccagaccggcgccagaggcctgcccggcgagagaggcagagtgggcgcccccggccccgccggcgccagaggcagcgacggcagcgtgggccccgtgggccccgccggccccatcggcagcgccggcccccccggcttccccggcgcccccggccccaagggcgagatcggcgccgtgggcaacgccggccccgccggccccgccggccccagaggcgaggtgggcctgcccggcctgagcggccccgtgggcccccccggcaaccccggcgccaacggcctgaccggcgccaagggcgccgccggcctgcccggcgtggccggcgcccccggcctgcccggccccagaggcatccccggccccgtgggcgccgccggcgccaccggcgccagaggcctggtgggcgagcccggccccgccggcagcaagggcgagagcggcaacaagggcgagcccggcagcgccggcccccagggcccccccggccccagcggcgaggagggcaagagaggccccaacggcgaggccggcagcgccggcccccccggcccccccggcctgagaggcagccccggcagcagaggcctgcccggcgccgacggcagagccggcgtgatgggcccccccggcagcagaggcgccagcggccccgccggcgtgagaggccccaacggcgacgccggcagacccggcgagcccggcctgatgggccccagaggcctgcccggcagccccggcaacatcggccccgccggcaaggagggccccgtgggcctgcccggcatcgacggcagacccggccccatcggccccgccggcgccagaggcgagcccggcaacatcggcttccccggccccaagggccccaccggcgaccccggcaagaacggcgacaagggccacgccggcctggccggcgccagaggcgcccccggccccgacggcaacaacggcgcccagggcccccccggcccccagggcgtgcagggcggcaagggcgagcagggcccccccggcccccccggcttccagggcctgcccggccccagcggccccgccggcgaggtgggcaagcccggcgagagaggcctgcacggcgagttcggcctgcccggccccgccggccccagaggcgagagaggcccccccggcgagagcggcgccgccggccccaccggccccatcggcagcagaggccccagcggcccccccggccccgacggcaacaagggcgagcccggcgtggtgggcgccgtgggcaccgccggccccagcggccccagcggcctgcccggcgagagaggcgccgccggcatccccggcggcaagggcgagaagggcgagcccggcctgagaggcgagatcggcaaccccggcagagacggcgccagaggcgcccccggcgccgtgggcgcccccggccccgccggcgccaccggcgacagaggcgaggccggcgccgccggccccgccggccccgccggccccagaggcagccccggcgagagaggcgaggtgggccccgccggccccaacggcttcgccggccccgccggcgccgccggccagcccggcgccaagggcgagagaggcgccaagggccccaagggcgagaacggcgtggtgggccccaccggccccgtgggcgccgccggccccgccggccccaacggcccccccggccccgccggcagcagaggcgacggcggcccccccggcatgaccggcttccccggcgccgccggcagaaccggcccccccggccccagcggcatcagcggcccccccggcccccccggccccgccggcaaggagggcctgagaggccccagaggcgaccagggccccgtgggcagaaccggcgaggtgggcgccgtgggcccccccggcttcgccggcgagaagggccccagcggcgaggccggcaccgccggcccccccggcacccccggcccccagggcctgctgggcgcccccggcatcctgggcctgcccggcagcagaggcgagagaggcctgcccggcgtggccggcgccgtgggcgagcccggccccctgggcatcgccggcccccccggcgccagaggcccccccggcgccgtgggcagccccggcgtgaacggcgcccccggcgaggccggcagagacggcaaccccggcaacgacggcccccccggcagagacggccagcccggccacaagggcgagagaggctaccccggcaacatcggccccgtgggcgccgccggcgcccccggcccccacggccccgtgggccccgccggcaagcacggcaacagaggcgagaccggccccagcggccccgtgggccccgccggcgccgtgggccccagaggccccagcggcccccagggcatcagaggcgacaagggcgagcccggcgagaagggccccagaggcctgcccggcctgaagggccacaacggcctgcagggcctgcccggcatcgccggccaccacggcgaccagggcgcccccggcagcgtgggccccgccggccccagaggccccgccggccccagcggccccgccggcaaggacggcagaaccggccaccccggcaccgtgggccccgccggcatcagaggcccccagggccaccagggccccgccggcccccccggcccccccggcccccccggcccccccggcgtgagcggcggcggctacgacttcggctacgacggcgacttctacagagccgaccagcccagaagcgcccccagcctgagacccaaggactacgaggtggacgccaccctgaagagcctgaacaaccagatcgagaccctgctgacccccgagggcagcagaaagaaccccgccagaacctgcagagacctgagactgagccaccccgagtggagcagcggctactactggatcgaccccaaccagggctgcaccatggacgccatcaaggtgtactgcgacttcagcaccggcgagacctgcatcagagcccagcccgagaacatccccgccaagaactggtacagaagcagcaaggacaagaagcacgtgtggctgggcgagaccatcaacgccggcagccagttcgagtacaacgtggagggcgtgaccagcaaggagatggccacccagctggccttcatgagactgctggccaactacgccagccagaacatcacctaccactgcaagaacagcatcgcctacatggacgaggagaccggcaacctgaagaaggccgtgatcctgcagggcagcaacgacgtggagctggtggccgagggcaacagcagattcacctacaccgtgctggtggacggctgcagcaagaagaccaacgagtggggcaagaccatcatcgagtacaagaccaacaagcccagcagactgcccttcctggacatcgcccccctggacatcggcggcgccgaccaggagttcttcgtggacatcggccccgtgtgcttcaagtag

SEQ ID NO: 10133 - DNA, 4401 bp, Artificial Sequence
  Description of Artificial Sequence: Synthetic coding sequence
atgatgagcttcgtgcagaagggcagctggctgctgctggccctgctgcaccccaccatcatcctggcccagcaggaggccgtggagggcggctgcagccacctgggccagagctacgccgacagagacgtgtggaagcccgagccctgccagatctgcgtgtgcgacagcggcagcgtgctgtgcgacgacatcatctgcgacgaccaggagctggactgccccaaccccgagatccccttcggcgagtgctgcgccgtgtgcccccagccccccaccgcccccaccagaccccccaacggccagggcccccagggccccaagggcgaccccggcccccccggcatccccggcagaaacggcgaccccggcatccccggccagcccggcagccccggcagccccggcccccccggcatctgcgagagctgccccaccggcccccagaactacagcccccagtacgacagctacgacgtgaagagcggcgtggccgtgggcggcctggccggctaccccggccccgccggcccccccggcccccccggcccccccggcaccagcggccaccccggcagccccggcagccccggctaccagggcccccccggcgagcccggccaggccggccccagcggcccccccggcccccccggcgccatcggccccagcggccccgccggcaaggacggcgagagcggcagacccggcagacccggcgagagaggcctgcccggcccccccggcatcaagggccccgccggcatccccggcttccccggcatgaagggccacagaggcttcgacggcagaaacggcgagaagggcgagaccggcgcccccggcctgaagggcgagaacggcctgcccggcgagaacggcgcccccggccccatgggccccagaggcgcccccggcgagagaggcagacccggcctgcccggcgccgccggcgccagaggcaacgacggcgccagaggcagcgacggccagcccggcccccccggcccccccggcaccgccggcttccccggcagccccggcgccaagggcgaggtgggccccgccggcagccccggcagcaacggcgcccccggccagagaggcgagcccggcccccagggccacgccggcgcccagggcccccccggcccccccggcatcaacggcagccccggcggcaagggcgagatgggccccgccggcatccccggcgcccccggcctgatgggcgccagaggcccccccggccccgccggcgccaacggcgcccccggcctgagaggcggcgccggcgagcccggcaagaacggcgccaagggcgagcccggccccagaggcgagagaggcgaggccggcatccccggcgtgcccggcgccaagggcgaggacggcaaggacggcagccccggcgagcccggcgccaacggcctgcccggcgccgccggcgagagaggcgcccccggcttcagaggccccgccggccccaacggcatccccggcgagaagggccccgccggcgagagaggcgcccccggccccgccggccccagaggcgccgccggcgagcccggcagagacggcgtgcccggcggccccggcatgagaggcatgcccggcagccccggcggccccggcagcgacggcaagcccggcccccccggcagccagggcgagagcggcagacccggcccccccggccccagcggccccagaggccagcccggcgtgatgggcttccccggccccaagggcaacgacggcgcccccggcaagaacggcgagagaggcggccccggcggccccggcccccagggcccccccggcaagaacggcgagaccggcccccagggcccccccggccccaccggccccggcggcgacaagggcgacaccggcccccccggcccccagggcctgcagggcctgcccggcaccggcggcccccccggcgagaacggcaagcccggcgagcccggccccaagggcgacgccggcgcccccggcgcccccggcggcaagggcgacgccggcgcccccggcgagagaggcccccccggcctggccggcgcccccggcctgagaggcggcgccggcccccccggccccgagggcggcaagggcgccgccggcccccccggcccccccggcgccgccggcacccccggcctgcagggcatgcccggcgagagaggcggcctgggcagccccggccccaagggcgacaagggcgagcccggcggccccggcgccgacggcgtgcccggcaaggacggccccagaggccccaccggccccatcggcccccccggccccgccggccagcccggcgacaagggcgagggcggcgcccccggcctgcccggcatcgccggccccagaggcagccccggcgagagaggcgagaccggcccccccggccccgccggcttccccggcgcccccggccagaacggcgagcccggcggcaagggcgagagaggcgcccccggcgagaagggcgagggcggcccccccggcgtggccggcccccccggcggcagcggccccgccggcccccccggcccccagggcgtgaagggcgagagaggcagccccggcggccccggcgccgccggcttccccggcgccagaggcctgcccggcccccccggcagcaacggcaaccccggcccccccggccccagcggcagccccggcaaggacggcccccccggccccgccggcaacaccggcgcccccggcagccccggcgtgagcggccccaagggcgacgccggccagcccggcgagaagggcagccccggcgcccagggcccccccggcgcccccggccccctgggcatcgccggcatcaccggcgccagaggcctggccggcccccccggcatgcccggccccagaggcagccccggcccccagggcgtgaagggcgagagcggcaagcccggcgccaacggcctgagcggcgagagaggcccccccggcccccagggcctgcccggcctggccggcaccgccggcgagcccggcagagacggcaaccccggcagcgacggcctgcccggcagagacggcagccccggcggcaagggcgacagaggcgagaacggcagccccggcgcccccggcgcccccggccaccccggcccccccggccccgtgggccccgccggcaagagcggcgacagaggcgagagcggccccgccggccccgccggcgcccccggccccgccggcagcagaggcgcccccggcccccagggccccagaggcgacaagggcgagaccggcgagagaggcgccgccggcatcaagggccacagaggcttccccggcaaccccggcgcccccggcagccccggccccgccggccagcagggcgccatcggcagccccggccccgccggccccagaggccccgtgggccccagcggcccccccggcaaggacggcaccagcggccaccccggccccatcggcccccccggccccagaggcaacagaggcgagagaggcagcgagggcagccccggccaccccggccagcccggcccccccggcccccccggcgcccccggcccctgctgcggcggcgtgggcgccgccgccatcgccggcatcggcggcgagaaggccggcggcttcgccccctactacggcgacgagcccatggacttcaagatcaacaccgacgagatcatgaccagcctgaagagcgtgaacggccagatcgagagcctgatcagccccgacggcagcagaaagaaccccgccagaaactgcagagacctgaagttctgccaccccgagctgaagagcggcgagtactgggtggaccccaaccagggctgcaagctggacgccatcaaggtgttctgcaacatggagaccggcgagacctgcatcagcgccaaccccctgaacgtgcccagaaagcactggtggaccgacagcagcgccgagaagaagcacgtgtggttcggcgagagcatggacggcggcttccagttcagctacggcaaccccgagctgcccgaggacgtgctggacgtgcacctggccttcctgagactgctgagcagcagagccagccagaacatcacctaccactgcaagaacagcatcgcctacatggaccaggccagcggcaacgtgaagaaggccctgaagctgatgggcagcaacgagggcgagttcaaggccgagggcaacagcaagttcacctacaccgtgctggaggacggctgcaccaagcacaccggcgagtggagcaagaccgtgttcgagtacagaaccagaaaggccgtgagactgcccatcgtggacatcgccccctacgacatcggcggccccgaccaggagttcggcgtggacgtgggccccgtgtgcttcctgtag

SEQ ID NO: 10134 - DNA, 3492 bp, Artificial Sequence
  Description of Artificial Sequence: Synthetic coding sequence
atgatgagcttcgtgcagaagggcagctggctgctgctggccctgctgcaccccaccatcatcctggcccagcaggaggccgtggagggcggctgcagccacctgggccagagctacgccgacagagacgtgtggaagcccgagccctgccagatctgcgtgtgcgacagcggcagcgtgctgtgcgacgacatcatctgcgacgaccaggagctggactgccccaaccccgagatccccttcggcgagtgctgcgccgtgtgcccccagccccccaccgcccccaccagaccccccaacggccagggcccccagggccccaagggcgaccccggcccccccggcatccccggcagaaacggcgaccccggcatccccggccagcccggcagccccggcagccccggcccccccggcatctgcgagagctgccccaccggcccccagaactacagcccccagtacgacagctacgacgtgaagagcggcgtggccgtgggcggcctggccggctaccccggccccgccggcccccccggcccccccggcccccccggcaccagcggccaccccggcagccccggcagccccggctaccagggcccccccggcgagcccggccaggccggccccagcggcccccccggcccccccggcgccatcggccccagcggccccgccggcaaggacggcgagagcggcagacccggcagacccggcgagagaggcctgcccggcccccccggcatcaagggccccgccggcatccccggcttccccggcatgaagggccacagaggcttcgacggcagaaacggcgagaagggcgagaccggcgcccccggcctgaagggcgagaacggcctgcccggcgagaacggcgcccccggccccatgggccccagaggcgcccccggcgagagaggcagacccggcctgcccggcgccgccggcgccagaggcaacgacggcgccagaggcagcgacggccagcccggcccccccggcccccccggcaccgccggcttccccggcagccccggcgccaagggcgaggtgggccccgccggcagccccggcagcaacggcgcccccggccagagaggcgagcccggcccccagggccacgccggcgcccagggcccccccggcccccccggcatcaacggcagccccggcggcaagggcgagatgggccccgccggcatccccggcgcccccggcctgatgggcgccagaggcccccccggccccgccggcgccaacggcgcccccggcctgagaggcggcgccggcgagcccggcaagaacggcgccaagggcgagcccggccccagaggcgagagaggcgaggccggcatccccggcgtgcccggcgccaagggcgaggacggcaaggacggcagccccggcgagcccggcgccaacggcctgcccggcgccgccggcgagagaggcgcccccggcttcagaggccccgccggccccaacggcatccccggcgagaagggccccgccggcgagagaggcgcccccggccccgccggccccagaggcgccgccggcgagcccggcagagacggcgtgcccggcggccccggcatgagaggcatgcccggcagccccggcggccccggcagcgacggcaagcccggcccccccggcagccagggcgagagcggcagacccggcccccccggccccagcggccccagaggccagcccggcgtgatgggcttccccggccccaagggcaacgacggcgcccccggcaagaacggcgagagaggcggccccggcggccccggcccccagggcccccccggcaagaacggcgagaccggcccccagggcccccccggccccaccggccccggcggcgacaagggcgacaccggcccccccggcccccagggcctgcagggcctgcccggcaccggcggcccccccggcgagaacggcaagcccggcgagcccggccccaagggcgacgccggcgcccccggcgcccccggcggcaagggcgacgccggcgcccccggcgagagaggcccccccggcctggccggcgcccccggcctgagaggcggcgccggcccccccggccccgagggcggcaagggcgccgccggcccccccggcccccccggcgccgccggcacccccggcctgcagggcatgcccggcgagagaggcggcctgggcagccccggccccaagggcgacaagggcgagcccggcggccccggcgccgacggcgtgcccggcaaggacggccccagaggccccaccggccccatcggcccccccggccccgccggccagcccggcgacaagggcgagggcggcgcccccggcctgcccggcatcgccggccccagaggcagccccggcgagagaggcgagaccggcccccccggccccgccggcttccccggcgcccccggccagaacggcgagcccggcggcaagggcgagagaggcgcccccggcgagaagggcgagggcggcccccccggcctgttcggcccccccggcaaggacggcaccagcggccaccccggccccatcggcccccccggccccagaggcaacagaggcgagagaggcagcgagggcagccccggccaccccggccagcccggcccccccggcccccccggcgcccccggcccctgctgcggcggcgtgggcgccgccgccatcgccggcatcggcggcgagaaggccggcggcttcgccccctactacggcgacgagcccatggacttcaagatcaacaccgacgagatcatgaccagcctgaagagcgtgaacggccagatcgagagcctgatcagccccgacggcagcagaaagaaccccgccagaaactgcagagacctgaagttctgccaccccgagctgaagagcggcgagtactgggtggaccccaaccagggctgcaagctggacgccatcaaggtgttctgcaacatggagaccggcgagacctgcatcagcgccaaccccctgaacgtgcccagaaagcactggtggaccgacagcagcgccgagaagaagcacgtgtggttcggcgagagcatggacggcggcttccagttcagctacggcaaccccgagctgcccgaggacgtgctggacgtgcacctggccttcctgagactgctgagcagcagagccagccagaacatcacctaccactgcaagaacagcatcgcctacatggaccaggccagcggcaacgtgaagaaggccctgaagctgatgggcagcaacgagggcgagttcaaggccgagggcaacagcaagttcacctacaccgtgctggaggacggctgcaccaagcacaccggcgagtggagcaagaccgtgttcgagtacagaaccagaaaggccgtgagactgcccatcgtggacatcgccccctacgacatcggcggccccgaccaggagttcggcgtggacgtgggccccgtgtgcttcctgtag

SEQ ID NO: 10135 - DNA, 5139 bp, Artificial Sequence
  Description of Artificial Sequence: Synthetic coding sequence
atgggcagagaccagagagccgtggccggccccgccctgagaagatggctgctgctgggcaccgtgaccgtgggcttcctggcccagagcgtgctggccggcgtgaagaagttcgacgtgccctgcggcggcagagactgcagcggcggctgccagtgctaccccgagaagggcggcagaggccagcccggccccgtgggcccccagggctacaacggcccccccggcctgcagggcttccccggcctgcagggcagaaagggcgacaagggcgagagaggcgcccccggcgtgaccggccccaagggcgacgtgggcgccagaggcgtgagcggcttccccggcgccgacggcatccccggccaccccggccagggcggccccagaggcagacccggctacgacggctgcaacggcacccagggcgacagcggcccccagggcccccccggcagcgagggcttcaccggcccccccggcccccagggccccaagggccagaagggcgagccctacgccctgcccaaggaggagagagacagatacagaggcgagcccggcgagcccggcctggtgggcttccagggcccccccggcagacccggccacgtgggccagatgggccccgtgggcgcccccggcagacccggccccagcagcgacgagagcttcaagaacaagctgaagaacaagggcctgaactactacaccgtgaacagcatgcagggcgacgtgggccagcccggccccaacggcatccccagcgacaccctgcaccccatcatcgcccccaccggcgtgaccttccaccccgaccagtacaagggccccgtgggctggagaggcagaccctgggtggccggcatcagcctgaagggcgaggagggcatcatgggcttccccggcctgagaggctaccccggcctgagcggcgagaagggcagccccggccagaagggcagcagaggcctggacggctaccagggccccgacggccccagaggccccaagggcgaggccggcgaccccggcccccccggcctgcccgcctacagcccccaccccagcctggccaagggcgccagaggcgaccccggcttccccggcgcccagggcgagcccggcagccagggcgagcccggcgaccccggcctgcccggcccccccggcctgagcatcggcgacggcgaccagagaagaggcctgcccggcgagatgggccccaagggcttcatcggcgaccccggcatccccgccctgtacggcggcccccccggccccgacggcaagagaggcccccccggcccccccggcctgcccggcccccccggccccgacggcttcctgttcggcctgaagggcgccaagggcagagccggcttccccggcctgcccggcagccccggcgccagaggccccaagggctggaagggcgacgccggcgagtgcagatgcaccgagggcgacgaggccatcaagggcctgcccggcctgcccggccccaagggcttcgccggcatcaacggcgagcccggcagaaagggcgacagaggcgaccccggccagcacggcctgcccggcttccccggcctgaagggcgtgcccggcaacatcggcgcccccggccccaagggcgccaagggcgacagcagaaccatcaccaccaagggcgagagaggccagcccggcgtgcccggcgtgcccggcatgaagggcgacgacggcagccccggcagagacggcctggacggcttccccggcctgcccggcccccccggcgacggcatcaagggcccccccggcgaccccggctaccccggcatccccggcaccaagggcacccccggcgagatgggcccccccggcctgggcctgcccggcctgaagggccagagaggcttccccggcgacgccggcctgcccggcccccccggcttcctgggcccccccggccccgccggcacccccggccagatcgactgcgacaccgacgtgaagagagccgtgggcggcgacagacaggaggccatccagcccggctgcatcggcggccccaagggcctgcccggcctgcccggcccccccggccccaccggcgccaagggcctgagaggcatccccggcttcgccggcgccgacggcggccccggccccagaggcctgcccggcgacgccggcagagagggcttccccggcccccccggcttcatcggccccagaggcagcaagggcgccgtgggcctgcccggccccgacggcagccccggccccatcggcctgcccggccccgacggcccccccggcgagagaggcctgcccggcgaggtgctgggcgcccagcccggccccagaggcgacgccggcgtgcccggccagcccggcctgaagggcctgcccggcgacagaggcccccccggcttcagaggcagccagggcatgcccggcatgcccggcctgaagggccagcccggcctgcccggccccagcggccagcccggcctgtacggcccccccggcctgcacggcttccccggcgcccccggccaggagggccccctgggcctgcccggcatccccggcagagagggcctgcccggcgacagaggcgaccccggcgacaccggcgcccccggccccgtgggcatgaagggcctgagcggcgacagaggcgacgccggcttcaccggcgagcagggccaccccggcagccccggcttcaagggcatcgacggcatgcccggcacccccggcctgaagggcgacagaggcagccccggcatggacggcttccagggcatgcccggcctgaagggcagacccggcttccccggcagcaagggcgaggccggcttcttcggcatccccggcctgaagggcctggccggcgagcccggcttcaagggcagcagaggcgaccccggcccccccggccccccccccgtgatcctgcccggcatgaaggacatcaagggcgagaagggcgacgagggccccatgggcctgaagggctacctgggcgccaagggcatccagggcatgcccggcatccccggcctgagcggcatccccggcctgcccggcagacccggccacatcaagggcgtgaagggcgacatcggcgtgcccggcatccccggcctgcccggcttccccggcgtggccggcccccccggcatcaccggcttccccggcttcatcggcagcagaggcgacaagggcgcccccggcagagccggcctgtacggcgagatcggcgccaccggcgacttcggcgacatcggcgacaccatcaacctgcccggcagacccggcctgaagggcgagagaggcaccaccggcatccccggcctgaagggcttcttcggcgagaagggcaccgagggcgacatcggcttccccggcatcaccggcgtgaccggcgtgcagggcccccccggcctgaagggccagaccggcttccccggcctgaccggcccccccggcagccagggcgagctgggcagaatcggcctgcccggcggcaagggcgacgacggctggcccggcgcccccggcctgcccggcttccccggcctgagaggcatcagaggcctgcacggcctgcccggcaccaagggcttccccggcagccccggcagcgacatccacggcgaccccggcttccccggcccccccggcgagagaggcgaccccggcgaggccaacaccctgcccggccccgtgggcgtgcccggccagaagggcgaccagggcgcccccggcgagagaggcccccccggcagccccggcctgcagggcttccccggcatcaccccccccagcaacatcagcggcgcccccggcgacaagggcgcccccggcatcttcggcctgaagggctacagaggcccccccggcccccccggcagcgccgccctgcccggcagcaagggcgacaccggcaaccccggcgcccccggcacccccggcaccaagggctgggccggcgacagcggcccccagggcagacccggcgtgttcggcctgcccggcgagaagggccccagaggcgagcagggcttcatgggcaacaccggccccaccggcgccgtgggcgacagaggccccaagggccccaagggcgaccccggcttccccggcgcccccggcaccgtgggcgcccccggcatcgccggcatcccccagaagatcgccgtgcagcccggcaccgtgggcccccagggcagaagaggcccccccggcgcccccggcgagatgggcccccagggcccccccggcgagcccggcttcagaggcgcccccggcaaggccggcccccagggcagaggcggcgtgagcgccgtgcccggcttcagaggcgacgagggccccatcggccaccagggccccatcggccaggagggcgcccccggcagacccggcagccccggcctgcccggcatgcccggcagaagcgtgagcatcggctacctgctggtgaagcacagccagaccgaccaggagcccatgtgccccgtgggcatgaacaagctgtggagcggctacagcctgctgtacttcgagggccaggagaaggcccacaaccaggacctgggcctggccggcagctgcctggccagattcagcaccatgcccttcctgtactgcaaccccggcgacgtgtgctactacgccagcagaaacgacaagagctactggctgagcaccaccgcccccctgcccatgatgcccgtggccgaggacgagatcaagccctacatcagcagatgcagcgtgtgcgaggcccccgccatcgccatcgccgtgcacagccaggacgtgagcatcccccactgccccgccggctggagaagcctgtggatcggctacagcttcctgatgcacaccgccgccggcgacgagggcggcggccagagcctggtgagccccggcagctgcctggaggacttcagagccacccccttcatcgagtgcaacggcggcagaggcacctgccactactacgccaacaagtacagcttctggctgaccaccatccccgagcagagcttccagggcagccccagcgccgacaccctgaaggccggcctgatcagaacccacatcagcagatgccaggtgtgcatgaagaacctgtag

SEQ ID NO: 10136 - DNA, 5139 bp, Artificial Sequence
  Description of Artificial Sequence: Synthetic coding sequence
atgggcagagaccagagagccgtggccggccccgccctgagaagatggctgctgctgggcaccgtgaccgtgggcttcctggcccagagcgtgctggccggcgtgaagaagttcgacgtgccctgcggcggcagagactgcagcggcggctgccagtgctaccccgagaagggcggcagaggccagcccggccccgtgggcccccagggctacaacggcccccccggcctgcagggcttccccggcctgcagggcagaaagggcgacaagggcgagagaggcgcccccggcgtgaccggccccaagggcgacgtgggcgccagaggcgtgagcggcttccccggcgccgacggcatccccggccaccccggccagggcggccccagaggcagacccggctacgacggctgcaacggcacccagggcgacagcggcccccagggcccccccggcagcgagggcttcaccggcccccccggcccccagggccccaagggccagaagggcgagccctacgccctgcccaaggaggagagagacagatacagaggcgagcccggcgagcccggcctggtgggcttccagggcccccccggcagacccggccacgtgggccagatgggccccgtgggcgcccccggcagacccggcccccccggcccccccggccccaagggccagcagggcaacagaggcctgggcttctacggcgtgaagggcgagaagggcgacgtgggccagcccggccccaacggcatccccagcgacaccctgcaccccatcatcgcccccaccggcgtgaccttccaccccgaccagtacaagggcgagaagggcagcgagggcgagcccggcatcagaggcatcagcctgaagggcgaggagggcatcatgggcttccccggcctgagaggctaccccggcctgagcggcgagaagggcagccccggccagaagggcagcagaggcctggacggctaccagggccccgacggccccagaggccccaagggcgaggccggcgaccccggcccccccggcctgcccgcctacagcccccaccccagcctggccaagggcgccagaggcgaccccggcttccccggcgcccagggcgagcccggcagccagggcgagcccggcgaccccggcctgcccggcccccccggcctgagcatcggcgacggcgaccagagaagaggcctgcccggcgagatgggccccaagggcttcatcggcgaccccggcatccccgccctgtacggcggcccccccggccccgacggcaagagaggcccccccggcccccccggcctgcccggcccccccggccccgacggcttcctgttcggcctgaagggcgccaagggcagagccggcttccccggcctgcccggcagccccggcgccagaggccccaagggctggaagggcgacgccggcgagtgcagatgcaccgagggcgacgaggccatcaagggcctgcccggcctgcccggccccaagggcttcgccggcatcaacggcgagcccggcagaaagggcgacagaggcgaccccggccagcacggcctgcccggcttccccggcctgaagggcgtgcccggcaacatcggcgcccccggccccaagggcgccaagggcgacagcagaaccatcaccaccaagggcgagagaggccagcccggcgtgcccggcgtgcccggcatgaagggcgacgacggcagccccggcagagacggcctggacggcttccccggcctgcccggcccccccggcgacggcatcaagggcccccccggcgaccccggctaccccggcatccccggcaccaagggcacccccggcgagatgggcccccccggcctgggcctgcccggcctgaagggccagagaggcttccccggcgacgccggcctgcccggcccccccggcttcctgggcccccccggccccgccggcacccccggccagatcgactgcgacaccgacgtgaagagagccgtgggcggcgacagacaggaggccatccagcccggctgcatcggcggccccaagggcctgcccggcctgcccggcccccccggccccaccggcgccaagggcctgagaggcatccccggcttcgccggcgccgacggcggccccggccccagaggcctgcccggcgacgccggcagagagggcttccccggcccccccggcttcatcggccccagaggcagcaagggcgccgtgggcctgcccggccccgacggcagccccggccccatcggcctgcccggccccgacggcccccccggcgagagaggcctgcccggcgaggtgctgggcgcccagcccggccccagaggcgacgccggcgtgcccggccagcccggcctgaagggcctgcccggcgacagaggcccccccggcttcagaggcagccagggcatgcccggcatgcccggcctgaagggccagcccggcctgcccggccccagcggccagcccggcctgtacggcccccccggcctgcacggcttccccggcgcccccggccaggagggccccctgggcctgcccggcatccccggcagagagggcctgcccggcgacagaggcgaccccggcgacaccggcgcccccggccccgtgggcatgaagggcctgagcggcgacagaggcgacgccggcttcaccggcgagcagggccaccccggcagccccggcttcaagggcatcgacggcatgcccggcacccccggcctgaagggcgacagaggcagccccggcatggacggcttccagggcatgcccggcctgaagggcagacccggcttccccggcagcaagggcgaggccggcttcttcggcatccccggcctgaagggcctggccggcgagcccggcttcaagggcagcagaggcgaccccggcccccccggccccccccccgtgatcctgcccggcatgaaggacatcaagggcgagaagggcgacgagggccccatgggcctgaagggctacctgggcgccaagggcatccagggcatgcccggcatccccggcctgagcggcatccccggcctgcccggcagacccggccacatcaagggcgtgaagggcgacatcggcgtgcccggcatccccggcctgcccggcttccccggcgtggccggcccccccggcatcaccggcttccccggcttcatcggcagcagaggcgacaagggcgcccccggcagagccggcctgtacggcgagatcggcgccaccggcgacttcggcgacatcggcgacaccatcaacctgcccggcagacccggcctgaagggcgagagaggcaccaccggcatccccggcctgaagggcttcttcggcgagaagggcaccgagggcgacatcggcttccccggcatcaccggcgtgaccggcgtgcagggcccccccggcctgaagggccagaccggcttccccggcctgaccggcccccccggcagccagggcgagctgggcagaatcggcctgcccggcggcaagggcgacgacggctggcccggcgcccccggcctgcccggcttccccggcctgagaggcatcagaggcctgcacggcctgcccggcaccaagggcttccccggcagccccggcagcgacatccacggcgaccccggcttccccggcccccccggcgagagaggcgaccccggcgaggccaacaccctgcccggccccgtgggcgtgcccggccagaagggcgaccagggcgcccccggcgagagaggcccccccggcagccccggcctgcagggcttccccggcatcaccccccccagcaacatcagcggcgcccccggcgacaagggcgcccccggcatcttcggcctgaagggctacagaggcccccccggcccccccggcagcgccgccctgcccggcagcaagggcgacaccggcaaccccggcgcccccggcacccccggcaccaagggctgggccggcgacagcggcccccagggcagacccggcgtgttcggcctgcccggcgagaagggccccagaggcgagcagggcttcatgggcaacaccggccccaccggcgccgtgggcgacagaggccccaagggccccaagggcgaccccggcttccccggcgcccccggcaccgtgggcgcccccggcatcgccggcatcccccagaagatcgccgtgcagcccggcaccgtgggcccccagggcagaagaggcccccccggcgcccccggcgagatgggcccccagggcccccccggcgagcccggcttcagaggcgcccccggcaaggccggcccccagggcagaggcggcgtgagcgccgtgcccggcttcagaggcgacgagggccccatcggccaccagggccccatcggccaggagggcgcccccggcagacccggcagccccggcctgcccggcatgcccggcagaagcgtgagcatcggctacctgctggtgaagcacagccagaccgaccaggagcccatgtgccccgtgggcatgaacaagctgtggagcggctacagcctgctgtacttcgagggccaggagaaggcccacaaccaggacctgggcctggccggcagctgcctggccagattcagcaccatgcccttcctgtactgcaaccccggcgacgtgtgctactacgccagcagaaacgacaagagctactggctgagcaccaccgcccccctgcccatgatgcccgtggccgaggacgagatcaagccctacatcagcagatgcagcgtgtgcgaggcccccgccatcgccatcgccgtgcacagccaggacgtgagcatcccccactgccccgccggctggagaagcctgtggatcggctacagcttcctgatgcacaccgccgccggcgacgagggcggcggccagagcctggtgagccccggcagctgcctggaggacttcagagccacccccttcatcgagtgcaacggcggcagaggcacctgccactactacgccaacaagtacagcttctggctgaccaccatccccgagcagagcttccagggcagccccagcgccgacaccctgaaggccggcctgatcagaacccacatcagcagatgccaggtgtgcatgaagaacctgtag

SEQ ID NO: 10137 - DNA, 318 bp, Artificial Sequence
  Description of Artificial Sequence: Synthetic coding sequence
atgggcagagaccagagagccgtggccggccccgccctgagaagatggctgctgctgggcaccgtgaccgtgggcttcctggcccagagcgtgctggccggcgtgaagaagttcgacgtgccctgcggcggcagagactgcagcggcggctgccagtgctaccccgagaagggcggcagaggccagcccggccccgtgggcccccagggctacaacggcccccccggcctgcagggcttccccggcctgcagggcagaaagggcgacaagggcgagagaggcgcccccggcgtgaccggccccaagggcgacgtgtag

SEQ ID NO: 10138 - DNA, 4497 bp, Artificial Sequence
  Description of Artificial Sequence: Synthetic coding sequence
atgagcgccagaaccgcccccagaccccaggtgctgctgctgcccctgctgctggtgctgctggccgccgcccccgccgccagcaagggctgcgtgtgcaaggacaagggccagtgcttctgcgacggcgccaagggcgagaagggcgagaagggcttccccggcccccccggcagccccggccagaagggcttcaccggccccgagggcctgcccggcccccagggccccaagagcttcagagccatccccagctacagcggcggcaagagcctgcagggcatcagcggcctgcccggcttcagcggcagccccggcctgcccggcacccccggcaacaccggcccctacggcctggtgggcgtgcccggctgcagcggcagcaagggcgagcagggcttccccggcctgcccggcaccctgggctaccccggcatccccggcatccacaacctgaagatcttcaagggcgcccccgccaaggaggaggacatcgagctggacgccaagggcgaccccggcctgcccggcgcccccggcccccagggcctgcccggcccccccggcttccccggccccgtgggcccccccggcccccccggcttcttcggcttccccggcgccatgggccccagaggccccaagagcttcgtgctgagcagcagaatcagcaccaagggcgagaagggcgtgaagggcctgaccggcccccccggcccccccggcaccgtgatcgtgaccctgaccggccccgacaacagaaccgacctgaagggcgagaagggcgacaagggcgccatgggcgagcccggcccccccggccccagcggcctgcccggcgagagctacggcagcgagaagggcgcccccggcgaccccggcctgcagggcaagcccggcaaggacggcgtgcccggcttccccggcagcgagggcgtgaagggcaacagaggcttccccggcctgatgggcgaggacggcatcaaggaggagaagagagacgtggccatcgtgagcttcagcagcaagaccgagtactacgacacctaccaggagaagggcgacgagggcacccccggcccccccggccccagaggcgccagaggcccccagggcaagaacaagttcagatgcatccccggcagccagggcagcagcagacccggcctgagaggcgcccccggctggcccggcctgaagggcagcaagggcgagagaggcagacccggcaaggacgccatgggcacccccggcagccccggctgcgccggcagccccggcctgcccggcagccccggcccccccggcccccccggcgacatcgtgttcagaaagggcccccccggcgaccacggcctgcccggctacctgggcagccccggcatccccggcgtggacggccccaagggcgagcccggcctgctgtgcacccagtgcccctacatccccggcccccccggcctgcccggcctgcccggcctgcacggcgtgaagggcatccccggcagacagggcgccgccggcctgaagggcagccccggcagccccggcaacaccggcctgcccggcttccccggcttccccggcgcccagggcgaccccggcctgaagggcgagaagggcgagaccctgcagcccgagggccaggtgggcgtgcccggcgaccccggcctgagaggccagcccggcagaaagggcctggacggcatccccggcacccccggcgtgaagggcctgcccggccccaagggcgagctggccctgagcggcgagaagggcgaccagggcccccccggcgaccccggcagccccggcagccccggccccgccggccccgccggcccccccggctacggcccccagggcgagcccggcctgcagggcacccagggcgtgcccggcgcccccggcccccccggcgaggccggccccagaggcgagctgagcgtgagcacccccgtgcccggcccccccggcccccccggcccccccggccaccccggcccccagggcccccccggcatccccggcagcctgggcaagtgcggcgaccccggcctgcccggccccgacggcgagcccggcatccccggcatcggcttccccggcccccccggccccaagggcgaccagggcttccccggcaccaagggcagcctgggctgccccggcaagatgggcgagcccggcctgcccggcaagcccggcctgcccggcgccaagggcgagcccgccgtggccatgcccggcggccccggcacccccggcttccccggcgagagaggcaacagcggcgagcacggcgagatcggcctgcccggcctgcccggcctgcccggcacccccggcaacgagggcctggacggccccagaggcgaccccggccagcccggcccccccggcgagcagggcccccccggcagatgcatcgagggccccagaggcgcccagggcctgcccggcctgaacggcctgaagggccagcagggcagaagaggcaagaccggccccaagggcgaccccggcatccccggcctggacagaagcggcttccccggcgagaccggcagccccggcatccccggccaccagggcgagatgggccccctgggccagagaggctaccccggcaaccccggcatcctgggcccccccggcgaggacggcgtgatcggcatgatgggcttccccggcgccatcggcccccccggcccccccggcaaccccggcacccccggccagagaggcagccccggcatccccggcgtgaagggccagagaggcacccccggcgccaagggcgagcagggcgacaagggcaaccccggccccagcgagatcagccacgtgatcggcgacaagggcgagcccggcctgaagggcttcgccggcaaccccggcgagaagggcaacagaggcgtgcccggcatgcccggcctgaagggcctgaagggcctgcccggccccgccggcccccccggccccagaggcgacctgggcagcaccggcaaccccggcgagcccggcctgagaggcatccccggcagcatgggcaacatgggcatgcccggcagcaagggcaagagaggcaccctgggcttccccggcagagccggcagacccggcctgcccggcatccacggcctgcagggcgacaagggcgagcccggctacagcgagggcaccagacccggcccccccggccccaccggcgaccccggcctgcccggcgacatgggcaagaagggcgagatgggccagcccggcccccccggccacctgggccccgccggccccgagggcgcccccggcagccccggcagccccggcctgcccggcaagcccggcccccacggcgacctgggcttcaagggcatcaagggcctgctgggcccccccggcatcagaggcccccccggcctgcccggcttccccggcagccccggccccatgggcatcagaggcgaccagggcagagacggcatccccggccccgccggcgagaagggcgagaccggcctgctgagagccccccccggccccagaggcaaccccggcgcccagggcgccaagggcgacagaggcgcccccggcttccccggcctgcccggcagaaagggcgccatgggcgacgccggccccagaggccccaccggcatcgagggcttccccggcccccccggcctgcccggcgccatcatccccggccagaccggcaacagaggcccccccggcagcagaggcagccccggcgcccccggcccccccggcccccccggcagccacgtgatcggcatcaagggcgacaagggcagcatgggccaccccggccccaagggcccccccggcaccgccggcgacatgggcccccccggcagactgggcgcccccggcacccccggcctgcccggccccagaggcgaccccggcttccagggcttccccggcgtgaagggcgagaagggcaaccccggcttcctgggcagcatcggcccccccggccccatcggccccaagggcccccccggcgtgagaggcgaccccggcaccctgaagatcatcagcctgcccggcagccccggcccccccggcacccccggcgagcccggcatgcagggcgagcccggcccccccggcccccccggcaacctgggcccctgcggccccagaggcaagcccggcaaggacggcaagcccggcacccccggccccgccggcgagaagggcaacaagggcagcaagggcgagcccggccccgccggcagcgacggcctgcccggcctgaagggcaagagaggcgacagcggcagccccgccacctggaccaccagaggcttcgtgttcaccagacacagccagaccaccgccatccccagctgccccgagggcaccgtgcccctgtacagcggcttcagcttcctgttcgtgcagggcaaccagagagcccacggccaggacctggacgccctgttcgtgaaggtgctgagaagcccctag

SEQ ID NO: 10139 - DNA, 4914 bp, Artificial Sequence
  Description of Artificial Sequence: Synthetic coding sequence
atgagcgccagaaccgcccccagaccccaggtgctgctgctgcccctgctgctggtgctgctggccgccgcccccgccgccagcaagggctgcgtgtgcaaggacaagggccagtgcttctgcgacggcgccaagggcgagaagggcgagaagggcttccccggcccccccggcagccccggccagaagggcttcaccggccccgagggcctgcccggcccccagggccccaagagcttcagagccatccccagctacagcggcggcaagagcctgcagggcatcagcggcctgcccggcttcagcggcagccccggcctgcccggcacccccggcaacaccggcccctacggcctggtgggcgtgcccggctgcagcggcagcaagggcgagcagggcttccccggcctgcccggcaccctgggctaccccggcatccccggcatccacaacctgaagatcttcaagggcgcccccgccaaggaggaggacatcgagctggacgccaagggcgaccccggcctgcccggcgcccccggcccccagggcctgcccggcccccccggcttccccggccccgtgggcccccccggcccccccggcttcttcggcttccccggcgccatgggccccagaggccccaagagcttcgtgctgagcagcagaatcagcaccaagggcgagaagggcgtgaagggcctgaccggcccccccggcccccccggcaccgtgatcgtgaccctgaccggccccgacaacagaaccgacctgaagggcgagaagggcgacaagggcgccatgggcgagcccggcccccccggccccagcggcctgcccggcgagagctacggcagcgagaagggcgcccccggcgaccccggcctgcagggcaagcccggcaaggacggcgtgcccggcttccccggcagcgagggcgtgaagggcaacagaggcttccccggcctgatgggcgaggacggcatcaaggaggagaagagagacgtggccatcgtgagcttcagcagcaagaccgagtactacgacacctaccaggagaagggcgacgagggcacccccggcccccccggccccagaggcgccagaggcccccagggcaagaacaagttcagatgcatccccggcagccagggcagcagcagacccggcctgagaggcgcccccggctggcccggcctgaagggcagcaagggcgagagaggcagacccggcaaggacgccatgggcacccccggcagccccggctgcgccggcagccccggcctgcccggcagccccggcccccccggcccccccggcgacatcgtgttcagaaagggcccccccggcgaccacggcctgcccggctacctgggcagccccggcatccccggcgtggacggccccaagggcgagcccggcctgctgtgcacccagtgcccctacatccccggcccccccggcctgcccggcctgcccggcctgcacggcgtgaagggcatccccggcagacagggcgccgccggcctgaagggcagccccggcagccccggcaacaccggcctgcccggcttccccggcttccccggcgcccagggcgaccccggcctgaagggcgagaagggcgagaccctgcagcccgagggccaggtgggcgtgcccggcgaccccggcctgagaggccagcccggcagaaagggcctggacggcatccccggcacccccggcgtgaagggcctgcccggccccaagggcgagctggccctgagcggcgagaagggcgaccagggcccccccggcgaccccggcagccccggcagccccggccccgccggccccgccggcccccccggctacggcccccagggcgagcccggcctgcagggcacccagggcgtgcccggcgcccccggcccccccggcgaggccggccccagaggcgagctgagcgtgagcacccccgtgcccggcccccccggcccccccggcccccccggccaccccggcccccagggcccccccggcatccccggcagcctgggcaagtgcggcgaccccggcctgcccggccccgacggcgagcccggcatccccggcatcggcttccccggcccccccggccccaagggcgaccagggcttccccggcaccaagggcagcctgggctgccccggcaagatgggcgagcccggcctgcccggcaagcccggcctgcccggcgccaagggcgagcccgccgtggccatgcccggcggccccggcacccccggcttccccggcgagagaggcaacagcggcgagcacggcgagatcggcctgcccggcctgcccggcctgcccggcacccccggcaacgagggcctggacggccccagaggcgaccccggccagcccggcccccccggcgagcagggcccccccggcagatgcatcgagggccccagaggcgcccagggcctgcccggcctgaacggcctgaagggccagcagggcagaagaggcaagaccggccccaagggcgaccccggcatccccggcctggacagaagcggcttccccggcgagaccggcagccccggcatccccggccaccagggcgagatgggccccctgggccagagaggctaccccggcaaccccggcatcctgggcccccccggcgaggacggcgtgatcggcatgatgggcttccccggcgccatcggcccccccggcccccccggcaaccccggcacccccggccagagaggcagccccggcatccccggcgtgaagggccagagaggcacccccggcgccaagggcgagcagggcgacaagggcaaccccggccccagcgagatcagccacgtgatcggcgacaagggcgagcccggcctgaagggcttcgccggcaaccccggcgagaagggcaacagaggcgtgcccggcatgcccggcctgaagggcctgaagggcctgcccggccccgccggcccccccggccccagaggcgacctgggcagcaccggcaaccccggcgagcccggcctgagaggcatccccggcagcatgggcaacatgggcatgcccggcagcaagggcaagagaggcaccctgggcttccccggcagagccggcagacccggcctgcccggcatccacggcctgcagggcgacaagggcgagcccggctacagcgagggcaccagacccggcccccccggccccaccggcgaccccggcctgcccggcgacatgggcaagaagggcgagatgggccagcccggcccccccggccacctgggccccgccggccccgagggcgcccccggcagccccggcagccccggcctgcccggcaagcccggcccccacggcgacctgggcttcaagggcatcaagggcctgctgggcccccccggcatcagaggcccccccggcctgcccggcttccccggcagccccggccccatgggcatcagaggcgaccagggcagagacggcatccccggccccgccggcgagaagggcgagaccggcctgctgagagccccccccggccccagaggcaaccccggcgcccagggcgccaagggcgacagaggcgcccccggcttccccggcctgcccggcagaaagggcgccatgggcgacgccggccccagaggccccaccggcatcgagggcttccccggcccccccggcctgcccggcgccatcatccccggccagaccggcaacagaggcccccccggcagcagaggcagccccggcgcccccggcccccccggcccccccggcagccacgtgatcggcatcaagggcgacaagggcagcatgggccaccccggccccaagggcccccccggcaccgccggcgacatgggcccccccggcagactgggcgcccccggcacccccggcctgcccggccccagaggcgaccccggcttccagggcttccccggcgtgaagggcgagaagggcaaccccggcttcctgggcagcatcggcccccccggccccatcggccccaagggcccccccggcgtgagaggcgaccccggcaccctgaagatcatcagcctgcccggcagccccggcccccccggcacccccggcgagcccggcatgcagggcgagcccggcccccccggcccccccggcaacctgggcccctgcggccccagaggcaagcccggcaaggacggcaagcccggcacccccggccccgccggcgagaagggcaacaagggcagcaagggcgagcccggccccgccggcagcgacggcctgcccggcctgaagggcaagagaggcgacagcggcagccccgccacctggaccaccagaggcttcgtgttcaccagacacagccagaccaccgccatccccagctgccccgagggcaccgtgcccctgtacagcggcttcagcttcctgttcgtgcagggcaaccagagagcccacggccaggacctgggcaccctgggcagctgcctgcagagattcaccaccatgcccttcctgttctgcaacgtgaacgacgtgtgcaacttcgccagcagaaacgactacagctactggctgagcacccccgccctgatgcccatgaacatggcccccatcaccggcagagccctggagccctacatcagcagatgcaccgtgtgcgagggccccgccatcgccatcgccgtgcacagccagaccaccgacatccccccctgcccccacggctggatcagcctgtggaagggcttcagcttcatcatgaaggcctacagcatcaactgcgagagctggggcatcagaaagaacaacaagagcctgagcggcgtgcacgaggagaagaccctgaagctgaagaagaccgccgagctgctgttcttcatcctgaagaacaaggtgatgaccgagcacgccgtgatctag

SEQ ID NO: 10140 - DNA, 4485 bp, Artificial Sequence
  Description of Artificial Sequence: Synthetic coding sequence
atgagcgccagaaccgcccccagaccccaggtgctgctgctgcccctgctgctggtgctgctggccgccgcccccgccgccagcaagggctgcgtgtgcaaggacaagggccagtgcttctgcgacggcgccaagggcgagaagggcgagaagggcttccccggcccccccggcagccccggccagaagggcttcaccggccccgagggcctgcccggcccccagggccccaagagcttcagagccatccccagctacagcggcggcaagagcctgcagggcatcagcggcctgcccggcttcagcggcagccccggcctgcccggcacccccggcaacaccggcccctacggcctggtgggcgtgcccggctgcagcggcagcaagggcgagcagggcttccccggcctgcccggcaccctgggctaccccggcatccccggcatccacaacctgaagatcttcaagggcgcccccgccaaggaggaggacatcgagctggacgccaagggcgaccccggcctgcccggcgcccccggcccccagggcctgcccggcccccccggcttccccggccccgtgggcccccccggcccccccggcttcttcggcttccccggcgccatgggccccagaggccccaagagcttcgtgctgagcagcagaatcagcaccaagggcgagaagggcgtgaagggcctgaccggcccccccggcccccccggcaccgtgatcgtgaccctgaccggccccgacaacagaaccgacctgaagggcgagaagggcgacaagggcgccatgggcgagcccggcccccccggccccagcggcctgcccggcgagagctacggcagcgagaagggcgcccccggcgaccccggcctgcagggcaagcccggcaaggacggcgtgcccggcttccccggcagcgagggcgtgaagggcaacagaggcttccccggcctgatgggcgaggacggcatcaaggaggagaagagagacgtggccatcgtgagcttcagcagcaagaccgagtactacgacacctaccaggagaagggcgacgagggcacccccggcccccccggccccagaggcgccagaggcccccagggcaagaacaagttcagatgcatccccggcagccagggcagcagcagacccggcctgagaggcgcccccggctggcccggcctgaagggcagcaagggcgagagaggcagacccggcaaggacgccatgggcacccccggcagccccggctgcgccggcagccccggcctgcccggcagccccggcccccccggcccccccggcgacatcgtgttcagaaagggcccccccggcgaccacggcctgcccggctacctgggcagccccggcatccccggcgtggacggccccaagggcgagcccggcctgctgtgcacccagtgcccctacatccccggcccccccggcctgcccggcctgcccggcctgcacggcgtgaagggcatccccggcagacagggcgccgccggcctgaagggcagccccggcagccccggcaacaccggcctgcccggcttccccggcttccccggcgcccagggcgaccccggcctgaagggcgagaagggcgagaccctgcagcccgagggccaggtgggcgtgcccggcgaccccggcctgagaggccagcccggcagaaagggcctggacggcatccccggcacccccggcgtgaagggcctgcccggccccaagggcgagctggccctgagcggcgagaagggcgaccagggcccccccggcgaccccggcagccccggcagccccggccccgccggccccgccggcccccccggctacggcccccagggcgagcccggcctgcagggcacccagggcgtgcccggcgcccccggcccccccggcgaggccggccccagaggcgagctgagcgtgagcacccccgtgcccggcccccccggcccccccggcccccccggccaccccggcccccagggcccccccggcatccccggcagcctgggcaagtgcggcgaccccggcctgcccggccccgacggcgagcccggcatccccggcatcggcttccccggcccccccggccccaagggcgaccagggcttccccggcaccaagggcagcctgggctgccccggcaagatgggcgagcccggcctgcccggcaagcccggcctgcccggcgccaagggcgagcccgccgtggccatgcccggcggccccggcacccccggcttccccggcgagagaggcaacagcggcgagcacggcgagatcggcctgcccggcctgcccggcctgcccggcacccccggcaacgagggcctggacggccccagaggcgaccccggccagcccggcccccccggcgagcagggcccccccggcagatgcatcgagggccccagaggcgcccagggcctgcccggcctgaacggcctgaagggccagcagggcagaagaggcaagaccggccccaagggcgaccccggcatccccggcctggacagaagcggcttccccggcgagaccggcagccccggcatccccggccaccagggcgagatgggccccctgggccagagaggctaccccggcaaccccggcatcctgggcccccccggcgaggacggcgtgatcggcatgatgggcttccccggcgccatcggcccccccggcccccccggcaaccccggcacccccggccagagaggcagccccggcatccccggcgtgaagggccagagaggcacccccggcgccaagggcgagcagggcgacaagggcaaccccggccccagcgagatcagccacgtgatcggcgacaagggcgagcccggcctgaagggcttcgccggcaaccccggcgagaagggcaacagaggcgtgcccggcatgcccggcctgaagggcctgaagggcctgcccggccccgccggcccccccggccccagaggcgacctgggcagcaccggcaaccccggcgagcccggcctgagaggcatccccggcagcatgggcaacatgggcatgcccggcagcaagggcaagagaggcaccctgggcttccccggcagagccggcagacccggcctgcccggcatccacggcctgcagggcgacaagggcgagcccggctacagcgagggcaccagacccggcccccccggccccaccggcgaccccggcctgcccggcgacatgggcaagaagggcgagatgggccagcccggcccccccggccacctgggccccgccggccccgagggcgcccccggcagccccggcagccccggcctgcccggcaagcccggcccccacggcgacctgggcttcaagggcatcaagggcctgctgggcccccccggcatcagaggcccccccggcctgcccggcttccccggcagccccggccccatgggcatcagaggcgaccagggcagagacggcatccccggccccgccggcgagaagggcgagaccggcctgctgagagccccccccggccccagaggcaaccccggcgcccagggcgccaagggcgacagaggcgcccccggcttccccggcctgcccggcagaaagggcgccatgggcgacgccggccccagaggccccaccggcatcgagggcttccccggcccccccggcctgcccggcgccatcatccccggccagaccggcaacagaggcccccccggcagcagaggcagccccggcgcccccggcccccccggcccccccggcagccacgtgatcggcatcaagggcgacaagggcagcatgggccaccccggccccaagggcccccccggcaccgccggcgacatgggcccccccggcagactgggcgcccccggcacccccggcctgcccggccccagaggcgaccccggcttccagggcttccccggcgtgaagggcgagaagggcaaccccggcttcctgggcagcatcggcccccccggccccatcggccccaagggcccccccggcgtgagaggcgaccccggcaccctgaagatcatcagcctgcccggcagccccggcccccccggcacccccggcgagcccggcatgcagggcgagcccggcccccccggcccccccggcaacctgggcccctgcggccccagaggcaagcccggcaaggacggcaagcccggcacccccggccccgccggcgagaagggcaacaagggcagcaagggcgagcccggccccgccggcagcgacggcctgcccggcctgaagggcaagagaggcgacagcggcagccccgccacctggaccaccagaggcttcgtgttcaccagacacagccagaccaccgccatccccagctgccccgagggcaccgtgcccctgtacagcggcttcagcttcctgttcgtgcagggcaaccagagagcccacggccaggacctggagagcctgttccaccagctgtag

SEQ ID NO: 10141 - DNA, 4275 bp, Artificial Sequence
  Description of Artificial Sequence: Synthetic coding sequence
atgagcgccagaaccgcccccagaccccaggtgctgctgctgcccctgctgctggtgctgctggccgccgcccccgccgccagcaagggctgcgtgtgcaaggacaagggccagtgcttctgcgacggcgccaagggcgagaagggcgagaagggcttccccggcccccccggcagccccggccagaagggcttcaccggccccgagggcctgcccggcccccagggccccaagagcttcagagccatccccagctacagcggcggcaagagcctgcagggcatcagcggcctgcccggcttcagcggcagccccggcctgcccggcacccccggcaacaccggcccctacggcctggtgggcgtgcccggctgcagcggcagcaagggcgagcagggcttccccggcctgcccggcaccctgggctaccccggcatccccggcatccacaacctgaagatcttcaagggcgcccccgccaaggaggaggacatcgagctggacgccaagggcgaccccggcctgcccggcgcccccggcccccagggcctgcccggcccccccggcttccccggccccgtgggcccccccggcccccccggcttcttcggcttccccggcgccatgggccccagaggccccaagagcttcgtgctgagcagcagaatcagcaccaagggcgagaagggcgtgaagggcctgaccggcccccccggcccccccggcaccgtgatcgtgaccctgaccggccccgacaacagaaccgacctgaagggcgagaagggcgacaagggcgccatgggcgagcccggcccccccggccccagcggcctgcccggcgagagctacggcagcgagaagggcgcccccggcgaccccggcctgcagggcaagcccggcaaggacggcgtgcccggcttccccggcagcgagggcgtgaagggcaacagaggcttccccggcctgatgggcgaggacggcatcaaggaggagaagagagacgtggccatcgtgagcttcagcagcaagaccgagtactacgacacctaccaggagaagggcgacgagggcacccccggcccccccggccccagaggcgccagaggcccccagggcaagaacaagttcagatgcatccccggcagccagggcagcagcagacccggcctgagaggcgcccccggctggcccggcctgaagggcagcaagggcgagagaggcagacccggcaaggacgccatgggcacccccggcagccccggctgcgccggcagccccggcctgcccggcagccccggcccccccggcccccccggcgacatcgtgttcagaaagggcccccccggcgaccacggcctgcccggctacctgggcagccccggcatccccggcgtggacggccccaagggcgagcccggcctgctgtgcacccagtgcccctacatccccggcccccccggcctgcccggcctgcccggcctgcacggcgtgaagggcatccccggcagacagggcgccgccggcctgaagggcagccccggcagccccggcaacaccggcctgcccggcttccccggcttccccggcgcccagggcgaccccggcctgaagggcgagaagggcgagaccctgcagcccgagggccaggtgggcgtgcccggcgaccccggcctgagaggccagcccggcagaaagggcctggacggcatccccggcacccccggcgtgaagggcctgcccggccccaagggcgagctggccctgagcggcgagaagggcgaccagggcccccccggcgaccccggcagccccggcagccccggccccgccggccccgccggcccccccggctacggcccccagggcgagcccggcctgcagggcacccagggcgtgcccggcgcccccggcccccccggcgaggccggccccagaggcgagctgagcgtgagcacccccgtgcccggcccccccggcccccccggcccccccggccaccccggcccccagggcccccccggcatccccggcagcctgggcaagtgcggcgaccccggcctgcccggccccgacggcgagcccggcatccccggcatcggcttccccggcccccccggccccaagggcgaccagggcttccccggcaccaagggcagcctgggctgccccggcaagatgggcgagcccggcctgcccggcaagcccggcctgcccggcgccaagggcgagcccgccgtggccatgcccggcggccccggcacccccggcttccccggcgagagaggcaacagcggcgagcacggcgagatcggcctgcccggcctgcccggcctgcccggcacccccggcaacgagggcctggacggccccagaggcgaccccggccagcccggcccccccggcgagcagggcccccccggcagatgcatcgagggccccagaggcgcccagggcctgcccggcctgaacggcctgaagggccagcagggcagaagaggcaagaccggccccaagggcgaccccggcatccccggcctggacagaagcggcttccccggcgagaccggcagccccggcatccccggccaccagggcgagatgggccccctgggccagagaggctaccccggcaaccccggcatcctgggcccccccggcgaggacggcgtgatcggcatgatgggcttccccggcgccatcggcccccccggcccccccggcaaccccggcacccccggccagagaggcagccccggcatccccggcgtgaagggccagagaggcacccccggcgccaagggcgagcagggcgacaagggcaaccccggccccagcgagatcagccacgtgatcggcgacaagggcgagcccggcctgaagggcttcgccggcaaccccggcgagaagggcaacagaggcgtgcccggcatgcccggcctgaagggcctgaagggcctgcccggccccgccggcccccccggccccagaggcgacctgggcagcaccggcaaccccggcgagcccggcctgagaggcatccccggcagcatgggcaacatgggcatgcccggcagcaagggcaagagaggcaccctgggcttccccggcagagccggcagacccggcctgcccggcatccacggcctgcagggcgacaagggcgagcccggctacagcgagggcaccagacccggcccccccggccccaccggcgaccccggcctgcccggcgacatgggcaagaagggcgagatgggccagcccggcccccccggccacctgggccccgccggccccgagggcgcccccggcagccccggcagccccggcctgcccggcaagcccggcccccacggcgacctgggcttcaagggcatcaagggcctgctgggcccccccggcatcagaggcccccccggcctgcccggcttccccggcagccccggccccatgggcatcagaggcgaccagggcagagacggcatccccggccccgccggcgagaagggcgagaccggcctgctgagagccccccccggccccagaggcaaccccggcgcccagggcgccaagggcgacagaggcgcccccggcttccccggcctgcccggcagaaagggcgccatgggcgacgccggccccagaggccccaccggcatcgagggcttccccggcccccccggcctgcccggcgccatcatccccggccagaccggcaacagaggcccccccggcagcagaggcagccccggcgcccccggcccccccggcccccccggcagccacgtgatcggcatcaagggcgacaagggcagcatgggccaccccggccccaagggcccccccggcaccgccggcgacatgggcccccccggcagactgggcgcccccggcacccccggcctgcccggccccagaggcgaccccggcttccagggcttccccggcgtgaagggcgagaagggcaaccccggcttcctgggcagcatcggcccccccggccccatcggccccaagggcccccccggcgtgagaggcgaccccggcaccctgaagatcatcagcctgcccggcagccccggcccccccggcacccccggcgagcccggcatgcagggcgagcccggcccccccggcccccccggcaacctgggcccctgcggccccagaggcaagcccggcaaggacggcaagcccggcacccccggccccgccggcgagaagggcaacaagggcagcaagggcgagcccgagagcctgttccaccagctgtag

SEQ ID NO: 10142 - DNA, 5013 bp, Artificial Sequence
  Description of Artificial Sequence: Synthetic coding sequence
atgagcgccagaaccgcccccagaccccaggtgctgctgctgcccctgctgctggtgctgctggccgccgcccccgccgccagcaagggctgcgtgtgcaaggacaagggccagtgcttctgcgacggcgccaagggcgagaagggcgagaagggcttccccggcccccccggcagccccggccagaagggcttcaccggccccgagggcctgcccggcccccagggccccaagggcttccccggcctgcccggcctgaccggcagcaagggcgtgagaggcatcagcggcctgcccggcttcagcggcagccccggcctgcccggcacccccggcaacaccggcccctacggcctggtgggcgtgcccggctgcagcggcagcaagggcgagcagggcttccccggcctgcccggcaccctgggctaccccggcatccccggcgccgccggcctgaagggccagaagggcgcccccgccaaggaggaggacatcgagctggacgccaagggcgaccccggcctgcccggcgcccccggcccccagggcctgcccggcccccccggcttccccggccccgtgggcccccccggcccccccggcttcttcggcttccccggcgccatgggccccagaggccccaagggccacatgggcgagagagtgatcggccacaagggcgagagaggcgtgaagggcctgaccggcccccccggcccccccggcaccgtgatcgtgaccctgaccggccccgacaacagaaccgacctgaagggcgagaagggcgacaagggcgccatgggcgagcccggcccccccggccccagcggcctgcccggcgagagctacggcagcgagaagggcgcccccggcgaccccggcctgcagggcaagcccggcaaggacggcgtgcccggcttccccggcagcgagggcgtgaagggcaacagaggcttccccggcctgatgggcgaggacggcatcaagggccagaagggcgacatcggcccccccggcttcagaggccccaccgagtactacgacacctaccaggagaagggcgacgagggcacccccggcccccccggccccagaggcgccagaggcccccagggccccagcggcccccccggcgtgcccggcagccccggcagcagcagacccggcctgagaggcgcccccggctggcccggcctgaagggcagcaagggcgagagaggcagacccggcaaggacgccatgggcacccccggcagccccggctgcgccggcagccccggcctgcccggcagccccggcccccccggcccccccggcgacatcgtgttcagaaagggcccccccggcgaccacggcctgcccggctacctgggcagccccggcatccccggcgtggacggccccaagggcgagcccggcctgctgtgcacccagtgcccctacatccccggcccccccggcctgcccggcctgcccggcctgcacggcgtgaagggcatccccggcagacagggcgccgccggcctgaagggcagccccggcagccccggcaacaccggcctgcccggcttccccggcttccccggcgcccagggcgaccccggcctgaagggcgagaagggcgagaccctgcagcccgagggccaggtgggcgtgcccggcgaccccggcctgagaggccagcccggcagaaagggcctggacggcatccccggcacccccggcgtgaagggcctgcccggccccaagggcgagctggccctgagcggcgagaagggcgaccagggcccccccggcgaccccggcagccccggcagccccggccccgccggccccgccggcccccccggctacggcccccagggcgagcccggcctgcagggcacccagggcgtgcccggcgcccccggcccccccggcgaggccggccccagaggcgagctgagcgtgagcacccccgtgcccggcccccccggcccccccggcccccccggccaccccggcccccagggcccccccggcatccccggcagcctgggcaagtgcggcgaccccggcctgcccggccccgacggcgagcccggcatccccggcatcggcttccccggcccccccggccccaagggcgaccagggcttccccggcaccaagggcagcctgggctgccccggcaagatgggcgagcccggcctgcccggcaagcccggcctgcccggcgccaagggcgagcccgccgtggccatgcccggcggccccggcacccccggcttccccggcgagagaggcaacagcggcgagcacggcgagatcggcctgcccggcctgcccggcctgcccggcacccccggcaacgagggcctggacggccccagaggcgaccccggccagcccggcccccccggcgagcagggcccccccggcagatgcatcgagggccccagaggcgcccagggcctgcccggcctgaacggcctgaagggccagcagggcagaagaggcaagaccggccccaagggcgaccccggcatccccggcctggacagaagcggcttccccggcgagaccggcagccccggcatccccggccaccagggcgagatgggccccctgggccagagaggctaccccggcaaccccggcatcctgggcccccccggcgaggacggcgtgatcggcatgatgggcttccccggcgccatcggcccccccggcccccccggcaaccccggcacccccggccagagaggcagccccggcatccccggcgtgaagggccagagaggcacccccggcgccaagggcgagcagggcgacaagggcaaccccggccccagcgagatcagccacgtgatcggcgacaagggcgagcccggcctgaagggcttcgccggcaaccccggcgagaagggcaacagaggcgtgcccggcatgcccggcctgaagggcctgaagggcctgcccggccccgccggcccccccggccccagaggcgacctgggcagcaccggcaaccccggcgagcccggcctgagaggcatccccggcagcatgggcaacatgggcatgcccggcagcaagggcaagagaggcaccctgggcttccccggcagagccggcagacccggcctgcccggcatccacggcctgcagggcgacaagggcgagcccggctacagcgagggcaccagacccggcccccccggccccaccggcgaccccggcctgcccggcgacatgggcaagaagggcgagatgggccagcccggcccccccggccacctgggccccgccggccccgagggcgcccccggcagccccggcagccccggcctgcccggcaagcccggcccccacggcgacctgggcttcaagggcatcaagggcctgctgggcccccccggcatcagaggcccccccggcctgcccggcttccccggcagccccggccccatgggcatcagaggcgaccagggcagagacggcatccccggccccgccggcgagaagggcgagaccggcctgctgagagccccccccggccccagaggcaaccccggcgcccagggcgccaagggcgacagaggcgcccccggcttccccggcctgcccggcagaaagggcgccatgggcgacgccggccccagaggccccaccggcatcgagggcttccccggcccccccggcctgcccggcgccatcatccccggccagaccggcaacagaggcccccccggcagcagaggcagccccggcgcccccggcccccccggcccccccggcagccacgtgatcggcatcaagggcgacaagggcagcatgggccaccccggccccaagggcccccccggcaccgccggcgacatgggcccccccggcagactgggcgcccccggcacccccggcctgcccggccccagaggcgaccccggcttccagggcttccccggcgtgaagggcgagaagggcaaccccggcttcctgggcagcatcggcccccccggccccatcggccccaagggcccccccggcgtgagaggcgaccccggcaccctgaagatcatcagcctgcccggcagccccggcccccccggcacccccggcgagcccggcatgcagggcgagcccggcccccccggcccccccggcaacctgggcccctgcggccccagaggcaagcccggcaaggacggcaagcccggcacccccggccccgccggcgagaagggcaacaagggcagcaagggcgagcccggccccgccggcagcgacggcctgcccggcctgaagggcaagagaggcgacagcggcagccccgccacctggaccaccagaggcttcgtgttcaccagacacagccagaccaccgccatccccagctgccccgagggcaccgtgcccctgtacagcggcttcagcttcctgttcgtgcagggcaaccagagagcccacggccaggacctgggcaccctgggcagctgcctgcagagattcaccaccatgcccttcctgttctgcaacgtgaacgacgtgtgcaacttcgccagcagaaacgactacagctactggctgagcacccccgccctgatgcccatgaacatggcccccatcaccggcagagccctggagccctacatcagcagatgcaccgtgtgcgagggccccgccatcgccatcgccgtgcacagccagaccaccgacatccccccctgcccccacggctggatcagcctgtggaagggcttcagcttcatcatgttcaccagcgccggcagcgagggcaccggccaggccctggccagccccggcagctgcctggaggagttcagagccagccccttcctggagtgccacggcagaggcacctgcaactactacagcaacagctacagcttctggctggccagcctgaaccccgagagaatgttcagaaagcccatccccagcaccgtgaaggccggcgagctggagaagatcatcagcagatgccaggtgtgcatgaagaagagacactag

SEQ ID NO: 10143 - DNA, 4500 bp, Artificial Sequence
  Description of Artificial Sequence: Synthetic coding sequence
atgatggccaactgggccgaggccagacccctgctgatcctgatcgtgctgctgggccagttcgtgagcatcaaggcccaggaggaggacgaggacgagggctacggcgaggagatcgcctgcacccagaacggccagatgtacctgaacagagacatctggaagcccgccccctgccagatctgcgtgtgcgacaacggcgccatcctgtgcgacaagatcgagtgccaggacgtgctggactgcgccgaccccgtgaccccccccggcgagtgctgccccgtgtgcagccagacccccggcggcggcaacaccaacttcggcagaggcagaaagggccagaagggcgagcccggcctggtgcccgtggtgaccggcatcagaggcagacccggccccgccggcccccccggcagccagggccccagaggcgagagaggccccaagggcagacccggccccagaggcccccagggcatcgacggcgagcccggcgtgcccggccagcccggcgcccccggcccccccggccaccccagccaccccggccccgacggcctgagcagacccttcagcgcccagatggccggcctggacgagaagagcggcctgggcagccaggtgggcctgatgcccggcagcgtgggccccgtgggccccagaggcccccagggcctgcagggccagcagggcggcgccggccccaccggcccccccggcgagcccggcgaccccggccccatgggccccatcggcagcagaggccccgagggcccccccggcaagcccggcgaggacggcgagcccggcagaaacggcaaccccggcgaggtgggcttcgccggcagccccggcgccagaggcttccccggcgcccccggcctgcccggcctgaagggccacagaggccacaagggcctggagggccccaagggcgaggtgggcgcccccggcagcaagggcgaggccggccccaccggccccatgggcgccatgggccccctgggccccagaggcatgcccggcgagagaggcagactgggcccccagggcgcccccggccagagaggcgcccacggcatgcccggcaagcccggccccatgggccccctgggcatccccggcagcagcggcttccccggcaaccccggcatgaagggcgaggccggccccaccggcgccagaggccccgagggcccccagggccagagaggcgagaccggcccccccggccccgtgggcagccccggcctgcccggcgccatcggcaccgacggcacccccggcgccaagggccccaccggcagccccggcaccagcggcccccccggcagcgccggcccccccggcagccccggcccccagggcagcaccggcccccagggcatcagaggccagcccggcgaccccggcgtgcccggcttcaagggcgaggccggccccaagggcgagcccggcccccacggcatccagggccccatcggcccccccggcgaggagggcaagagaggccccagaggcgaccccggcaccgtgggcccccccggccccgtgggcgagagaggcgcccccggcaacagaggcttccccggcagcgacggcctgcccggccccaagggcgcccagggcgagagaggccccgtgggcagcagcggccccaagggcagccagggcgaccccggcagacccggcgagcccggcctgcccggcgccagaggcctgaccggcaaccccggcgtgcagggccccgagggcaagctgggccccctgggcgcccccggcgaggacggcagacccggcccccccggcagcatcggcatcagaggccagcccggcagcatgggcctgcccggccccaagggcagcagcggcgaccccggcaagcccggcgaggccggcaacgccggcgtgcccggccagagaggcgcccccggcaaggacggcgaggtgggccccagcggccccgtgggcccccccggcctggccggcgagagaggcgagcagggcccccccggccccaccggcttccagggcctgcccggcccccccggcccccccggcgagggcggcaagcccggcgaccagggcgtgcccggcgaccccggcgccgtgggccccctgggccccagaggcgagagaggcaaccccggcgagagaggcgagcccggcatcaccggcctgcccggcgagaagggcatggccggcggccacggccccgacggccccaagggcagccccggccccagcggcacccccggcgacaccggcccccccggcctgcagggcatgcccggcgagagaggcatcgccggcacccccggccccaagggcgacagaggcggcatcggcgagaagggcgccgagggcaccgccggcaacgacggcgccagaggcctgcccggccccctgggcccccccggccccgccggccccaccggcgagaagggcgagcccggccccagaggcctggtgggcccccccggcagcagaggcaaccccggcagcagaggcgagaacggccccaccggcgccgtgggcttcgccggcccccagggccccgacggccagcccggcgtgaagggcgagcccggcgagcccggccagaagggcgacgccggcagccccggcccccagggcctggccggcagccccggcccccacggccccaacggcgtgcccggcctgaagggcggcagaggcacccagggcccccccggcgccaccggcttccccggcagcgccggcagagtgggcccccccggccccgccggcgcccccggccccgccggccccctgggcgagcccggcaaggagggcccccccggcctgagaggcgaccccggcagccacggcagagtgggcgacagaggccccgccggcccccccggcggccccggcgacaagggcgaccccggcgaggacggccagcccggccccgacggcccccccggccccgccggcaccaccggccagagaggcatcgtgggcatgcccggccagagaggcgagagaggcatgcccggcctgcccggccccgccggcacccccggcaaggtgggccccaccggcgccaccggcgacaagggcccccccggccccgtgggcccccccggcagcaacggccccgtgggcgagcccggccccgagggccccgccggcaacgacggcacccccggcagagacggcgccgtgggcgagagaggcgacagaggcgaccccggccccgccggcctgcccggcagccagggcgcccccggcacccccggccccgtgggcgcccccggcgacgccggccagagaggcgaccccggcagcagaggccccatcggcccccccggcagagccggcaagagaggcctgcccggcccccagggccccagaggcgacaagggcgaccacggcgacagaggcgacagaggccagaagggccacagaggcttcaccggcctgcagggcctgcccggcccccccggccccaacggcgagcagggcagcgccggcatccccggccccttcggccccagaggcccccccggccccgtgggccccagcggcaaggagggcaaccccggccccctgggccccatcggcccccccggcgtgagaggcagcgtgggcgaggccggccccgagggcccccccggcgagcccggcccccccggcccccccggcccccccggccacctgaccgccgccctgggcgacatcatgggccactacgacgagagcatgcccgaccccctgcccgagttcaccgaggaccaggccgcccccgacgacaagaacaagaccgaccccggcgtgcacgccaccctgaagagcctgagcagccagatcgagaccatgagaagccccgacggcagcaagaagcaccccgccagaacctgcgacgacctgaagctgtgccacagcgccaagcagagcggcgagtactggatcgaccccaaccagggcagcgtggaggacgccatcaaggtgtactgcaacatggagaccggcgagacctgcatcagcgccaaccccagcagcgtgcccagaaagacctggtgggccagcaagagccccgacaacaagcccgtgtggtacggcctggacatgaacagaggcagccagttcgcctacggcgaccaccagagccccaacaccgccatcacccagatgaccttcctgagactgctgagcaaggaggccagccagaacatcacctacatctgcaagaacagcgtgggctacatggacgaccaggccaagaacctgaagaaggccgtggtgctgaagggcgccaacgacctggacatcaaggccgagggcaacatcagattcagatacatcgtgctgcaggacacctgcagcaagagaaacggcaacgtgggcaagaccgtgttcgagtacagaacccagaacgtggccagactgcccatcatcgacctggcccccgtggacgtgggcggcaccgaccaggagttcggcgtggagatcggccccgtgtgcttcgtgtag

SEQ ID NO: 10144 - DNA, 3420 bp, Artificial Sequence
  Description of Artificial Sequence: Synthetic coding sequence
ctgcccggcagaagacacagactgggcccccccggcagccagggccccagaggcgagagaggccccaagggcagacccggccccagaggcccccagggcatcgacggcgagcccggcgtgcccggccagcccggcgcccccggcggcgccggccccaccggcccccccggcgagcccggcgaccccggccccatgggccccatcggcagcagaggccccgagggcccccccggcaagcccggcgaggacggcgagcccggcagaaacggcaaccccggcgaggtgggcttcgccggcagccccggcgccagaggcttccccggcgcccccggcctgcccggcctgaagggccacagaggccacaagggcctggagggccccaagggcgaggtgggcgcccccggcagcaagggcgaggccggccccaccggccccagaggcgaccccggcaccgtgggcccccccggccccgtgggcgagagaggcgcccccggcaacagaggcttccccggcagcgacggcctgcccggccccaagggcgcccagggcgagagaggccccgtgggcagcagcggccccaagggcagccagggcgaccccggcagacccggcgagcccggcctgcccggcgccagaggcctgaccggcaaccccggcgtgcagggccccgagggcaagctgggccccctgggcgcccccggcgaggacggcagacccggcccccccggcagcatcggcatcagaggccagcccggcagcatgggcctgcccggccccaagggcagcagcggcgaccccggcaagcccggcgaggccggcaacgccggcgtgcccggccagagaggcgcccccggcaaggacggcgaggtgggccccagcggccccgtgggcccccccggcctggccggcgagagaggcgagcagggcccccccggccccaccggcttccagggcctgcccggcccccccggcccccccggcgagggcggcaagcccggcgaccagggcgtgcccggcgaccccggcgccgtgggccccctgggccccagaggcgagagaggcaaccccggcgagagaggcgagcccggcatcaccggcctgcccggcgagaagggcatggccggcggccacggccccgacggccccaagggcagccccggccccagcggcacccccggcgacaccggcccccccggcctgcagggcatgcccggcgagagaggcatcgccggcacccccggccccaagggcgacagaggcggcatcggcgagaagggcgccgagggcaccgccggcaacgacggcgccagaggcctgcccggccccctgggcccccccggccccgccggccccaccggcgagaagggcgagcccggccccagaggcctggtgggcccccccggcagcagaggcaaccccggcagcagaggcgagaacggccccaccggcgccgtgggcttcgccggcccccagggccccgacggccagcccggcgtgaagggcgagcccggcgagcccggccagaagggcgacgccggcagccccggcccccagggcctggccggcagccccggcccccacggccccaacggcgtgcccggcctgaagggcggcagaggcacccagggcccccccggcgccaccggcttccccggcagcgccggcagagtgggcccccccggccccgccggcgcccccggccccgccggccccctgggcgagcccggcaaggagggcccccccggcctgagaggcgaccccggcagccacggcagagtgggcgacagaggccccgccggcccccccggcggccccggcgacaagggcgaccccggcgaggacggccagcccggccccgacggcccccccggccccgccggcaccaccggccagagaggcatcgtgggcatgcccggccagagaggcgagagaggcatgcccggcctgcccggccccgccggcacccccggcaaggtgggccccaccggcgccaccggcgacaagggcccccccggccccgtgggcccccccggcagcaacggccccgtgggcgagcccggccccgagggccccgccggcaacgacggcacccccggcagagacggcgccgtgggcgagagaggcgacagaggcgaccccggccccgccggcctgcccggcagccagggcgcccccggcacccccggccccgtgggcgcccccggcgacgccggccagagaggcgaccccggcagcagaggccccatcggcccccccggcagagccggcaagagaggcctgcccggcccccagggccccagaggcgacaagggcgaccacggcgacagaggcgacagaggccagaagggccacagaggcttcaccggcctgcagggcctgcccggcccccccggccccaacggcgagcagggcagcgccggcatccccggccccttcggccccagaggcccccccggccccgtgggccccagcggcaaggagggcaaccccggccccctgggccccatcggcccccccggcgtgagaggcagcgtgggcgaggccggccccgagggcccccccggcgagcccggcccccccggcccccccggcccccccggccacctgaccgccgccctgggcgacatcatgggccactacgacgagagcatgcccgaccccctgcccgagttcaccgaggaccaggccgcccccgacgacaagaacaagaccgaccccggcgtgcacgccaccctgaagagcctgagcagccagatcgagaccatgagaagccccgacggcagcaagaagcaccccgccagaacctgcgacgacctgaagctgtgccacagcgccaagcagagcggcgagtactggatcgaccccaaccagggcagcgtggaggacgccatcaaggtgtactgcaacatggagaccggcgagacctgcatcagcgccaaccccagcagcgtgcccagaaagacctggtgggccagcaagagccccgacaacaagcccgtgtggtacggcctggacatgaacagaggcagccagttcgcctacggcgaccaccagagccccaacaccgccatcacccagatgaccttcctgagactgctgagcaaggaggccagccagaacatcacctacatctgcaagaacagcgtgggctacatggacgaccaggccaagaacctgaagaaggccgtggtgctgaagggcgccaacgacctggacatcaaggccgagggcaacatcagattcagatacatcgtgctgcaggacacctgcagcaagagaaacggcaacgtgggcaagaccgtgttcgagtacagaacccagaacgtggccagactgcccatcatcgacctggcccccgtggacgtgggcggcaccgaccaggagttcggcgtggagatcggccccgtgtgcttcgtgtag

SEQ ID NO: 10145 - DNA, 5304 bp, Artificial Sequence
  Description of Artificial Sequence: Synthetic coding sequence
atggagccctggagcagcagatggaagaccaagagatggctgtgggacttcaccgtgaccaccctggccctgaccttcctgttccaggccagagaggtgagaggcgccgcccccgtggacgtgctgaaggccctggacttccacaacagccccgagggcatcagcaagaccaccggcttctgcaccaacagaaagaacagcaagggcagcgacaccgcctacagagtgagcaagcaggcccagctgagcgcccccaccaagcagctgttccccggcggcaccttccccgaggacttcagcatcctgttcaccgtgaagcccaagaagggcatccagagcttcctgctgagcatctacaacgagcacggcatccagcagatcggcgtggaggtgggcagaagccccgtgttcctgttcgaggaccacaccggcaagcccgcccccgaggactaccccctgttcagaaccgtgaacatcgccgacggcaagtggcacagagtggccatcagcgtggagaagaagaccgtgaccatgatcgtggactgcaagaagaagaccaccaagcccctggacagaagcgagagagccatcgtggacaccaacggcatcaccgtgttcggcaccagaatcctggacgaggaggtgttcgagggcgacatccagcagttcctgatcaccggcgaccccaaggccgcctacgactactgcgagcactacagccccgactgcgacagcagcgcccccaaggccgcccaggcccaggagccccagatcgacgaggccaacatcgtggacgacttccaggagtacaactacggcaccatggagagctaccagaccgaggcccccagacacgtgagcggcaccaacgagcccaaccccgtggaggagatcttcaccgaggagtacctgaccggcgaggactacgacagccagagaaagaacagcgaggacaccctgtacgagaacaaggagatcgacggcagagacagcgacctgctggtggacggcgacctgggcgagtacgacttctacgagtacaaggagtacgaggacaagcccaccagcccccccaacgaggagttcggccccggcgtgcccgccgagaccgacatcaccgagaccagcatcaacggccacggcgcctacggcgagaagggccagaagggcgagcccgccgtggtggagcccggcatgctggtggagggcccccccggccccgccggccccgccggcatcatgggcccccccggcctgcagggccccaccggcccccccggcgaccccggcgacagaggcccccccggcagacccggcctgcccggcgccgacggcctgcccggcccccccggcaccatgctgatgctgcccttcagatacggcggcgacggcagcaagggccccaccatcagcgcccaggaggcccaggcccaggccatcctgcagcaggccagaatcgccctgagaggcccccccggccccatgggcctgaccggcagacccggccccgtgggcggccccggcagcagcggcgccaagggcgagagcggcgaccccggcccccagggccccagaggcgtgcagggcccccccggccccaccggcaagcccggcaagagaggcagacccggcgccgacggcggcagaggcatgcccggcgagcccggcgccaagggcgacagaggcttcgacggcctgcccggcctgcccggcgacaagggccacagaggcgagagaggcccccagggcccccccggcccccccggcgacgacggcatgagaggcgaggacggcgagatcggccccagaggcctgcccggcgaggccggccccagaggcctgctgggccccagaggcacccccggcgcccccggccagcccggcatggccggcgtggacggcccccccggccccaagggcaacatgggcccccagggcgagcccggcccccccggccagcagggcaaccccggcccccagggcctgcccggcccccagggccccatcggcccccccggcgagaagggcccccagggcaagcccggcctggccggcctgcccggcgccgacggcccccccggccaccccggcaaggagggccagagcggcgagaagggcgccctgggcccccccggcccccagggccccatcggctaccccggccccagaggcgtgaagggcgccgacggcgtgagaggcctgaagggcagcaagggcgagaagggcgaggacggcttccccggcttcaagggcgacatgggcctgaagggcgacagaggcgaggtgggccagatcggccccagaggcgaggacggccccgagggccccaagggcagagccggccccaccggcgaccccggccccagcggccaggccggcgagaagggcaagctgggcgtgcccggcctgcccggctaccccggcagacagggccccaagggcagcaccggcttccccggcttccccggcgccaacggcgagaagggcgccagaggcgtggccggcaagcccggccccagaggccagagaggccccaccggccccagaggcagcagaggcgccagaggccccaccggcaagcccggccccaagggcaccagcggcggcgacggcccccccggcccccccggcgagagaggcccccagggcccccagggccccgtgggcttccccggccccaagggcccccccggcccccccggcaaggacggcctgcccggccaccccggccagagaggcgagaccggcttccagggcaagaccggcccccccggccccggcggcgtggtgggcccccagggccccaccggcgagaccggccccatcggcgagagaggccaccccggcccccccggcccccccggcgagcagggcctgcccggcgccgccggcaaggagggcgccaagggcgaccccggcccccagggcatcagcggcaaggacggccccgccggcctgagaggcttccccggcgagagaggcctgcccggcgcccagggcgcccccggcctgaagggcggcgagggcccccagggcccccccggccccgtgggcagccccggcgagagaggcagcgccggcaccgccggccccatcggcctgcccggcagacccggcccccagggcccccccggccccgccggcgagaagggcgcccccggcgagaagggcccccagggccccgccggcagagacggcgtgcagggccccgtgggcctgcccggccccgccggccccgccggcagccccggcgaggacggcgacaagggcgagatcggcgagcccggccagaagggcagcaagggcgacaagggcgagaacggcccccccggcccccccggcctgcagggccccgtgggcgcccccggcatcgccggcggcgacggcgagcccggccccagaggccagcagggcatgttcggccagaagggcgacgagggcgccagaggcttccccggcccccccggccccatcggcctgcagggcctgcccggcccccccggcgagaagggcgagaacggcgacgtgggccccatgggcccccccggcccccccggccccagaggcccccagggccccaacggcgccgacggcccccagggcccccccggcagcgtgggcagcgtgggcggcgtgggcgagaagggcgagcccggcgaggccggcaaccccggcccccccggcgaggccggcgtgggcggccccaagggcgagagaggcgagaagggcgaggccggcccccccggcgccgccggcccccccggcgccaagggcccccccggcgacgacggccccaagggcaaccccggccccgtgggcttccccggcgaccccggcccccccggcgagcccggccccgccggccaggacggcgtgggcggcgacaagggcgaggacggcgaccccggccagcccggcccccccggccccagcggcgaggccggcccccccggcccccccggcaagagaggcccccccggcgccgccggcgccgagggcagacagggcgagaagggcgccaagggcgaggccggcgccgagggcccccccggcaagaccggccccgtgggcccccagggccccgccggcaagcccggccccgagggcctgagaggcatccccggccccgtgggcgagcagggcctgcccggcgccgccggccaggacggcccccccggccccatgggcccccccggcctgcccggcctgaagggcgaccccggcagcaagggcgagaagggccaccccggcctgatcggcctgatcggcccccccggcgagcagggcgagaagggcgacagaggcctgcccggcacccagggcagccccggcgccaagggcgacggcggcatccccggccccgccggccccctgggcccccccggcccccccggcctgcccggcccccagggccccaagggcaacaagggcagcaccggccccgccggccagaagggcgacagcggcctgcccggcccccccggcagccccggcccccccggcgaggtgatccagcccctgcccatcctgagcagcaagaagaccagaagacacaccgagggcatgcaggccgacgccgacgacaacatcctggactacagcgacggcatggaggagatcttcggcagcctgaacagcctgaagcaggacatcgagcacatgaagttccccatgggcacccagaccaaccccgccagaacctgcaaggacctgcagctgagccaccccgacttccccgacggcgagtactggatcgaccccaaccagggctgcagcggcgacagcttcaaggtgtactgcaacttcaccagcggcggcgagacctgcatctaccccgacaagaagagcgagggcgtgagaatcagcagctggcccaaggagaagcccggcagctggttcagcgagttcaagagaggcaagctgctgagctacctggacgtggagggcaacagcatcaacatggtgcagatgaccttcctgaagctgctgaccgccagcgccagacagaacttcacctaccactgccaccagagcgccgcctggtacgacgtgagcagcggcagctacgacaaggccctgagattcctgggcagcaacgacgaggagatgagctacgacaacaaccccttcatcaagaccctgtacgacggctgcgccagcagaaagggctacgagaagaccgtgatcgagatcaacacccccaagatcgaccaggtgcccatcgtggacgtgatgatcaacgacttcggcgaccagaaccagaagttcggcttcgaggtgggccccgtgtgcttcctgggctag

SEQ ID NO: 10146 - DNA, 5457 bp, Artificial Sequence
  Description of Artificial Sequence: Synthetic coding sequence
atggagccctggagcagcagatggaagaccaagagatggctgtgggacttcaccgtgaccaccctggccctgaccttcctgttccaggccagagaggtgagaggcgccgcccccgtggacgtgctgaaggccctggacttccacaacagccccgagggcatcagcaagaccaccggcttctgcaccaacagaaagaacagcaagggcagcgacaccgcctacagagtgagcaagcaggcccagctgagcgcccccaccaagcagctgttccccggcggcaccttccccgaggacttcagcatcctgttcaccgtgaagcccaagaagggcatccagagcttcctgctgagcatctacaacgagcacggcatccagcagatcggcgtggaggtgggcagaagccccgtgttcctgttcgaggaccacaccggcaagcccgcccccgaggactaccccctgttcagaaccgtgaacatcgccgacggcaagtggcacagagtggccatcagcgtggagaagaagaccgtgaccatgatcgtggactgcaagaagaagaccaccaagcccctggacagaagcgagagagccatcgtggacaccaacggcatcaccgtgttcggcaccagaatcctggacgaggaggtgttcgagggcgacatccagcagttcctgatcaccggcgaccccaaggccgcctacgactactgcgagcactacagccccgactgcgacagcagcgcccccaaggccgcccaggcccaggagccccagatcgacgagaagaagaagagcaacttcaagaagaagatgagaaccgtggccaccaagagcaaggagaagagcaagaagttcaccccccccaagagcgagaagttcagcagcaagaagaagaagagctaccaggccagcgccaaggccaagctgggcgtgaaggccaacatcgtggacgacttccaggagtacaactacggcaccatggagagctaccagaccgaggcccccagacacgtgagcggcaccaacgagcccaaccccgtggaggagatcttcaccgaggagtacctgaccggcgaggactacgacagccagagaaagaacagcgaggacaccctgtacgagaacaaggagatcgacggcagagacagcgacctgctggtggacggcgacctgggcgagtacgacttctacgagtacaaggagtacgaggacaagcccaccagcccccccaacgaggagttcggccccggcgtgcccgccgagaccgacatcaccgagaccagcatcaacggccacggcgcctacggcgagaagggccagaagggcgagcccgccgtggtggagcccggcatgctggtggagggcccccccggccccgccggccccgccggcatcatgggcccccccggcctgcagggccccaccggcccccccggcgaccccggcgacagaggcccccccggcagacccggcctgcccggcgccgacggcctgcccggcccccccggcaccatgctgatgctgcccttcagatacggcggcgacggcagcaagggccccaccatcagcgcccaggaggcccaggcccaggccatcctgcagcaggccagaatcgccctgagaggcccccccggccccatgggcctgaccggcagacccggccccgtgggcggccccggcagcagcggcgccaagggcgagagcggcgaccccggcccccagggccccagaggcgtgcagggcccccccggccccaccggcaagcccggcaagagaggcagacccggcgccgacggcggcagaggcatgcccggcgagcccggcgccaagggcgacagaggcttcgacggcctgcccggcctgcccggcgacaagggccacagaggcgagagaggcccccagggcccccccggcccccccggcgacgacggcatgagaggcgaggacggcgagatcggccccagaggcctgcccggcgaggccggccccagaggcctgctgggccccagaggcacccccggcgcccccggccagcccggcatggccggcgtggacggcccccccggccccaagggcaacatgggcccccagggcgagcccggcccccccggccagcagggcaaccccggcccccagggcctgcccggcccccagggccccatcggcccccccggcgagaagggcccccagggcaagcccggcctggccggcctgcccggcgccgacggcccccccggccaccccggcaaggagggccagagcggcgagaagggcgccctgggcccccccggcccccagggccccatcggctaccccggccccagaggcgtgaagggcgccgacggcgtgagaggcctgaagggcagcaagggcgagaagggcgaggacggcttccccggcttcaagggcgacatgggcctgaagggcgacagaggcgaggtgggccagatcggccccagaggcgaggacggccccgagggccccaagggcagagccggccccaccggcgaccccggccccagcggccaggccggcgagaagggcaagctgggcgtgcccggcctgcccggctaccccggcagacagggccccaagggcagcaccggcttccccggcttccccggcgccaacggcgagaagggcgccagaggcgtggccggcaagcccggccccagaggccagagaggccccaccggccccagaggcagcagaggcgccagaggccccaccggcaagcccggccccaagggcaccagcggcggcgacggcccccccggcccccccggcgagagaggcccccagggcccccagggccccgtgggcttccccggccccaagggcccccccggcccccccggcaaggacggcctgcccggccaccccggccagagaggcgagaccggcttccagggcaagaccggcccccccggccccggcggcgtggtgggcccccagggccccaccggcgagaccggccccatcggcgagagaggccaccccggcccccccggcccccccggcgagcagggcctgcccggcgccgccggcaaggagggcgccaagggcgaccccggcccccagggcatcagcggcaaggacggccccgccggcctgagaggcttccccggcgagagaggcctgcccggcgcccagggcgcccccggcctgaagggcggcgagggcccccagggcccccccggccccgtgggcagccccggcgagagaggcagcgccggcaccgccggccccatcggcctgcccggcagacccggcccccagggcccccccggccccgccggcgagaagggcgcccccggcgagaagggcccccagggccccgccggcagagacggcgtgcagggccccgtgggcctgcccggccccgccggccccgccggcagccccggcgaggacggcgacaagggcgagatcggcgagcccggccagaagggcagcaagggcgacaagggcgagaacggcccccccggcccccccggcctgcagggccccgtgggcgcccccggcatcgccggcggcgacggcgagcccggccccagaggccagcagggcatgttcggccagaagggcgacgagggcgccagaggcttccccggcccccccggccccatcggcctgcagggcctgcccggcccccccggcgagaagggcgagaacggcgacgtgggccccatgggcccccccggcccccccggccccagaggcccccagggccccaacggcgccgacggcccccagggcccccccggcagcgtgggcagcgtgggcggcgtgggcgagaagggcgagcccggcgaggccggcaaccccggcccccccggcgaggccggcgtgggcggccccaagggcgagagaggcgagaagggcgaggccggcccccccggcgccgccggcccccccggcgccaagggcccccccggcgacgacggccccaagggcaaccccggccccgtgggcttccccggcgaccccggcccccccggcgagcccggccccgccggccaggacggcgtgggcggcgacaagggcgaggacggcgaccccggccagcccggcccccccggccccagcggcgaggccggcccccccggcccccccggcaagagaggcccccccggcgccgccggcgccgagggcagacagggcgagaagggcgccaagggcgaggccggcgccgagggcccccccggcaagaccggccccgtgggcccccagggccccgccggcaagcccggccccgagggcctgagaggcatccccggccccgtgggcgagcagggcctgcccggcgccgccggccaggacggcccccccggccccatgggcccccccggcctgcccggcctgaagggcgaccccggcagcaagggcgagaagggccaccccggcctgatcggcctgatcggcccccccggcgagcagggcgagaagggcgacagaggcctgcccggcacccagggcagccccggcgccaagggcgacggcggcatccccggccccgccggccccctgggcccccccggcccccccggcctgcccggcccccagggccccaagggcaacaagggcagcaccggccccgccggccagaagggcgacagcggcctgcccggcccccccggcagccccggcccccccggcgaggtgatccagcccctgcccatcctgagcagcaagaagaccagaagacacaccgagggcatgcaggccgacgccgacgacaacatcctggactacagcgacggcatggaggagatcttcggcagcctgaacagcctgaagcaggacatcgagcacatgaagttccccatgggcacccagaccaaccccgccagaacctgcaaggacctgcagctgagccaccccgacttccccgacggcgagtactggatcgaccccaaccagggctgcagcggcgacagcttcaaggtgtactgcaacttcaccagcggcggcgagacctgcatctaccccgacaagaagagcgagggcgtgagaatcagcagctggcccaaggagaagcccggcagctggttcagcgagttcaagagaggcaagctgctgagctacctggacgtggagggcaacagcatcaacatggtgcagatgaccttcctgaagctgctgaccgccagcgccagacagaacttcacctaccactgccaccagagcgccgcctggtacgacgtgagcagcggcagctacgacaaggccctgagattcctgggcagcaacgacgaggagatgagctacgacaacaaccccttcatcaagaccctgtacgacggctgcgccagcagaaagggctacgagaagaccgtgatcgagatcaacacccccaagatcgaccaggtgcccatcgtggacgtgatgatcaacgacttcggcgaccagaaccagaagttcggcttcgaggtgggccccgtgtgcttcctgggctag

SEQ ID NO: 10147 - DNA, 3081 bp, Artificial Sequence
  Description of Artificial Sequence: Synthetic coding sequence
atggtgagcgaggtgagcagagacctgaaggtgaagagagagaagctggtgaagctggcccaggagggcaagatggccctgaaggaccccaaggtggagcaggcccagctggagacccaggtgctgcaggtgaagcaggagaagagagagaacctggagttccaggactaccaggacatccaggaggacaaggtgcagagaatcagcgacgtgatcggcagcaccggcttccccggcttccccggcgccaacggcgagaagggcgccagaggcgtggccggcaagcccggccccagaggccagagaggccccaccggccccagaggcagcagaggcgccagaggccccaccggcaagcccggccccaagggcaccagcggcggcgacggcccccccggcccccccggcgagagaggcccccagggcccccagggccccgtgggcttccccggccccaagggcccccccggcccccccggcaaggacggcctgcccggccaccccggccagagaggcgagaccggcttccagggcaagaccggcccccccggccccggcggcgtggtgggcccccagggccccaccggcgagaccggccccatcggcgagagaggccaccccggcccccccggcccccccggcgagcagggcctgcccggcgccgccggcaaggagggcgccaagggcgaccccggcccccagggcatcagcggcaaggacggccccgccggcctgagaggcttccccggcgagagaggcctgcccggcgcccagggcgcccccggcctgaagggcggcgagggcccccagggcccccccggccccgtgggcagccccggcgagagaggcagcgccggcaccgccggccccatcggcctgcccggcagacccggcccccagggcccccccggccccgccggcgagaagggcgcccccggcgagaagggcccccagggccccgccggcagagacggcgtgcagggccccgtgggcctgcccggccccgccggccccgccggcagccccggcgaggacggcgacaagggcgagatcggcgagcccggccagaagggcagcaagggcgacaagggcgagaacggcccccccggcccccccggcctgcagggccccgtgggcgcccccggcatcgccggcggcgacggcgagcccggccccagaggccagcagggcatgttcggccagaagggcgacgagggcgccagaggcttccccggcccccccggccccatcggcctgcagggcctgcccggcccccccggcgagaagggcgagaacggcgacgtgggccccatgggcccccccggcccccccggccccagaggcccccagggccccaacggcgccgacggcccccagggcccccccggcagcgtgggcagcgtgggcggcgtgggcgagaagggcgagcccggcgaggccggcaaccccggcccccccggcgaggccggcgtgggcggccccaagggcgagagaggcgagaagggcgaggccggcccccccggcgccgccggcccccccggcgccaagggcccccccggcgacgacggccccaagggcaaccccggccccgtgggcttccccggcgaccccggcccccccggcgagcccggccccgccggccaggacggcgtgggcggcgacaagggcgaggacggcgaccccggccagcccggcccccccggccccagcggcgaggccggcccccccggcccccccggcaagagaggcccccccggcgccgccggcgccgagggcagacagggcgagaagggcgccaagggcgaggccggcgccgagggcccccccggcaagaccggccccgtgggcccccagggccccgccggcaagcccggccccgagggcctgagaggcatccccggccccgtgggcgagcagggcctgcccggcgccgccggccaggacggcccccccggccccatgggcccccccggcctgcccggcctgaagggcgaccccggcagcaagggcgagaagggccaccccggcctgatcggcctgatcggcccccccggcgagcagggcgagaagggcgacagaggcctgcccggcacccagggcagccccggcgccaagggcgacggcggcatccccggccccgccggccccctgggcccccccggcccccccggcctgcccggcccccagggccccaagggcaacaagggcagcaccggccccgccggccagaagggcgacagcggcctgcccggcccccccggcagccccggcccccccggcgaggtgatccagcccctgcccatcctgagcagcaagaagaccagaagacacaccgagggcatgcaggccgacgccgacgacaacatcctggactacagcgacggcatggaggagatcttcggcagcctgaacagcctgaagcaggacatcgagcacatgaagttccccatgggcacccagaccaaccccgccagaacctgcaaggacctgcagctgagccaccccgacttccccgacggcgagtactggatcgaccccaaccagggctgcagcggcgacagcttcaaggtgtactgcaacttcaccagcggcggcgagacctgcatctaccccgacaagaagagcgagggcgtgagaatcagcagctggcccaaggagaagcccggcagctggttcagcgagttcaagagaggcaagctgctgagctacctggacgtggagggcaacagcatcaacatggtgcagatgaccttcctgaagctgctgaccgccagcgccagacagaacttcacctaccactgccaccagagcgccgcctggtacgacgtgagcagcggcagctacgacaaggccctgagattcctgggcagcaacgacgaggagatgagctacgacaacaaccccttcatcaagaccctgtacgacggctgcgccagcagaaagggctacgagaagaccgtgatcgagatcaacacccccaagatcgaccaggtgcccatcgtggacgtgatgatcaacgacttcggcgaccagaaccagaagttcggcttcgaggtgggccccgtgtgcttcctgggctag

SEQ ID NO: 10148 - DNA, 5421 bp, Artificial Sequence
  Description of Artificial Sequence: Synthetic coding sequence
atggagccctggagcagcagatggaagaccaagagatggctgtgggacttcaccgtgaccaccctggccctgaccttcctgttccaggccagagaggtgagaggcgccgcccccgtggacgtgctgaaggccctggacttccacaacagccccgagggcatcagcaagaccaccggcttctgcaccaacagaaagaacagcaagggcagcgacaccgcctacagagtgagcaagcaggcccagctgagcgcccccaccaagcagctgttccccggcggcaccttccccgaggacttcagcatcctgttcaccgtgaagcccaagaagggcatccagagcttcctgctgagcatctacaacgagcacggcatccagcagatcggcgtggaggtgggcagaagccccgtgttcctgttcgaggaccacaccggcaagcccgcccccgaggactaccccctgttcagaaccgtgaacatcgccgacggcaagtggcacagagtggccatcagcgtggagaagaagaccgtgaccatgatcgtggactgcaagaagaagaccaccaagcccctggacagaagcgagagagccatcgtggacaccaacggcatcaccgtgttcggcaccagaatcctggacgaggaggtgttcgagggcgacatccagcagttcctgatcaccggcgaccccaaggccgcctacgactactgcgagcactacagccccgactgcgacagcagcgcccccaaggccgcccaggcccaggagccccagatcgacgagtacgcccccgaggacatcatcgagtacgactacgagtacggcgaggccgagtacaaggaggccgagagcgtgaccgagggccccaccgtgaccgaggagaccatcgcccagaccgaggccaacatcgtggacgacttccaggagtacaactacggcaccatggagagctaccagaccgaggcccccagacacgtgagcggcaccaacgagcccaaccccgtggaggagatcttcaccgaggagtacctgaccggcgaggactacgacagccagagaaagaacagcgaggacaccctgtacgagaacaaggagatcgacggcagagacagcgacctgctggtggacggcgacctgggcgagtacgacttctacgagtacaaggagtacgaggacaagcccaccagcccccccaacgaggagttcggccccggcgtgcccgccgagaccgacatcaccgagaccagcatcaacggccacggcgcctacggcgagaagggccagaagggcgagcccgccgtggtggagcccggcatgctggtggagggcccccccggccccgccggccccgccggcatcatgggcccccccggcctgcagggccccaccggcccccccggcgaccccggcgacagaggcccccccggcagacccggcctgcccggcgccgacggcctgcccggcccccccggcaccatgctgatgctgcccttcagatacggcggcgacggcagcaagggccccaccatcagcgcccaggaggcccaggcccaggccatcctgcagcaggccagaatcgccctgagaggcccccccggccccatgggcctgaccggcagacccggccccgtgggcggccccggcagcagcggcgccaagggcgagagcggcgaccccggcccccagggccccagaggcgtgcagggcccccccggccccaccggcaagcccggcaagagaggcagacccggcgccgacggcggcagaggcatgcccggcgagcccggcgccaagggcgacagaggcttcgacggcctgcccggcctgcccggcgacaagggccacagaggcgagagaggcccccagggcccccccggcccccccggcgacgacggcatgagaggcgaggacggcgagatcggccccagaggcctgcccggcgaggccggccccagaggcctgctgggccccagaggcacccccggcgcccccggccagcccggcatggccggcgtggacggcccccccggccccaagggcaacatgggcccccagggcgagcccggcccccccggccagcagggcaaccccggcccccagggcctgcccggcccccagggccccatcggcccccccggcgagaagggcccccagggcaagcccggcctggccggcctgcccggcgccgacggcccccccggccaccccggcaaggagggccagagcggcgagaagggcgccctgggcccccccggcccccagggccccatcggctaccccggccccagaggcgtgaagggcgccgacggcgtgagaggcctgaagggcagcaagggcgagaagggcgaggacggcttccccggcttcaagggcgacatgggcctgaagggcgacagaggcgaggtgggccagatcggccccagaggcgaggacggccccgagggccccaagggcagagccggccccaccggcgaccccggccccagcggccaggccggcgagaagggcaagctgggcgtgcccggcctgcccggctaccccggcagacagggccccaagggcagcaccggcttccccggcttccccggcgccaacggcgagaagggcgccagaggcgtggccggcaagcccggccccagaggccagagaggccccaccggccccagaggcagcagaggcgccagaggccccaccggcaagcccggccccaagggcaccagcggcggcgacggcccccccggcccccccggcgagagaggcccccagggcccccagggccccgtgggcttccccggccccaagggcccccccggcccccccggcaaggacggcctgcccggccaccccggccagagaggcgagaccggcttccagggcaagaccggcccccccggccccggcggcgtggtgggcccccagggccccaccggcgagaccggccccatcggcgagagaggccaccccggcccccccggcccccccggcgagcagggcctgcccggcgccgccggcaaggagggcgccaagggcgaccccggcccccagggcatcagcggcaaggacggccccgccggcctgagaggcttccccggcgagagaggcctgcccggcgcccagggcgcccccggcctgaagggcggcgagggcccccagggcccccccggccccgtgggcagccccggcgagagaggcagcgccggcaccgccggccccatcggcctgcccggcagacccggcccccagggcccccccggccccgccggcgagaagggcgcccccggcgagaagggcccccagggccccgccggcagagacggcgtgcagggccccgtgggcctgcccggccccgccggccccgccggcagccccggcgaggacggcgacaagggcgagatcggcgagcccggccagaagggcagcaagggcgacaagggcgagaacggcccccccggcccccccggcctgcagggccccgtgggcgcccccggcatcgccggcggcgacggcgagcccggccccagaggccagcagggcatgttcggccagaagggcgacgagggcgccagaggcttccccggcccccccggccccatcggcctgcagggcctgcccggcccccccggcgagaagggcgagaacggcgacgtgggccccatgggcccccccggcccccccggccccagaggcccccagggccccaacggcgccgacggcccccagggcccccccggcagcgtgggcagcgtgggcggcgtgggcgagaagggcgagcccggcgaggccggcaaccccggcccccccggcgaggccggcgtgggcggccccaagggcgagagaggcgagaagggcgaggccggcccccccggcgccgccggcccccccggcgccaagggcccccccggcgacgacggccccaagggcaaccccggccccgtgggcttccccggcgaccccggcccccccggcgagcccggccccgccggccaggacggcgtgggcggcgacaagggcgaggacggcgaccccggccagcccggcccccccggccccagcggcgaggccggcccccccggcccccccggcaagagaggcccccccggcgccgccggcgccgagggcagacagggcgagaagggcgccaagggcgaggccggcgccgagggcccccccggcaagaccggccccgtgggcccccagggccccgccggcaagcccggccccgagggcctgagaggcatccccggccccgtgggcgagcagggcctgcccggcgccgccggccaggacggcccccccggccccatgggcccccccggcctgcccggcctgaagggcgaccccggcagcaagggcgagaagggccaccccggcctgatcggcctgatcggcccccccggcgagcagggcgagaagggcgacagaggcctgcccggcacccagggcagccccggcgccaagggcgacggcggcatccccggccccgccggccccctgggcccccccggcccccccggcctgcccggcccccagggccccaagggcaacaagggcagcaccggccccgccggccagaagggcgacagcggcctgcccggcccccccggcagccccggcccccccggcgaggtgatccagcccctgcccatcctgagcagcaagaagaccagaagacacaccgagggcatgcaggccgacgccgacgacaacatcctggactacagcgacggcatggaggagatcttcggcagcctgaacagcctgaagcaggacatcgagcacatgaagttccccatgggcacccagaccaaccccgccagaacctgcaaggacctgcagctgagccaccccgacttccccgacggcgagtactggatcgaccccaaccagggctgcagcggcgacagcttcaaggtgtactgcaacttcaccagcggcggcgagacctgcatctaccccgacaagaagagcgagggcgtgagaatcagcagctggcccaaggagaagcccggcagctggttcagcgagttcaagagaggcaagctgctgagctacctggacgtggagggcaacagcatcaacatggtgcagatgaccttcctgaagctgctgaccgccagcgccagacagaacttcacctaccactgccaccagagcgccgcctggtacgacgtgagcagcggcagctacgacaaggccctgagattcctgggcagcaacgacgaggagatgagctacgacaacaaccccttcatcaagaccctgtacgacggctgcgccagcagaaagggctacgagaagaccgtgatcgagatcaacacccccaagatcgaccaggtgcccatcgtggacgtgatgatcaacgacttcggcgaccagaaccagaagttcggcttcgaggtgggccccgtgtgcttcctgggctag

SEQ ID NO: 10149 - DNA, 5073 bp, Artificial Sequence
  Description of Artificial Sequence: Synthetic coding sequence
atggagccctggagcagcagatggaagaccaagagatggctgtgggacttcaccgtgaccaccctggccctgaccttcctgttccaggccagagaggtgagaggcgccgcccccgtggacgtgctgaaggccctggacttccacaacagccccgagggcatcagcaagaccaccggcttctgcaccaacagaaagaacagcaagggcagcgacaccgcctacagagtgagcaagcaggcccagctgagcgcccccaccaagcagctgttccccggcggcaccttccccgaggacttcagcatcctgttcaccgtgaagcccaagaagggcatccagagcttcctgctgagcatctacaacgagcacggcatccagcagatcggcgtggaggtgggcagaagccccgtgttcctgttcgaggaccacaccggcaagcccgcccccgaggactaccccctgttcagaaccgtgaacatcgccgacggcaagtggcacagagtggccatcagcgtggagaagaagaccgtgaccatgatcgtggactgcaagaagaagaccaccaagcccctggacagaagcgagagagccatcgtggacaccaacggcatcaccgtgttcggcaccagaatcctggacgaggaggtgttcgagggcgacatccagcagttcctgatcaccggcgaccccaaggccgcctacgactactgcgagcactacagccccgactgcgacagcagcgcccccaaggccgcccaggcccaggagccccagatcgacgagtacgcccccgaggacatcatcgagtacgactacgagtacggcgaggccgagtacaaggaggccgagagcgtgaccgagggccccaccgtgaccgaggagaccatcgcccagaccgagatcaacggccacggcgcctacggcgagaagggccagaagggcgagcccgccgtggtggagcccggcatgctggtggagggcccccccggccccgccggccccgccggcatcatgggcccccccggcctgcagggccccaccggcccccccggcgaccccggcgacagaggcccccccggcagacccggcctgcccggcgccgacggcctgcccggcccccccggcaccatgctgatgctgcccttcagatacggcggcgacggcagcaagggccccaccatcagcgcccaggaggcccaggcccaggccatcctgcagcaggccagaatcgccctgagaggcccccccggccccatgggcctgaccggcagacccggccccgtgggcggccccggcagcagcggcgccaagggcgagagcggcgaccccggcccccagggccccagaggcgtgcagggcccccccggccccaccggcaagcccggcaagagaggcagacccggcgccgacggcggcagaggcatgcccggcgagcccggcgccaagggcgacagaggcttcgacggcctgcccggcctgcccggcgacaagggccacagaggcgagagaggcccccagggcccccccggcccccccggcgacgacggcatgagaggcgaggacggcgagatcggccccagaggcctgcccggcgaggccggccccagaggcctgctgggccccagaggcacccccggcgcccccggccagcccggcatggccggcgtggacggcccccccggccccaagggcaacatgggcccccagggcgagcccggcccccccggccagcagggcaaccccggcccccagggcctgcccggcccccagggccccatcggcccccccggcgagaagggcccccagggcaagcccggcctggccggcctgcccggcgccgacggcccccccggccaccccggcaaggagggccagagcggcgagaagggcgccctgggcccccccggcccccagggccccatcggctaccccggccccagaggcgtgaagggcgccgacggcgtgagaggcctgaagggcagcaagggcgagaagggcgaggacggcttccccggcttcaagggcgacatgggcctgaagggcgacagaggcgaggtgggccagatcggccccagaggcgaggacggccccgagggccccaagggcagagccggccccaccggcgaccccggccccagcggccaggccggcgagaagggcaagctgggcgtgcccggcctgcccggctaccccggcagacagggccccaagggcagcaccggcttccccggcttccccggcgccaacggcgagaagggcgccagaggcgtggccggcaagcccggccccagaggccagagaggccccaccggccccagaggcagcagaggcgccagaggccccaccggcaagcccggccccaagggcaccagcggcggcgacggcccccccggcccccccggcgagagaggcccccagggcccccagggccccgtgggcttccccggccccaagggcccccccggcccccccggcaaggacggcctgcccggccaccccggccagagaggcgagaccggcttccagggcaagaccggcccccccggccccggcggcgtggtgggcccccagggccccaccggcgagaccggccccatcggcgagagaggccaccccggcccccccggcccccccggcgagcagggcctgcccggcgccgccggcaaggagggcgccaagggcgaccccggcccccagggcatcagcggcaaggacggccccgccggcctgagaggcttccccggcgagagaggcctgcccggcgcccagggcgcccccggcctgaagggcggcgagggcccccagggcccccccggccccgtgggcagccccggcgagagaggcagcgccggcaccgccggccccatcggcctgcccggcagacccggcccccagggcccccccggccccgccggcgagaagggcgcccccggcgagaagggcccccagggccccgccggcagagacggcgtgcagggccccgtgggcctgcccggccccgccggccccgccggcagccccggcgaggacggcgacaagggcgagatcggcgagcccggccagaagggcagcaagggcgacaagggcgagaacggcccccccggcccccccggcctgcagggccccgtgggcgcccccggcatcgccggcggcgacggcgagcccggccccagaggccagcagggcatgttcggccagaagggcgacgagggcgccagaggcttccccggcccccccggccccatcggcctgcagggcctgcccggcccccccggcgagaagggcgagaacggcgacgtgggccccatgggcccccccggcccccccggccccagaggcccccagggccccaacggcgccgacggcccccagggcccccccggcagcgtgggcagcgtgggcggcgtgggcgagaagggcgagcccggcgaggccggcaaccccggcccccccggcgaggccggcgtgggcggccccaagggcgagagaggcgagaagggcgaggccggcccccccggcgccgccggcccccccggcgccaagggcccccccggcgacgacggccccaagggcaaccccggccccgtgggcttccccggcgaccccggcccccccggcgagcccggccccgccggccaggacggcgtgggcggcgacaagggcgaggacggcgaccccggccagcccggcccccccggccccagcggcgaggccggcccccccggcccccccggcaagagaggcccccccggcgccgccggcgccgagggcagacagggcgagaagggcgccaagggcgaggccggcgccgagggcccccccggcaagaccggccccgtgggcccccagggccccgccggcaagcccggccccgagggcctgagaggcatccccggccccgtgggcgagcagggcctgcccggcgccgccggccaggacggcccccccggccccatgggcccccccggcctgcccggcctgaagggcgaccccggcagcaagggcgagaagggccaccccggcctgatcggcctgatcggcccccccggcgagcagggcgagaagggcgacagaggcctgcccggcacccagggcagccccggcgccaagggcgacggcggcatccccggccccgccggccccctgggcccccccggcccccccggcctgcccggcccccagggccccaagggcaacaagggcagcaccggccccgccggccagaagggcgacagcggcctgcccggcccccccggcagccccggcccccccggcgaggtgatccagcccctgcccatcctgagcagcaagaagaccagaagacacaccgagggcatgcaggccgacgccgacgacaacatcctggactacagcgacggcatggaggagatcttcggcagcctgaacagcctgaagcaggacatcgagcacatgaagttccccatgggcacccagaccaaccccgccagaacctgcaaggacctgcagctgagccaccccgacttccccgacggcgagtactggatcgaccccaaccagggctgcagcggcgacagcttcaaggtgtactgcaacttcaccagcggcggcgagacctgcatctaccccgacaagaagagcgagggcgtgagaatcagcagctggcccaaggagaagcccggcagctggttcagcgagttcaagagaggcaagctgctgagctacctggacgtggagggcaacagcatcaacatggtgcagatgaccttcctgaagctgctgaccgccagcgccagacagaacttcacctaccactgccaccagagcgccgcctggtacgacgtgagcagcggcagctacgacaaggccctgagattcctgggcagcaacgacgaggagatgagctacgacaacaaccccttcatcaagaccctgtacgacggctgcgccagcagaaagggctacgagaagaccgtgatcgagatcaacacccccaagatcgaccaggtgcccatcgtggacgtgatgatcaacgacttcggcgaccagaaccagaagttcggcttcgaggtgggccccgtgtgcttcctgggctag

SEQ ID NO: 10150 - DNA, 4560 bp, Artificial Sequence
  Description of Artificial Sequence: Synthetic coding sequence
atggccccctacccctgcggctgccacatcctgctgctgctgttctgctgcctggccgccgccagagccaacctgctgaacctgaactggctgtggttcaacaacgaggacaccagccacgccgccaccaccatccccgagccccagggccccctgcccgtgcagcccaccgccgacaccaccacccacgtgacccccagaaacggcagcaccgagcccgccaccgcccccggcagccccgagccccccagcgagctgctggaggacggccaggacacccccaccagcgccgagagccccgacgcccccgaggagaacatcgccggcgtgggcgccgagatcctgaacgtggccaagggcatcagaagcttcgtgcagctgtggaacgacaccgtgcccaccgagagcctggccagagccgagaccctggtgctggagacccccgtgggccccctggccctggccggccccagcagcaccccccaggagaacggcaccaccctgtggcccagcagaggcatccccagcagccccggcgcccacaccaccgaggccggcaccctgcccgcccccacccccagcccccccagcctgggcagaccctgggcccccctgaccggccccagcgtgcccccccccagcagcgagagaatcagcgaggaggtgggcctgctgcagctgctgggcgacccccccccccagcaggtgacccagaccgacgaccccgacgtgggcctggcctacgtgttcggccccgacgccaacagcggccaggtggccagataccacttccccagcctgttcttcagagacttcagcctgctgttccacatcagacccgccaccgagggccccggcgtgctgttcgccatcaccgacagcgcccaggccatggtgctgctgggcgtgaagctgagcggcgtgcaggacggccaccaggacatcagcctgctgtacaccgagcccggcgccggccagacccacaccgccgccagcttcagactgcccgccttcgtgggccagtggacccacctggccctgagcgtggccggcggcttcgtggccctgtacgtggactgcgaggagttccagagaatgcccctggccagaagcagcagaggcctggagctggagcccggcgccggcctgttcgtggcccaggccggcggcgccgaccccgacaagttccagggcgtgatcgccgagctgaaggtgagaagagacccccaggtgagccccatgcactgcctggacgaggagggcgacgacagcgacggcgccagcggcgacagcggcagcggcctgggcgacgccagagagctgctgagagaggagaccggcgccgccctgaagcccagactgcccgcccccccccccgtgaccaccccccccctggccggcggcagcagcaccgaggacagcagaagcgaggaggtggaggagcagaccaccgtggccagcctgggcgcccagaccctgcccggcagcgacagcgtgagcacctgggacggcagcgtgagaacccccggcggcagagtgaaggagggcggcctgaagggccagaagggcgagcccggcgtgcccggcccccccggcagagccggcccccccggcagcccctgcctgcccggcccccccggcctgccctgccccgtgagccccctgggccccgccggccccgccctgcagaccgtgcccggcccccagggcccccccggcccccccggcagagacggcacccccggcagagacggcgagcccggcgaccccggcgaggacggcaagcccggcgacaccggcccccagggcttccccggcacccccggcgacgtgggccccaagggcgacaagggcgaccccggcgtgggcgagagaggcccccccggcccccagggcccccccggcccccccggccccagcttcagacacgacaagctgaccttcatcgacatggagggcagcggcttcggcggcgacctggaggccctgagaggccccagaggcttccccggcccccccggcccccccggcgtgcccggcctgcccggcgagcccggcagattcggcgtgaacagcagcgacgtgcccggccccgccggcctgcccggcgtgcccggcagagagggcccccccggcttccccggcctgcccggcccccccggcccccccggcagagagggcccccccggcagaaccggccagaagggcagcctgggcgaggccggcgcccccggccacaagggcagcaagggcgcccccggccccgccggcgccagaggcgagagcggcctggccggcgcccccggccccgccggcccccccggcccccccggcccccccggcccccccggccccggcctgcccgccggcttcgacgacatggagggcagcggcggccccttctggagcaccgccagaagcgccgacggcccccagggcccccccggcctgcccggcctgaagggcgaccccggcgtgcccggcctgcccggcgccaagggcgaggtgggcgccgacggcgtgcccggcttccccggcctgcccggcagagagggcatcgccggcccccagggccccaagggcgacagaggcagcagaggcgagaagggcgaccccggcaaggacggcgtgggccagcccggcctgcccggcccccccggcccccccggccccgtggtgtacgtgagcgagcaggacggcagcgtgctgagcgtgcccggccccgagggcagacccggcttcgccggcttccccggccccgccggccccaagggcaacctgggcagcaagggcgagagaggcagccccggccccaagggcgagaagggcgagcccggcagcatcttcagccccgacggcggcgccctgggccccgcccagaagggcgccaagggcgagcccggcttcagaggcccccccggcccctacggcagacccggctacaagggcgagatcggcttccccggcagacccggcagacccggcatgaacggcctgaagggcgagaagggcgagcccggcgacgccagcctgggcttcggcatgagaggcatgcccggcccccccggcccccccggcccccccggcccccccggcacccccgtgtacgacagcaacgtgttcgccgagagcagcagacccggcccccccggcctgcccggcaaccagggcccccccggccccaagggcgccaagggcgaggtgggcccccccggcccccccggccagttccccttcgacttcctgcagctggaggccgagatgaagggcgagaagggcgacagaggcgacgccggccagaagggcgagagaggcgagcccggcggcggcggcttcttcggcagcagcctgcccggcccccccggcccccccggcccccccggccccagaggctaccccggcatccccggccccaagggcgagagcatcagaggccagcccggcccccccggcccccagggcccccccggcatcggctacgagggcagacagggcccccccggcccccccggcccccccggcccccccagcttccccggcccccacagacagaccatcagcgtgcccggcccccccggcccccccggcccccccggcccccccggcaccatgggcgccagcagcggcgtgagactgtgggccaccagacaggccatgctgggccaggtgcacgaggtgcccgagggctggctgatcttcgtggccgagcaggaggagctgtacgtgagagtgcagaacggcttcagaaaggtgcagctggaggccagaacccccctgcccagaggcaccgacaacgaggtggccgccctgcagccccccgtggtgcagctgcacgacagcaacccctaccccagaagagagcacccccaccccaccgccagaccctggagagccgacgacatcctggccagcccccccagactgcccgagccccagccctaccccggcgccccccaccacagcagctacgtgcacctgagacccgccagacccaccagcccccccgcccacagccacagagacttccagcccgtgctgcacctggtggccctgaacagccccctgagcggcggcatgagaggcatcagaggcgccgacttccagtgcttccagcaggccagagccgtgggcctggccggcaccttcagagccttcctgagcagcagactgcaggacctgtacagcatcgtgagaagagccgacagagccgccgtgcccatcgtgaacctgaaggacgagctgctgttccccagctgggaggccctgttcagcggcagcgagggccccctgaagcccggcgccagaatcttcagcttcgacggcaaggacgtgctgagacaccccacctggccccagaagagcgtgtggcacggcagcgaccccaacggcagaagactgaccgagagctactgcgagacctggagaaccgaggcccccagcgccaccggccaggccagcagcctgctgggcggcagactgctgggccagagcgccgccagctgccaccacgcctacatcgtgctgtgcatcgagaacagcttcatgaccgccagcaagtag

SEQ ID NO: 10151 - DNA, 5265 bp, Artificial Sequence
  Description of Artificial Sequence: Synthetic coding sequence
atggccccctacccctgcggctgccacatcctgctgctgctgttctgctgcctggccgccgccagagccaacctgctgaacctgaactggctgtggttcaacaacgaggacaccagccacgccgccaccaccatccccgagccccagggccccctgcccgtgcagcccaccgccgacaccaccacccacgtgacccccagaaacggcagcaccgagcccgccaccgcccccggcagccccgagccccccagcgagctgctggaggacggccaggacacccccaccagcgccgagagccccgacgcccccgaggagaacatcgccggcgtgggcgccgagatcctgaacgtggccaagggcatcagaagcttcgtgcagctgtggaacgacaccgtgcccaccgagagcctggccagagccgagaccctggtgctggagacccccgtgggccccctggccctggccggccccagcagcaccccccaggagaacggcaccaccctgtggcccagcagaggcatccccagcagccccggcgcccacaccaccgaggccggcaccctgcccgcccccacccccagcccccccagcctgggcagaccctgggcccccctgaccggccccagcgtgcccccccccagcagcggcagagccagcctgagcagcctgctgggcggcgcccccccctggggcagcctgcaggaccccgacagccagggcctgagccccgccgccgccgcccccagccagcagctgcagagacccgacgtgagactgagaacccccctgctgcaccccctggtgatgggcagcctgggcaagcacgccgcccccagcgccttcagcagcggcctgcccggcgccctgagccaggtggccgtgaccaccctgaccagagacagcggcgcctgggtgagccacgtggccaacagcgtgggccccggcctggccaacaacagcgccctgctgggcgccgaccccgaggcccccgccggcagatgcctgcccctgccccccagcctgcccgtgtgcggccacctgggcatcagcagattctggctgcccaaccacctgcaccacgagagcggcgagcaggtgagagccggcgccagagcctggggcggcctgctgcagacccactgccaccccttcctggcctggttcttctgcctgctgctggtgcccccctgcggcagcgtgcccccccccgccccccccccctgctgccagttctgcgaggccctgcaggacgcctgctggagcagactgggcggcggcagactgcccgtggcctgcgccagcctgcccacccaggaggacggctactgcgtgctgatcggccccgccgccgagagaatcagcgaggaggtgggcctgctgcagctgctgggcgacccccccccccagcaggtgacccagaccgacgaccccgacgtgggcctggcctacgtgttcggccccgacgccaacagcggccaggtggccagataccacttccccagcctgttcttcagagacttcagcctgctgttccacatcagacccgccaccgagggccccggcgtgctgttcgccatcaccgacagcgcccaggccatggtgctgctgggcgtgaagctgagcggcgtgcaggacggccaccaggacatcagcctgctgtacaccgagcccggcgccggccagacccacaccgccgccagcttcagactgcccgccttcgtgggccagtggacccacctggccctgagcgtggccggcggcttcgtggccctgtacgtggactgcgaggagttccagagaatgcccctggccagaagcagcagaggcctggagctggagcccggcgccggcctgttcgtggcccaggccggcggcgccgaccccgacaagttccagggcgtgatcgccgagctgaaggtgagaagagacccccaggtgagccccatgcactgcctggacgaggagggcgacgacagcgacggcgccagcggcgacagcggcagcggcctgggcgacgccagagagctgctgagagaggagaccggcgccgccctgaagcccagactgcccgcccccccccccgtgaccaccccccccctggccggcggcagcagcaccgaggacagcagaagcgaggaggtggaggagcagaccaccgtggccagcctgggcgcccagaccctgcccggcagcgacagcgtgagcacctgggacggcagcgtgagaacccccggcggcagagtgaaggagggcggcctgaagggccagaagggcgagcccggcgtgcccggcccccccggcagagccggcccccccggcagcccctgcctgcccggcccccccggcctgccctgccccgtgagccccctgggccccgccggccccgccctgcagaccgtgcccggcccccagggcccccccggcccccccggcagagacggcacccccggcagagacggcgagcccggcgaccccggcgaggacggcaagcccggcgacaccggcccccagggcttccccggcacccccggcgacgtgggccccaagggcgacaagggcgaccccggcgtgggcgagagaggcccccccggcccccagggcccccccggcccccccggccccagcttcagacacgacaagctgaccttcatcgacatggagggcagcggcttcggcggcgacctggaggccctgagaggccccagaggcttccccggcccccccggcccccccggcgtgcccggcctgcccggcgagcccggcagattcggcgtgaacagcagcgacgtgcccggccccgccggcctgcccggcgtgcccggcagagagggcccccccggcttccccggcctgcccggcccccccggcccccccggcagagagggcccccccggcagaaccggccagaagggcagcctgggcgaggccggcgcccccggccacaagggcagcaagggcgcccccggccccgccggcgccagaggcgagagcggcctggccggcgcccccggccccgccggcccccccggcccccccggcccccccggcccccccggccccggcctgcccgccggcttcgacgacatggagggcagcggcggccccttctggagcaccgccagaagcgccgacggcccccagggcccccccggcctgcccggcctgaagggcgaccccggcgtgcccggcctgcccggcgccaagggcgaggtgggcgccgacggcgtgcccggcttccccggcctgcccggcagagagggcatcgccggcccccagggccccaagggcgacagaggcagcagaggcgagaagggcgaccccggcaaggacggcgtgggccagcccggcctgcccggcccccccggcccccccggccccgtggtgtacgtgagcgagcaggacggcagcgtgctgagcgtgcccggccccgagggcagacccggcttcgccggcttccccggccccgccggccccaagggcaacctgggcagcaagggcgagagaggcagccccggccccaagggcgagaagggcgagcccggcagcatcttcagccccgacggcggcgccctgggccccgcccagaagggcgccaagggcgagcccggcttcagaggcccccccggcccctacggcagacccggctacaagggcgagatcggcttccccggcagacccggcagacccggcatgaacggcctgaagggcgagaagggcgagcccggcgacgccagcctgggcttcggcatgagaggcatgcccggcccccccggcccccccggcccccccggcccccccggcacccccgtgtacgacagcaacgtgttcgccgagagcagcagacccggcccccccggcctgcccggcaaccagggcccccccggccccaagggcgccaagggcgaggtgggcccccccggcccccccggccagttccccttcgacttcctgcagctggaggccgagatgaagggcgagaagggcgacagaggcgacgccggccagaagggcgagagaggcgagcccggcggcggcggcttcttcggcagcagcctgcccggcccccccggcccccccggcccccccggccccagaggctaccccggcatccccggccccaagggcgagagcatcagaggccagcccggcccccccggcccccagggcccccccggcatcggctacgagggcagacagggcccccccggcccccccggcccccccggcccccccagcttccccggcccccacagacagaccatcagcgtgcccggcccccccggcccccccggcccccccggcccccccggcaccatgggcgccagcagcggcgtgagactgtgggccaccagacaggccatgctgggccaggtgcacgaggtgcccgagggctggctgatcttcgtggccgagcaggaggagctgtacgtgagagtgcagaacggcttcagaaaggtgcagctggaggccagaacccccctgcccagaggcaccgacaacgaggtggccgccctgcagccccccgtggtgcagctgcacgacagcaacccctaccccagaagagagcacccccaccccaccgccagaccctggagagccgacgacatcctggccagcccccccagactgcccgagccccagccctaccccggcgccccccaccacagcagctacgtgcacctgagacccgccagacccaccagcccccccgcccacagccacagagacttccagcccgtgctgcacctggtggccctgaacagccccctgagcggcggcatgagaggcatcagaggcgccgacttccagtgcttccagcaggccagagccgtgggcctggccggcaccttcagagccttcctgagcagcagactgcaggacctgtacagcatcgtgagaagagccgacagagccgccgtgcccatcgtgaacctgaaggacgagctgctgttccccagctgggaggccctgttcagcggcagcgagggccccctgaagcccggcgccagaatcttcagcttcgacggcaaggacgtgctgagacaccccacctggccccagaagagcgtgtggcacggcagcgaccccaacggcagaagactgaccgagagctactgcgagacctggagaaccgaggcccccagcgccaccggccaggccagcagcctgctgggcggcagactgctgggccagagcgccgccagctgccaccacgcctacatcgtgctgtgcatcgagaacagcttcatgaccgccagcaagtag

SEQ ID NO: 10152 - DNA, 4020 bp, Artificial Sequence
  Description of Artificial Sequence: Synthetic coding sequence
atggcccccagatgcccctggccctggcccagaagaagaagactgctggacgtgctggcccccctggtgctgctgctgggcgtgagagccgccagcgccgagcccgagagaatcagcgaggaggtgggcctgctgcagctgctgggcgacccccccccccagcaggtgacccagaccgacgaccccgacgtgggcctggcctacgtgttcggccccgacgccaacagcggccaggtggccagataccacttccccagcctgttcttcagagacttcagcctgctgttccacatcagacccgccaccgagggccccggcgtgctgttcgccatcaccgacagcgcccaggccatggtgctgctgggcgtgaagctgagcggcgtgcaggacggccaccaggacatcagcctgctgtacaccgagcccggcgccggccagacccacaccgccgccagcttcagactgcccgccttcgtgggccagtggacccacctggccctgagcgtggccggcggcttcgtggccctgtacgtggactgcgaggagttccagagaatgcccctggccagaagcagcagaggcctggagctggagcccggcgccggcctgttcgtggcccaggccggcggcgccgaccccgacaagttccagggcgtgatcgccgagctgaaggtgagaagagacccccaggtgagccccatgcactgcctggacgaggagggcgacgacagcgacggcgccagcggcgacagcggcagcggcctgggcgacgccagagagctgctgagagaggagaccggcgccgccctgaagcccagactgcccgcccccccccccgtgaccaccccccccctggccggcggcagcagcaccgaggacagcagaagcgaggaggtggaggagcagaccaccgtggccagcctgggcgcccagaccctgcccggcagcgacagcgtgagcacctgggacggcagcgtgagaacccccggcggcagagtgaaggagggcggcctgaagggccagaagggcgagcccggcgtgcccggcccccccggcagagccggcccccccggcagcccctgcctgcccggcccccccggcctgccctgccccgtgagccccctgggccccgccggccccgccctgcagaccgtgcccggcccccagggcccccccggcccccccggcagagacggcacccccggcagagacggcgagcccggcgaccccggcgaggacggcaagcccggcgacaccggcccccagggcttccccggcacccccggcgacgtgggccccaagggcgacaagggcgaccccggcgtgggcgagagaggcccccccggcccccagggcccccccggcccccccggccccagcttcagacacgacaagctgaccttcatcgacatggagggcagcggcttcggcggcgacctggaggccctgagaggccccagaggcttccccggcccccccggcccccccggcgtgcccggcctgcccggcgagcccggcagattcggcgtgaacagcagcgacgtgcccggccccgccggcctgcccggcgtgcccggcagagagggcccccccggcttccccggcctgcccggcccccccggcccccccggcagagagggcccccccggcagaaccggccagaagggcagcctgggcgaggccggcgcccccggccacaagggcagcaagggcgcccccggccccgccggcgccagaggcgagagcggcctggccggcgcccccggccccgccggcccccccggcccccccggcccccccggcccccccggccccggcctgcccgccggcttcgacgacatggagggcagcggcggccccttctggagcaccgccagaagcgccgacggcccccagggcccccccggcctgcccggcctgaagggcgaccccggcgtgcccggcctgcccggcgccaagggcgaggtgggcgccgacggcgtgcccggcttccccggcctgcccggcagagagggcatcgccggcccccagggccccaagggcgacagaggcagcagaggcgagaagggcgaccccggcaaggacggcgtgggccagcccggcctgcccggcccccccggcccccccggccccgtggtgtacgtgagcgagcaggacggcagcgtgctgagcgtgcccggccccgagggcagacccggcttcgccggcttccccggccccgccggccccaagggcaacctgggcagcaagggcgagagaggcagccccggccccaagggcgagaagggcgagcccggcagcatcttcagccccgacggcggcgccctgggccccgcccagaagggcgccaagggcgagcccggcttcagaggcccccccggcccctacggcagacccggctacaagggcgagatcggcttccccggcagacccggcagacccggcatgaacggcctgaagggcgagaagggcgagcccggcgacgccagcctgggcttcggcatgagaggcatgcccggcccccccggcccccccggcccccccggcccccccggcacccccgtgtacgacagcaacgtgttcgccgagagcagcagacccggcccccccggcctgcccggcaaccagggcccccccggccccaagggcgccaagggcgaggtgggcccccccggcccccccggccagttccccttcgacttcctgcagctggaggccgagatgaagggcgagaagggcgacagaggcgacgccggccagaagggcgagagaggcgagcccggcggcggcggcttcttcggcagcagcctgcccggcccccccggcccccccggcccccccggccccagaggctaccccggcatccccggccccaagggcgagagcatcagaggccagcccggcccccccggcccccagggcccccccggcatcggctacgagggcagacagggcccccccggcccccccggcccccccggcccccccagcttccccggcccccacagacagaccatcagcgtgcccggcccccccggcccccccggcccccccggcccccccggcaccatgggcgccagcagcggcgtgagactgtgggccaccagacaggccatgctgggccaggtgcacgaggtgcccgagggctggctgatcttcgtggccgagcaggaggagctgtacgtgagagtgcagaacggcttcagaaaggtgcagctggaggccagaacccccctgcccagaggcaccgacaacgaggtggccgccctgcagccccccgtggtgcagctgcacgacagcaacccctaccccagaagagagcacccccaccccaccgccagaccctggagagccgacgacatcctggccagcccccccagactgcccgagccccagccctaccccggcgccccccaccacagcagctacgtgcacctgagacccgccagacccaccagcccccccgcccacagccacagagacttccagcccgtgctgcacctggtggccctgaacagccccctgagcggcggcatgagaggcatcagaggcgccgacttccagtgcttccagcaggccagagccgtgggcctggccggcaccttcagagccttcctgagcagcagactgcaggacctgtacagcatcgtgagaagagccgacagagccgccgtgcccatcgtgaacctgaaggacgagctgctgttccccagctgggaggccctgttcagcggcagcgagggccccctgaagcccggcgccagaatcttcagcttcgacggcaaggacgtgctgagacaccccacctggccccagaagagcgtgtggcacggcagcgaccccaacggcagaagactgaccgagagctactgcgagacctggagaaccgaggcccccagcgccaccggccaggccagcagcctgctgggcggcagactgctgggccagagcgccgccagctgccaccacgcctacatcgtgctgtgcatcgagaacagcttcatgaccgccagcaagtag

SEQ ID NO: 10153 - DNA, 4020 bp, Artificial Sequence
  Description of Artificial Sequence: Synthetic coding sequence
atggcccccagatgcccctggccctggcccagaagaagaagactgctggacgtgctggcccccctggtgctgctgctgggcgtgagagccgccagcgccgagcccgagagaatcagcgaggaggtgggcctgctgcagctgctgggcgacccccccccccagcaggtgacccagaccgacgaccccgacgtgggcctggcctacgtgttcggccccgacgccaacagcggccaggtggccagataccacttccccagcctgttcttcagagacttcagcctgctgttccacatcagacccgccaccgagggccccggcgtgctgttcgccatcaccgacagcgcccaggccatggtgctgctgggcgtgaagctgagcggcgtgcaggacggccaccaggacatcagcctgctgtacaccgagcccggcgccggccagacccacaccgccgccagcttcagactgcccgccttcgtgggccagtggacccacctggccctgagcgtggccggcggcttcgtggccctgtacgtggactgcgaggagttccagagaatgcccctggccagaagcagcagaggcctggagctggagcccggcgccggcctgttcgtggcccaggccggcggcgccgaccccgacaagttccagggcgtgatcgccgagctgaaggtgagaagagacccccaggtgagccccatgcactgcctggacgaggagggcgacgacagcgacggcgccagcggcgacagcggcagcggcctgggcgacgccagagagctgctgagagaggagaccggcgccgccctgaagcccagactgcccgcccccccccccgtgaccaccccccccctggccggcggcagcagcaccgaggacagcagaagcgaggaggtggaggagcagaccaccgtggccagcctgggcgcccagaccctgcccggcagcgacagcgtgagcacctgggacggcagcgtgagaacccccggcggcagagtgaaggagggcggcctgaagggccagaagggcgagcccggcgtgcccggcccccccggcagagccggcccccccggcagcccctgcctgcccggcccccccggcctgccctgccccgtgagccccctgggccccgccggccccgccctgcagaccgtgcccggcccccagggcccccccggcccccccggcagagacggcacccccggcagagacggcgagcccgtgagcccccacgtgccccccagccccggcgacaccggcccccagggcttccccggcacccccggcgacgtgggccccaagggcgacaagggcgaccccggcgtgggcgagagaggcccccccggcccccagggcccccccggcccccccggccccagcttcagacacgacaagctgaccttcatcgacatggagggcagcggcttcggcggcgacctggaggccctgagaggccccagaggcttccccggcccccccggcccccccggcgtgcccggcctgcccggcgagcccggcagattcggcgtgaacagcagcgacgtgcccggccccgccggcctgcccggcgtgcccggcagagagggcccccccggcttccccggcctgcccggcccccccggcccccccggcagagagggcccccccggcagaaccggccagaagggcagcctgcagggcgccggcgcccccggcgtgcagggcagcaagggcgcccccggccccgccggcgccagaggcgagagcggcctggccggcgcccccggccccgccggcccccccggcccccccggcccccccggcccccccggccccggcctgcccgccggcttcgacgacatggagggcagcggcggccccttctggagcaccgccagaagcgccgacggcccccaggagccccccgccctgcacggcatcggcggcgaccccggcgtgcccggcctgcccggcgccaagggcgaggtgggcgccgacggcgtgcccggcttccccggcctgcccggcagagagggcatcgccggcccccagggccccaagggcgacagaggcagcagaggcgagaagggcgaccccggcaaggacggcgtgggccagcccggcctgcccggcccccccggcccccccggccccgtggtgtacgtgagcgagcaggacggcagcgtgctgagcgtgcccggccccgagggcagacccggcttcgccggcttccccggccccgccggccccaagggcaacctgggcagcaagggcgagagaggcagccccggccccaagggcgagaagggcgagcccggcagcatcttcagccccgacggcggcgccctgggccccgcccagaagggcgccaagggcgagcccggcttcagaggcccccccggcccctacggcagacccggctacaagggcgagatcggcttccccggcagacccggcagacccggcatgaacggcctgaagggcgagaagggcgagcccggcgacgccagcctgggcttcggcatgagaggcatgcccggcccccccggcccccccggcccccccggcccccccggcacccccgtgtacgacagcaacgtgttcgccgagagcagcagacccggcccccccggcctgcccggcaaccagggcccccccggccccaagggcgccaagggcgaggtgggcccccccggcccccccggccagttccccttcgacttcctgcagctggaggccgagatgaagggcgagaagggcgacagaggcgacgccggccagaagggcgagagaggcgagcccggcggcggcggcttcttcggcagcagcctgcccggcccccccggcccccccggcccccccggccccagaggctaccccggcatccccggccccaagggcgagagcatcagaggccagcccggcccccccggcccccagggcccccccggcatcggctacgagggcagacagggcccccccggcccccccggcccccccggcccccccagcttccccggcccccacagacagaccatcagcgtgcccggcccccccggcccccccggcccccccggcccccccggcaccatgggcgccagcagcggcgtgagactgtgggccaccagacaggccatgctgggccaggtgcacgaggtgcccgagggctggctgatcttcgtggccgagcaggaggagctgtacgtgagagtgcagaacggcttcagaaaggtgcagctggaggccagaacccccctgcccagaggcaccgacaacgaggtggccgccctgcagccccccgtggtgcagctgcacgacagcaacccctaccccagaagagagcacccccaccccaccgccagaccctggagagccgacgacatcctggccagcccccccagactgcccgagccccagccctaccccggcgccccccaccacagcagctacgtgcacctgagacccgccagacccaccagcccccccgcccacagccacagagacttccagcccgtgctgcacctggtggccctgaacagccccctgagcggcggcatgagaggcatcagaggcgccgacttccagtgcttccagcaggccagagccgtgggcctggccggcaccttcagagccttcctgagcagcagactgcaggacctgtacagcatcgtgagaagagccgacagagccgccgtgcccatcgtgaacctgaaggacgagctgctgttccccagctgggaggccctgttcagcggcagcgagggccccctgaagcccggcgccagaatcttcagcttcgacggcaaggacgtgctgagacaccccacctggccccagaagagcgtgtggcacggcagcgaccccaacggcagaagactgaccgagagctactgcgagacctggagaaccgaggcccccagcgccaccggccaggccagcagcctgctgggcggcagactgctgggccagagcgccgccagctgccaccacgcctacatcgtgctgtgcatcgagaacagcttcatgaccgccagcaagtag

SEQ ID NO: 10154 - DNA, 5265 bp, Artificial Sequence
  Description of Artificial Sequence: Synthetic coding sequence
atggccccctacccctgcggctgccacatcctgctgctgctgttctgctgcctggccgccgccagagccaacctgctgaacctgaactggctgtggttcaacaacgaggacaccagccacgccgccaccaccatccccgagccccagggccccctgcccgtgcagcccaccgccgacaccaccacccacgtgacccccagaaacggcagcaccgagcccgccaccgcccccggcagccccgagccccccagcgagctgctggaggacggccaggacacccccaccagcgccgagagccccgacgcccccgaggagaacatcgccggcgtgggcgccgagatcctgaacgtggccaagggcatcagaagcttcgtgcagctgtggaacgacaccgtgcccaccgagagcctggccagagccgagaccctggtgctggagacccccgtgggccccctggccctggccggccccagcagcaccccccaggagaacggcaccaccctgtggcccagcagaggcatccccagcagccccggcgcccacaccaccgaggccggcaccctgcccgcccccacccccagcccccccagcctgggcagaccctgggcccccctgaccggccccagcgtgcccccccccagcagcggcagagccagcctgagcagcctgctgggcggcgcccccccctggggcagcctgcaggaccccgacagccagggcctgagccccgccgccgccgcccccagccagcagctgcagagacccgacgtgagactgagaacccccctgctgcaccccctggtgatgggcagcctgggcaagcacgccgcccccagcgccttcagcagcggcctgcccggcgccctgagccaggtggccgtgaccaccctgaccagagacagcggcgcctgggtgagccacgtggccaacagcgtgggccccggcctggccaacaacagcgccctgctgggcgccgaccccgaggcccccgccggcagatgcctgcccctgccccccagcctgcccgtgtgcggccacctgggcatcagcagattctggctgcccaaccacctgcaccacgagagcggcgagcaggtgagagccggcgccagagcctggggcggcctgctgcagacccactgccaccccttcctggcctggttcttctgcctgctgctggtgcccccctgcggcagcgtgcccccccccgccccccccccctgctgccagttctgcgaggccctgcaggacgcctgctggagcagactgggcggcggcagactgcccgtggcctgcgccagcctgcccacccaggaggacggctactgcgtgctgatcggccccgccgccgagagaatcagcgaggaggtgggcctgctgcagctgctgggcgacccccccccccagcaggtgacccagaccgacgaccccgacgtgggcctggcctacgtgttcggccccgacgccaacagcggccaggtggccagataccacttccccagcctgttcttcagagacttcagcctgctgttccacatcagacccgccaccgagggccccggcgtgctgttcgccatcaccgacagcgcccaggccatggtgctgctgggcgtgaagctgagcggcgtgcaggacggccaccaggacatcagcctgctgtacaccgagcccggcgccggccagacccacaccgccgccagcttcagactgcccgccttcgtgggccagtggacccacctggccctgagcgtggccggcggcttcgtggccctgtacgtggactgcgaggagttccagagaatgcccctggccagaagcagcagaggcctggagctggagcccggcgccggcctgttcgtggcccaggccggcggcgccgaccccgacaagttccagggcgtgatcgccgagctgaaggtgagaagagacccccaggtgagccccatgcactgcctggacgaggagggcgacgacagcgacggcgccagcggcgacagcggcagcggcctgggcgacgccagagagctgctgagagaggagaccggcgccgccctgaagcccagactgcccgcccccccccccgtgaccaccccccccctggccggcggcagcagcaccgaggacagcagaagcgaggaggtggaggagcagaccaccgtggccagcctgggcgcccagaccctgcccggcagcgacagcgtgagcacctgggacggcagcgtgagaacccccggcggcagagtgaaggagggcggcctgaagggccagaagggcgagcccggcgtgcccggcccccccggcagagccggcccccccggcagcccctgcctgcccggcccccccggcctgccctgccccgtgagccccctgggccccgccggccccgccctgcagaccgtgcccggcccccagggcccccccggcccccccggcagagacggcacccccggcagagacggcgagcccgtgagcccccacgtgccccccagccccggcgacaccggcccccagggcttccccggcacccccggcgacgtgggccccaagggcgacaagggcgaccccggcgtgggcgagagaggcccccccggcccccagggcccccccggcccccccggccccagcttcagacacgacaagctgaccttcatcgacatggagggcagcggcttcggcggcgacctggaggccctgagaggccccagaggcttccccggcccccccggcccccccggcgtgcccggcctgcccggcgagcccggcagattcggcgtgaacagcagcgacgtgcccggccccgccggcctgcccggcgtgcccggcagagagggcccccccggcttccccggcctgcccggcccccccggcccccccggcagagagggcccccccggcagaaccggccagaagggcagcctgcagggcgccggcgcccccggcgtgcagggcagcaagggcgcccccggccccgccggcgccagaggcgagagcggcctggccggcgcccccggccccgccggcccccccggcccccccggcccccccggcccccccggccccggcctgcccgccggcttcgacgacatggagggcagcggcggccccttctggagcaccgccagaagcgccgacggcccccagggcccccccggcctgcccggcctgaagggcgaccccggcgtgcccggcctgcccggcgccaagggcgaggtgggcgccgacggcgtgcccggcttccccggcctgcccggcagagagggcatcgccggcccccagggccccaagggcgacagaggcagcagaggcgagaagggcgaccccggcaaggacggcgtgggccagcccggcctgcccggcccccccggcccccccggccccgtggtgtacgtgagcgagcaggacggcagcgtgctgagcgtgcccggccccgagggcagacccggcttcgccggcttccccggccccgccggccccaagggcaacctgggcagcaagggcgagagaggcagccccggccccaagggcgagaagggcgagcccggcagcatcttcagccccgacggcggcgccctgggccccgcccagaagggcgccaagggcgagcccggcttcagaggcccccccggcccctacggcagacccggctacaagggcgagatcggcttccccggcagacccggcagacccggcatgaacggcctgaagggcgagaagggcgagcccggcgacgccagcctgggcttcggcatgagaggcatgcccggcccccccggcccccccggcccccccggcccccccggcacccccgtgtacgacagcaacgtgttcgccgagagcagcagacccggcccccccggcctgcccggcaaccagggcccccccggccccaagggcgccaagggcgaggtgggcccccccggcccccccggccagttccccttcgacttcctgcagctggaggccgagatgaagggcgagaagggcgacagaggcgacgccggccagaagggcgagagaggcgagcccggcggcggcggcttcttcggcagcagcctgcccggcccccccggcccccccggcccccccggccccagaggctaccccggcatccccggccccaagggcgagagcatcagaggccagcccggcccccccggcccccagggcccccccggcatcggctacgagggcagacagggcccccccggcccccccggcccccccggcccccccagcttccccggcccccacagacagaccatcagcgtgcccggcccccccggcccccccggcccccccggcccccccggcaccatgggcgccagcagcggcgtgagactgtgggccaccagacaggccatgctgggccaggtgcacgaggtgcccgagggctggctgatcttcgtggccgagcaggaggagctgtacgtgagagtgcagaacggcttcagaaaggtgcagctggaggccagaacccccctgcccagaggcaccgacaacgaggtggccgccctgcagccccccgtggtgcagctgcacgacagcaacccctaccccagaagagagcacccccaccccaccgccagaccctggagagccgacgacatcctggccagcccccccagactgcccgagccccagccctaccccggcgccccccaccacagcagctacgtgcacctgagacccgccagacccaccagcccccccgcccacagccacagagacttccagcccgtgctgcacctggtggccctgaacagccccctgagcggcggcatgagaggcatcagaggcgccgacttccagtgcttccagcaggccagagccgtgggcctggccggcaccttcagagccttcctgagcagcagactgcaggacctgtacagcatcgtgagaagagccgacagagccgccgtgcccatcgtgaacctgaaggacgagctgctgttccccagctgggaggccctgttcagcggcagcgagggccccctgaagcccggcgccagaatcttcagcttcgacggcaaggacgtgctgagacaccccacctggccccagaagagcgtgtggcacggcagcgaccccaacggcagaagactgaccgagagctactgcgagacctggagaaccgaggcccccagcgccaccggccaggccagcagcctgctgggcggcagactgctgggccagagcgccgccagctgccaccacgcctacatcgtgctgtgcatcgagaacagcttcatgaccgccagcaagtag

SEQ ID NO: 10155 - DNA, 1623 bp, Artificial Sequence
  Description of Artificial Sequence: Synthetic coding sequence
atgggccccggcgagagagccggcggcggcggcgacgccggcaagggcaacgccgccggcggcggcggcggcggcagaagcgccaccaccgccggcagcagagccgtgagcgccctgtgcctgctgctgagcgtgggcagcgccgccgcctgcctgctgctgggcgtgcaggccgccgccctgcagggcagagtggccgccctggaggaggagagagagctgctgagaagagccggcccccccggcgccctggacgcctgggccgagccccacctggagagactgctgagagagaagctggacggcctggccaagatcagaaccgccagagaggcccccagcgagtgcgtgtgcccccccggcccccccggcagaagaggcaagcccggcagaagaggcgaccccggcccccccggccagagcggcagagacggctaccccggccccctgggcctggacggcaagcccggcctgcccggccccaagggcgagaagggcgcccccggcgacttcggccccagaggcgaccagggccaggacggcgccgccggcccccccggcccccccggcccccccggcgccagaggcccccccggcgacaccggcaaggacggccccagaggcgcccagggccccgccggccccaagggcgagcccggccaggacggcgagatgggccccaagggcccccccggccccaagggcgagcccggcgtgcccggcaagaagggcgacgacggcacccccagccagcccggcccccccggccccaagggcgagcccggcagcatgggccccagaggcgagaacggcgtggacggcgcccccggccccaagggcgagcccggccacagaggcaccgacggcgccgccggccccagaggcgcccccggcctgaagggcgagcagggcgacaccgtggtgatcgactacgacggcagaatcctggacgccctgaagggcccccccggcccccagggcccccccggcccccccggcatccccggcgccaagggcgagctgggcctgcccggcgcccccggcatcgacggcgagaagggccccaagggccagaagggcgaccccggcgagcccggccccgccggcctgaagggcgaggccggcgagatgggcctgagcggcctgcccggcgccgacggcctgaagggcgagaagggcgagagcgccagcgacagcctgcaggagagcctggcccagctgatcgtggagcccggcccccccggcccccccggcccccccggccccatgggcctgcagggcatccagggccccaagggcctggacggcgccaagggcgagaagggcgccagcggcgagagaggccccagcggcctgcccggccccgtgggcccccccggcctgatcggcctgcccggcaccaagggcgagaagggcagacccggcgagcccggcctggacggcttccccggccccagaggcgagaagggcgacagaagcgagagaggcgagaagggcgagagaggcgtgcccggcagaaagggcgtgaagggccagaagggcgagcccggcccccccggcctggaccagccctgccccgtgggccccgacggcctgcccgtgcccggctgctggcacaagtag

SEQ ID NO: 10156 - DNA, 930 bp, Artificial Sequence
  Description of Artificial Sequence: Synthetic coding sequence
atggagagcagaagcggcatccaggccggcgtgagatgcagagacctgggcagcctgcagcccccccccctggccctgaagcagttcagcagcctgagcctgcccagcagctgggactacagaagactgccccccagatgcggcttcctgttcgaggtgagcgagaccaccaacccccccgccggcaccaacagcagacacaccctgaccgtgaagctggacggcctggccaagatcagaaccgccagagaggcccccagcgagtgcgtgtgcccccccggcccccccggcagaagaggcaagcccggcagaagaggcgaccccggcccccccggccccctgggcctggacggcaagcccggcctgcccggccccaagggcgagaagggcgcccccggcgacttcggccccagaggcgaccagggccaggacggcgccgccggcccccccggcccccccggcccccccggcgccagaggcccccccggcgacaccggcaaggacggccccagaggcgcccagggccccgccggccccaagggcgagcccggccaggacggcgagatgggccccaagggcccccccggccccaagggcgagcccggcgtgcccggcaagaagggcgacgacggcacccccagccagcccggcccccccggccccaagggcgagcccggcagcatgggccccagaggcgagaacggcgtggacggcgcccccggccccaagggcgagcccggccacagaggcaccgacggcgccgccggccccagaggcgacgtgagagaccccggcctgggcagcgtgagcagctgcagccagagactggccagcagcagcaagaagaacggcagcgagcccccccccggctgcgccggctgccccagaccccagggcagagccggcagacacagcggcgacagactgtag

SEQ ID NO: 10157 - DNA, 1665 bp, Artificial Sequence
  Description of Artificial Sequence: Synthetic coding sequence
atgaccgcccccggcgccgccggcagatgcccccccaccacctggctgggcagcctgctgctgctggtgtgcctgctggccagcagaagcatcaccgaggaggtgagcgagtactgcagccacatgatcggcagcggccacctgcagagcctgcagagactgatcgacagccagatggagaccagctgccagatcaccttcgagttcgtggaccaggagcagctgaaggaccccgtgtgctacctgaagaaggccttcctgctggtgcaggacatcatggaggacaccatgagattcagagacaacacccccaacgccatcgccatcgtgcagctgcaggagctgagcctgagactgaagagctgcttcaccaaggactacgaggagcacgacaaggcctgcgtgagaaccttctacgagacccccctgcagctgctggagaaggtgaagaacgtgttcaacgagaccaagaacctgctggacaaggactggaacatcttcagcaagaactgcaacaacagcttcgccgagtgcagcagccaggacgtggtgaccaagcccgactgcaactgcctgtaccccaaggccatccccagcagcgaccccgccagcgtgagcccccaccagcccctggcccccagcatggcccccgtggccggcctgacctgggaggacagcgagggcaccgagggcagcagcctgctgcccggcgagcagcccctgcacaccgtggaccccggcagcgccaagcagagaccccccagaagcacctgccagagcttcgagccccccgagacccccgtggtgaaggacagcaccatcggcggcagcccccagcccagacccagcgtgggcgccttcaaccccggcatggaggacatcctggacagcgccatgggcaccaactgggtgcccgaggaggccagcggcgaggccagcgagatccccgtgccccagggcaccgagctgagccccagcagacccggcggcggcagcatgcagaccgagcccgccagacccagcaacttcctgagcgccagcagccccctgcccgccagcgccaagggccagcagcccgccgacgtgaccggcaccgccctgcccagagtgggccccgtgagacccaccggccaggactggaaccacaccccccagaagaccgaccaccccagcgccctgctgagagacccccccgagcccggcagccccagaatcagcagcctgagaccccagggcctgagcaaccccagcaccctgagcgcccagccccagctgagcagaagccacagcagcggcagcgtgctgcccctgggcgagctggagggcagaagaagcaccagagacagaagaagccccgccgagcccgagggcggccccgccagcgagggcgccgccagacccctgcccagattcaacagcgtgcccctgaccgacaccggccacgagagacagagcgagggcagcttcagcccccagctgcaggagagcgtgttccacctgctggtgcccagcgtgatcctggtgctgctggccgtgggcggcctgctgttctacagatggagaagaagaagccaccaggagccccagagagccgacagccccctggagcagcccgagggcagccccctgacccaggacgacagacaggtggagctgcccgtgtag

SEQ ID NO: 10158 - DNA, 1317 bp, Artificial Sequence
  Description of Artificial Sequence: Synthetic coding sequence
atgaccgcccccggcgccgccggcagatgcccccccaccacctggctgggcagcctgctgctgctggtgtgcctgctggccagcagaagcatcaccgaggaggtgagcgagtactgcagccacatgatcggcagcggccacctgcagagcctgcagagactgatcgacagccagatggagaccagctgccagatcaccttcgagttcgtggaccaggagcagctgaaggaccccgtgtgctacctgaagaaggccttcctgctggtgcaggacatcatggaggacaccatgagattcagagacaacacccccaacgccatcgccatcgtgcagctgcaggagctgagcctgagactgaagagctgcttcaccaaggactacgaggagcacgacaaggcctgcgtgagaaccttctacgagacccccctgcagctgctggagaaggtgaagaacgtgttcaacgagaccaagaacctgctggacaaggactggaacatcttcagcaagaactgcaacaacagcttcgccgagtgcagcagccaggacgtggtgaccaagcccgactgcaactgcctgtaccccaaggccatccccagcagcgaccccgccagcgtgagcccccaccagcccctggcccccagcatggcccccgtggccggcctgacctgggaggacagcgagggcaccgagggcagcagcctgctgcccggcgagcagcccctgcacaccgtggaccccggcagcgccaagcagagaccccccagaagcacctgccagagcttcgagccccccgagacccccgtggtgaaggacagcaccatcggcggcagcccccagcccagacccagcgtgggcgccttcaaccccggcatggaggacatcctggacagcgccatgggcaccaactgggtgcccgaggaggccagcggcgaggccagcgagatccccgtgccccagggcaccgagctgagccccagcagacccggcggcggcagcatgcagaccgagcccgccagacccagcaacttcctgagcgccagcagccccctgcccgccagcgccaagggccagcagcccgccgacgtgaccggccacgagagacagagcgagggcagcttcagcccccagctgcaggagagcgtgttccacctgctggtgcccagcgtgatcctggtgctgctggccgtgggcggcctgctgttctacagatggagaagaagaagccaccaggagccccagagagccgacagccccctggagcagcccgagggcagccccctgacccaggacgacagacaggtggagctgcccgtgtag

SEQ ID NO: 10159 - DNA, 360 bp, Artificial Sequence
  Description of Artificial Sequence: Synthetic coding sequence
atgaccgcccccggcgccgccggcagatgcccccccaccacctggctgggcagcctgctgctgctggtgtgcctgctggccagcagaagcatcaccgaggaggtgagcgagtactgcagccacatgatcggcagcggccacctgcagagcctgcagagactgatcgacagccagatggagaccagctgccagatcaccttcgagttcgtggaccaggagcagctgaaggaccccgtgtgctacctgaagaaggccttcctgctggtgcaggacatcatggaggacaccatgagattcagagacaacacccccaacgccatcgccatcgtgcagctgcaggagctgagcctgagactgtag

SEQ ID NO: 10160 - DNA, 1317 bp, Artificial Sequence; identical to SEQ ID NO: 10158
  Description of Artificial Sequence: Synthetic coding sequence

SEQ ID NO: 10161 - DNA, 1665 bp, Artificial Sequence; identical to SEQ ID NO: 10157
  Description of Artificial Sequence: Synthetic coding sequence

SEQ ID NO: 10162 - DNA, 771 bp, Artificial Sequence
  Description of Artificial Sequence: Synthetic coding sequence
atgaccgcccccggcgccgccggcagatgcccccccaccacctggctgggcagcctgctgctgctggtgtgcctgctggccagcagaagcatcaccgaggaggtgagcgagtactgcagccacatgatcggcagcggccacctgcagagcctgcagagactgatcgacagccagatggagaccagctgccagatcaccttcgagttcgtggaccaggagcagctgaaggaccccgtgtgctacctgaagaaggccttcctgctggtgcaggacatcatggaggacaccatgagattcagagacaacacccccaacgccatcgccatcgtgcagctgcaggagctgagcctgagactgaagagctgcttcaccaaggactacgaggagcacgacaaggcctgcgtgagaaccttctacgagacccccctgcagctgctggagaaggtgaagaacgtgttcaacgagaccaagaacctgctggacaaggactggaacatcttcagcaagaactgcaacaacagcttcgccgagtgcagcagccagggccacgagagacagagcgagggcagcttcagcccccagctgcaggagagcgtgttccacctgctggtgcccagcgtgatcctggtgctgctggccgtgggcggcctgctgttctacagatggagaagaagaagccaccaggagccccagagagccgacagccccctggagcagcccgagggcagccccctgacccaggacgacagacaggtggagctgcccgtgtag

SEQ ID NO: 10163 - DNA, 828 bp, Artificial Sequence
  Description of Artificial Sequence: Synthetic coding sequence
ggcagccccggcatggccggcgccctgtgcgccggccacatcgccggcctgtacggcgacagaggcctggtgcccagcaccagaagagaggagagaggcggcagaaagacctggcagaccggcgccgccagaccccagggcggcgccagaggcgccggcggcccctggcaccccgacagacaccccagacccaaggagaccagaggcaacctgggccccctggagacccccgccagatgggccacccagggccccgccgcccccagcgagcccatccccggcatcaagggcaccaagggcagccccggcaacatcaaggaccagcccagacccgccttcagcgccatcagaagaaaccccaacggcggccagagaggccacagcaccagaagcagccccaccagaaagaacagaaccagaaccacccccgccgacagcagcgccctgtaccccgccaccaccaccagccccagcagatgctgccccagcggcaagagcgcctgccccagcagccccccccagggcgccagaagcgacgccccctgggccagcgtgaccccccccaccagaggcagcagcagatggtgccagggcgcctggtgcttcagctgcagcagagtgaccagaagcggcctgaagaagacccccaagagagtgaccttcaccagagccctgagacccaccgccagcagcgccgccagcagcagcagccacctgcccgagcccggcaaggaccccctgccccacccccccctgtggctgccctgcagcgcctgcaagatgggcgccctgctgctgcagctgctgaagggcggcggctggctgtag

SEQ ID NO: 10164 - DNA, 738 bp, Artificial Sequence
  Description of Artificial Sequence: Synthetic coding sequence
atggagggccccagaggctggctggtgctgtgcgtgctggccatcagcctggccagcatggtgaccgaggacctgtgcagagcccccgacggcaagaagggcgaggccggcagacccggcagaagaggcagacccggcctgaagggcgagcagggcgagcccggcgcccccggcatcagaaccggcatccagggcctgaagggcgaccagggcgagcccggccccagcggcaaccccggcaaggtgggctaccccggccccagcggccccctgggcgccagaggcatccccggcatcaagggcaccaagggcagccccggcaacatcaaggaccagcccagacccgccttcagcgccatcagaagaaacccccccatgggcggcaacgtggtgatcttcgacaccgtgatcaccaaccaggaggagccctaccagaaccacagcggcagattcgtgtgcaccgtgcccggctactactacttcaccttccaggtgctgagccagtgggagatctgcctgagcatcgtgagcagcagcagaggccaggtgagaagaagcctgggcttctgcgacaccaccaacaagggcctgttccaggtggtgagcggcggcatggtgctgcagctgcagcagggcgaccaggtgtgggtggagaaggaccccaagaagggccacatctaccagggcagcgaggccgacagcgtgttcagcggcttcctgatcttccccagcgcctag

SEQ ID NO: 10165 - DNA, 738 bp, Artificial Sequence; identical to SEQ ID NO: 10164
  Description of Artificial Sequence: Synthetic coding sequence

SEQ ID NO: 10166 - DNA, 666 bp, Artificial Sequence
  Description of Artificial Sequence: Synthetic coding sequence
atggagggccccagaggctggctggtgctgtgcgtgctggccatcagcctggccagcatggtgaccgaggacctgtgcagagcccccgacggcaagaagggcgaggccggcagacccggcagaagaggcagacccggcctgaagggcgagcagggcgagcccggcgcccccggcatcagaaccggcatccagggcctgaagggcgaccagggcgagcccggccccagcggcaaccccggcaaggtgggctaccccggccccagcggccccctgggcgccagaggcatccccggcatcaagggcaccaagggcagccccggcaacatcaaggaccagcccagacccgccttcagcgccatcagaagaaacccccccatgggcggcaacgtggtgatcttcgacaccgtgatcaccaaccaggaggagccctaccagaaccacagcggcagattcgtgtgcaccgtgcccggctactactacttcaccttccaggtgctgagccagtgggagatctgcctgagcatcgtgagcagcagcagaggccaggtgagaagaagcctgggcttctgcgacaccaccaacaagggcctgttccaggtggtgagcggcggcatggtgctgcagctgcagcagggcgaccaggtgtgggtggagaaggacccctag

SEQ ID NO: 10167 - DNA, 1050 bp, Artificial Sequence
  Description of Artificial Sequence: Synthetic coding sequence
atgaccgccgccagcatgggccccgtgagagtggccttcgtggtgctgctggccctgtgcagcagacccgccgtgggccagaactgcagcggcccctgcagatgccccgacgagcccgcccccagatgccccgccggcgtgagcctggtgctggacggctgcggctgctgcagagtgtgcgccaagcagctgggcgagctgtgcaccgagagagacccctgcgacccccacaagggcctgttctgccacttcggcagccccgccaacagaaagatcggcgtgtgcaccgccaaggacggcgccccctgcatcttcggcggcaccgtgtacagaagcggcgagagcttccagagcagctgcaagtaccagtgcacctgcctggacggcgccgtgggctgcatgcccctgtgcagcatggacgtgagactgcccagccccgactgccccttccccagaagagtgaagctgcccggcaagtgctgcgaggagtgggtgtgcgacgagcccaaggaccagaccgtggtgggccccgccctggccgcctacagactggaggacaccttcggccccgaccccaccatgatcagagccaactgcctggtgcagaccaccgagtggagcgcctgcagcaagacctgcggcatgggcatcagcaccagagtgaccaacgacaacgccagctgcagactggagaagcagagcagactgtgcatggtgagaccctgcgaggccgacctggaggagaacatcaagaagggcaagaagtgcatcagaacccccaagatcagcaagcccatcaagttcgagctgagcggctgcaccagcatgaagacctacagagccaagttctgcggcgtgtgcaccgacggcagatgctgcaccccccacagaaccaccaccctgcccgtggagttcaagtgccccgacggcgaggtgatgaagaagaacatgatgttcatcaagacctgcgcctgccactacaactgccccggcgacaacgacatcttcgagagcctgtactacagaaagatgtacggcgacatggcctag

SEQ ID NO: 10168 - DNA, 2238 bp, Artificial Sequence
  Description of Artificial Sequence: Synthetic coding sequence
atggagagaccccccggcctgagacccggcgccggcggcccctgggagatgagagagagactgggcaccggcggcttcggcaacgtgtgcctgtaccagcacagagagctggacctgaagatcgccatcaagagctgcagactggagctgagcaccaagaacagagagagatggtgccacgagatccagatcatgaagaagctgaaccacgccaacgtggtgaaggcctgcgacgtgcccgaggagctgaacatcctgatccacgacgtgcccctgctggccatggagtactgcagcggcggcgacctgagaaagctgctgaacaagcccgagaactgctgcggcctgaaggagagccagatcctgagcctgctgagcgacatcggcagcggcatcagatacctgcacgagaacaagatcatccacagagacctgaagcccgagaacatcgtgctgcaggacgtgggcggcaagatcatccacaagatcatcgacctgggctacgccaaggacgtggaccagggcagcctgtgcaccagcttcgtgggcaccctgcagtacctggcccccgagctgttcgagaacaagccctacaccgccaccgtggactactggagcttcggcaccatggtgttcgagtgcatcgccggctacagacccttcctgcaccacctgcagcccttcacctggcacgagaagatcaagaagaaggaccccaagtgcatcttcgcctgcgaggagatgagcggcgaggtgagattcagcagccacctgccccagcccaacagcctgtgcagcctggtggtggagcccatggagaactggctgcagctgatgctgaactgggacccccagcagagaggcggccccgtggacctgaccctgaagcagcccagatgcttcgtgctgatggaccacatcctgaacctgaagatcgtgcacatcctgaacatgaccagcgccaagatcatcagcttcctgctgccccccgacgagagcctgcacagcctgcagagcagaatcgagagagagaccggcatcaacaccggcagccaggagctgctgagcgagaccggcatcagcctggaccccagaaagcccgccagccagtgcgtgctggacggcgtgagaggctgcgacagctacatggtgtacctgttcgacaagagcaagaccgtgtacgagggccccttcgccagcagaagcctgagcgactgcgtgaactacatcgtgcaggacagcaagatccagctgcccatcatccagctgagaaaggtgtgggccgaggccgtgcactacgtgagcggcctgaaggaggactacagcagactgttccagggccagagagccgccatgctgagcctgctgagatacaacgccaacctgaccaagatgaagaacaccctgatcagcgccagccagcagctgaaggccaagctggagttcttccacaagagcatccagctggacctggagagatacagcgagcagatgacctacggcatcagcagcgagaagatgctgaaggcctggaaggagatggaggagaaggccatccactacgccgaggtgggcgtgatcggctacctggaggaccagatcatgagcctgcacgccgagatcatggagctgcagaagagcccctacggcagaagacagggcgacctgatggagagcctggagcagagagccatcgacctgtacaagcagctgaagcacagacccagcgaccacagctacagcgacagcaccgagatggtgaagatcatcgtgcacaccgtgcagagccaggacagagtgctgaaggagctgttcggccacctgagcaagctgctgggctgcaagcagaagatcatcgacctgctgcccaaggtggaggtggccctgagcaacatcaaggaggccgacaacaccgtgatgttcatgcagggcaagagacagaaggagatctggcacctgctgaagatcgcctgcacccagagcagcgccagaagcctggtgggcagcagcctggagggcgccgtgaccccccagaccagcgcctggctgccccccaccagcgccgagcacgaccacagcctgagctgcgtggtgaccccccaggacggcgagaccagcgcccagatgatcgaggagaacctgaactgcctgggccacctgagcaccatcatccacgaggccaacgaggagcagggcaacagcatgatgaacctggactggagctggctgaccgagtag

SEQ ID NO: 10169 - DNA, 1653 bp, Artificial Sequence
  Description of Artificial Sequence: Synthetic coding sequence
atgtggaaggccagcgccggccacgccgtgagcatcgcccaggacgacgccggcgccgacgactgggagaccgaccccgacttcgtgaacgacgtgagcgagaaggagcagagatggggcgccaagaccgtgcagggcagcggccaccaggagcacatcaacatccacaagctgagagagaacgtgttccaggagcaccagaccctgaaggagaaggagctggagaccggccccaaggccagccacggctacggcggcaagttcggcgtggagcaggacagaatggacaagagcgccgtgggccacgagtaccagagcaagctgagcaagcactgcagccaggtggacagcgtgagaggcttcggcggcaagttcggcgtgcagatggacagagtggaccagagcgccgtgggcttcgagtaccagggcaagaccgagaagcacgccagccagaaggactacagcagcggcttcggcggcaagtacggcgtgcaggccgacagagtggacaagagcgccgtgggcttcgactaccagggcaagaccgagaagcacgagagccagagagactacagcaagggcttcggcggcaagtacggcatcgacaaggacaaggtggacaagagcgccgtgggcttcgagtaccagggcaagaccgagaagcacgagagccagaaggactacgtgaagggcttcggcggcaagttcggcgtgcagaccgacagacaggacaagtgcgccctgggctgggaccaccaggagaagctgcagctgcacgagagccagaaggactacaagaccggcttcggcggcaagttcggcgtgcagagcgagagacaggacagcgccgccgtgggcttcgactacaaggagaagctggccaagcacgagagccagcaggactacagcaagggcttcggcggcaagtacggcgtgcagaaggacagaatggacaagaacgccagcaccttcgaggacgtgacccaggtgagcagcgcctaccagaagaccgtgcccgtggaggccgtgaccagcaagaccagcaacatcagagccaacttcgagaacctggccaaggagaaggagcaggaggacagaagaaaggccgaggccgagagagcccagagaatggccaaggagagacaggagcaggaggaggccagaagaaagctggaggagcaggccagagccaagacccagaccccccccgtgagccccgccccccagcccaccgaggagagactgcccagcagccccgtgtacgaggacgccgccagcttcaaggccgagctgagctacagaggccccgtgagcggcaccgagcccgagcccgtgtacagcatggaggccgccgactacagagaggccagcagccagcagggcctggcctacgccaccgaggccgtgtacgagagcgccgaggcccccggccactaccccgccgaggacagcacctacgacgagtacgagaacgacctgggcatcaccgccgtggccctgtacgactaccaggccgccggcgacgacgagatcagcttcgaccccgacgacatcatcaccaacatcgagatgatcgacgacggctggtggagaggcgtgtgcaagggcagatacggcctgttccccgccaactacgtggagctgagacagtag

SEQ ID NO: 10170 - DNA, 1542 bp, Artificial Sequence
  Description of Artificial Sequence: Synthetic coding sequence
atgtggaaggccagcgccggccacgccgtgagcatcgcccaggacgacgccggcgccgacgactgggagaccgaccccgacttcgtgaacgacgtgagcgagaaggagcagagatggggcgccaagaccgtgcagggcagcggccaccaggagcacatcaacatccacaagctgagagagaacgtgttccaggagcaccagaccctgaaggagaaggagctggagaccggccccaaggccagccacggctacggcggcaagttcggcgtggagcaggacagaatggacaagagcgccgtgggccacgagtaccagagcaagctgagcaagcactgcagccaggtggacagcgtgagaggcttcggcggcaagttcggcgtgcagatggacagagtggaccagagcgccgtgggcttcgagtaccagggcaagaccgagaagcacgccagccagaaggactacagcagcggcttcggcggcaagtacggcgtgcaggccgacagagtggacaagagcgccgtgggcttcgactaccagggcaagaccgagaagcacgagagccagagagactacagcaagggcttcggcggcaagtacggcatcgacaaggacaaggtggacaagagcgccgtgggcttcgagtaccagggcaagaccgagaagcacgagagccagaaggactacgtgaagggcttcggcggcaagttcggcgtgcagaccgacagacaggacaagtgcgccctgggctgggaccaccaggagaagctgcagctgcacgagagccagaaggactacagcaagggcttcggcggcaagtacggcgtgcagaaggacagaatggacaagaacgccagcaccttcgaggacgtgacccaggtgagcagcgcctaccagaagaccgtgcccgtggaggccgtgaccagcaagaccagcaacatcagagccaacttcgagaacctggccaaggagaaggagcaggaggacagaagaaaggccgaggccgagagagcccagagaatggccaaggagagacaggagcaggaggaggccagaagaaagctggaggagcaggccagagccaagacccagaccccccccgtgagccccgccccccagcccaccgaggagagactgcccagcagccccgtgtacgaggacgccgccagcttcaaggccgagctgagctacagaggccccgtgagcggcaccgagcccgagcccgtgtacagcatggaggccgccgactacagagaggccagcagccagcagggcctggcctacgccaccgaggccgtgtacgagagcgccgaggcccccggccactaccccgccgaggacagcacctacgacgagtacgagaacgacctgggcatcaccgccgtggccctgtacgactaccaggccgccggcgacgacgagatcagcttcgaccccgacgacatcatcaccaacatcgagatgatcgacgacggctggtggagaggcgtgtgcaagggcagatacggcctgttccccgccaactacgtggagctgagacagtag

SEQ ID NO: 10171 - DNA, 1905 bp, Artificial Sequence
  Description of Artificial Sequence: Synthetic coding sequence
atgtggaaggccagcgccggccacgccgtgagcatcgcccaggacgacgccggcgccgacgactgggagaccgaccccgacttcgtgaacgacgtgagcgagaaggagcagagatggggcgccaagaccgtgcagggcagcggccaccaggagcacatcaacatccacaagctgagagagaacgtgttccaggagcaccagaccctgaaggagaaggagctggagaccggccccaaggccagccacggctacggcggcaagttcggcgtggagcaggacagaatggacaagagcgccgtgggccacgagtaccagagcaagctgagcaagcactgcagccaggtggacagcgtgagaggcttcggcggcaagttcggcgtgcagatggacagagtggaccagagcgccgtgggcttcgagtaccagggcaagaccgagaagcacgccagccagaaggactacagcagcggcttcggcggcaagtacggcgtgcaggccgacagagtggacaagagcgccgtgggcttcgactaccagggcaagaccgagaagcacgagagccagagagactacagcaagggcttcggcggcaagtacggcatcgacaaggacaaggtggacaagagcgccgtgggcttcgagtaccagggcaagaccgagaagcacgagagccagaaggactacgtgaagggcttcggcggcaagttcggcgtgcagaccgacagacaggacaagtgcgccctgggctgggaccaccaggagaagctgcagctgcacgagagccagaaggactacagcaagggcttcggcggcaagtacggcgtgcagaaggacagaatggacaagaacgccagcaccttcgaggacgtgacccaggtgagcagcgcctaccagaagaccgtgcccgtggaggccgtgaccagcaagaccagcaacatcagagccaacttcgagaacctggccaaggagaaggagcaggaggacagaagaaaggccgaggccgagagagcccagagaatggccaaggagagacaggagcaggaggaggccagaagaaagctggaggagcaggccagagccaagacccagaccccccccgtgagccccgccccccagcccaccgaggagagactgcccagcagccccgtgtacgaggacgccgccagcttcaaggccgagctgagctacagaggccccgtgagcggcaccgagcccgagcccgtgtacagcatggaggccgccgactacagagaggccagcagccagcagggcctggcctacgccaccgaggccgtgtacgagagcgccgaggcccccggccactaccccgccgaggacagcacctacgacgagtacgagaacgacctgggcatcaccgccgtggccctgtacgactaccaggccgccggcgacgacgagatcagcttcgaccccgacgacatcatcaccaacatcgagatgatcgacgacggctggtggagaggcgtgtgcaagggcagattcagagagctggccttcagctgcgtgagagtggccctggtgcccatcaagtgcagcagagacctgcccggccaggccagaggcctgagaagcgccctgtggagagtgggcagaaaggactgccccagaagaggcgccagcagcagagtgagcctgctgggcagaagaggcctgggcctgatggaggtgaaccccgagctgagccaccccgagcacagaagctgccacgtgagatgggagatctgcctgtgccacaccgtgaccgccagaagaatcagaaagctgatcagcttcctgagaagcagagaggccggccccgtgcccagctgcagccaggtgggcggcgtgagcttccagaaggtgacctggaagtgcctgggcacctgggtgcccgagtgcccctag

SEQ ID NO: 10172 - DNA, 945 bp, Artificial Sequence
  Description of Artificial Sequence: Synthetic coding sequence
atggacaagaacgccagcaccttcgaggacgtgacccaggtgagcagcgcctaccagaagaccgtgcccgtggaggccgtgaccagcaagaccagcaacatcagagccaacttcgagaacctggccaaggagaaggagcaggaggacagaagaaaggccgaggccgagagagcccagagaatggccaaggagagacaggagcaggaggaggccagaagaaagctggaggagcaggccagagccaagacccagaccccccccgtgagccccgccccccagcccaccgaggagagactgcccagcagccccgtgtacgaggacgccgccagcttcaaggccgagctgagctacagaggccccgtgagcggcaccgagcccgagcccgtgtacagcatggaggccgccgactacagagaggccagcagccagcagggcctggcctacgccaccgaggccgtgtacgagagcgccgaggcccccggccactaccccgccgaggacagcacctacgacgagtacgagaacgacctgggcatcaccgccgtggccctgtacgactaccaggccgccggcgacgacgagatcagcttcgaccccgacgacatcatcaccaacatcgagatgatcgacgacggctggtggagaggcgtgtgcaagggcagattcagagagctggccttcagctgcgtgagagtggccctggtgcccatcaagtgcagcagagacctgcccggccaggccagaggcctgagaagcgccctgtggagagtgggcagaaaggactgccccagaagaggcgccagcagcagagtgagcctgctgggcagaagaggcctgggcctgatggaggtgaaccccgagctgagccaccccgagcacagaagctgccacgtgagatgggagatctgcctgtgccacaccgtgaccgccagaagaatcagatag

SEQ ID NO: 10173 - DNA, 1761 bp, Artificial Sequence
  Description of Artificial Sequence: Synthetic coding sequence
atgggcgtgaacgccgtgcactggttcagaaagggcctgagactgcacgacaaccccgccctgaaggagtgcatccagggcgccgacaccatcagatgcgtgtacatcctggacccctggttcgccggcagcagcaacgtgggcatcaacagatggagattcctgctgcagtgcctggaggacctggacgccaacctgagaaagctgaacagcagactgttcgtgatcagaggccagcccgccgacgtgttccccagactgttcaaggagtggaacatcaccaagctgagcatcgagtacgacagcgagcccttcggcaaggagagagacgccgccatcaagaagctggccaccgaggccggcgtggaggtgatcgtgagaatcagccacaccctgtacgacctggacaagatcatcgagctgaacggcggccagccccccctgacctacaagagattccagaccctgatcagcaagatggagcccctggagatccccgtggagaccatcaccagcgaggtgatcgagaagtgcaccacccccctgagcgacgaccacgacgagaagtacggcgtgcccagcctggaggagctgggcttcgacaccgacggcctgagcagcgccgtgtggcccggcggcgagaccgaggccctgaccagactggagagacacctggagagaaaggcctgggtggccaacttcgagagacccagaatgaacgccaacagcctgctggccagccccaccggcctgagcccctacctgagattcggctgcctgagctgcagactgttctacttcaagctgaccgacctgtacaagaaggtgaagaagaacagcagcccccccctgagcctgtacggccagctgctgtggagagagttcttctacaccgccgccaccaacaaccccagattcgacaagatggagggcaaccccatctgcgtgcagatcccctgggacaagaaccccgaggccctggccaagtgggccgagggcagaaccggcttcccctggatcgacgccatcatgacccagctgagacaggagggctggatccaccacctggccagacacgccgtggcctgcttcctgaccagaggcgacctgtggatcagctgggaggagggcatgaaggtgttcgaggagctgctgctggacgccgactggagcatcaacgccggcagctggatgtggctgagctgcagcagcttcttccagcagttcttccactgctactgccccgtgggcttcggcagaagaaccgaccccaacggcgactacatcagaagatacctgcccgtgctgagaggcttccccgccaagtacatctacgacccctggaacgcccccgagggcatccagaaggtggccaagtgcctgatcggcgtgaactaccccaagcccatggtgaaccacgccgaggccagcagactgaacatcgagagaatgaagcagatctaccagcagctgagcagatacagaggcctgggcctgctggccagcgtgcccagcaaccccaacggcaacggcggcttcatgggctacagcgccgagaacatccccggctgcagcagcagcggcagctgcagccagggcagcggcatcctgcactacgcccacggcgacagccagcagacccacctgctgaagcagggcagaagcagcatgggcaccggcctgagcggcggcaagagacccagccaggaggaggacacccagagcatcggccccaaggtgcagagacagagcaccaactag

SEQ ID NO: 10174 - DNA, 582 bp, Artificial Sequence
  Description of Artificial Sequence: Synthetic coding sequence
atgctggaggtgggctgcggctgcctggtggtgcccttcttcaacttcttccactgctactgccccgtgggcttcggcagaagaaccgaccccaacggcgactacatcagaagatacctgcccgtgctgagaggcttccccgccaagtacatctacgacccctggaacgcccccgagggcatccagaaggtggccaagtgcctgatcggcgtgaactaccccaagcccatggtgaaccacgccgaggccagcagactgaacatcgagagaatgaagcagatctaccagcagctgagcagatacagaggcctgggcctgctggccagcgtgcccagcaaccccaacggcaacggcggcttcatgggctacagcgccgagaacatccccggctgcagcagcagcggcagctgcagccagggcagcggcatcctgcactacgcccacggcgacagccagcagacccacctgctgaagcagggcagaagcagcatgggcaccggcctgagcggcggcaagagacccagccaggaggaggacacccagagcatcggccccaaggtgcagagacagagcaccaactag

SEQ ID NO: 10175 - DNA, 1323 bp, Artificial Sequence
  Description of Artificial Sequence: Synthetic coding sequence
atgggcagcagccacctgctgaacaagggcctgcccctgggcgtgagaccccccatcatgaacggccccctgcaccccagacccctggtggccctgctggacggcagagactgcaccgtggagatgcccatcctgaaggacgtggccaccgtggccttctgcgacgcccagagcacccaggagatccacgagaaggtgctgaacgaggccgtgggcgccctgatgtaccacaccatcaccctgaccagagaggacctggagaagttcaaggccctgagaatcatcgtgagaatcggcagcggcttcgacaacatcgacatcaagagcgccggcgacctgggcatcgccgtgtgcaacgtgcccgccgccagcgtggaggagaccgccgacagcaccctgtgccacatcctgaacctgtacagaagagccacctggctgcaccaggccctgagagagggcaccagagtgcagagcgtggagcagatcagagaggtggccagcggcgccgccagaatcagaggcgagaccctgggcatcatcggcctgggcagagtgggccaggccgtggccctgagagccaaggccttcggcttcaacgtgctgttctacgacccctacctgagcgacggcgtggagagagccctgggcctgcagagagtgagcaccctgcaggacctgctgttccacagcgactgcgtgaccctgcactgcggcctgaacgagcacaaccaccacctgatcaacgacttcaccgtgaagcagatgagacagggcgccttcctggtgaacaccgccagaggcggcctggtggacgagaaggccctggcccaggccctgaaggagggcagaatcagaggcgccgccctggacgtgcacgagagcgagcccttcagcttcagccagggccccctgaaggacgcccccaacctgatctgcaccccccacgccgcctggtacagcgagcaggccagcatcgagatgagagaggaggccgccagagagatcagaagagccatcaccggcagaatccccgacagcctgaagaactgcgtgaacaaggaccacctgaccgccgccacccactgggccagcatggaccccgccgtggtgcaccccgagctgaacggcgccgcctacagatacccccccggcgtggtgggcgtggcccccaccggcatccccgccgccgtggagggcatcgtgcccagcgccatgagcctgagccacggcctgccccccgtggcccaccccccccacgcccccagccccggccagaccgtgaagcccgaggccgacagagaccacgccagcgaccagctgtag

SEQ ID NO: 10176 - DNA, 1290 bp, Artificial Sequence
  Description of Artificial Sequence: Synthetic coding sequence
atgagcggcgtgagaccccccatcatgaacggccccctgcaccccagacccctggtggccctgctggacggcagagactgcaccgtggagatgcccatcctgaaggacgtggccaccgtggccttctgcgacgcccagagcacccaggagatccacgagaaggtgctgaacgaggccgtgggcgccctgatgtaccacaccatcaccctgaccagagaggacctggagaagttcaaggccctgagaatcatcgtgagaatcggcagcggcttcgacaacatcgacatcaagagcgccggcgacctgggcatcgccgtgtgcaacgtgcccgccgccagcgtggaggagaccgccgacagcaccctgtgccacatcctgaacctgtacagaagagccacctggctgcaccaggccctgagagagggcaccagagtgcagagcgtggagcagatcagagaggtggccagcggcgccgccagaatcagaggcgagaccctgggcatcatcggcctgggcagagtgggccaggccgtggccctgagagccaaggccttcggcttcaacgtgctgttctacgacccctacctgagcgacggcgtggagagagccctgggcctgcagagagtgagcaccctgcaggacctgctgttccacagcgactgcgtgaccctgcactgcggcctgaacgagcacaaccaccacctgatcaacgacttcaccgtgaagcagatgagacagggcgccttcctggtgaacaccgccagaggcggcctggtggacgagaaggccctggcccaggccctgaaggagggcagaatcagaggcgccgccctggacgtgcacgagagcgagcccttcagcttcagccagggccccctgaaggacgcccccaacctgatctgcaccccccacgccgcctggtacagcgagcaggccagcatcgagatgagagaggaggccgccagagagatcagaagagccatcaccggcagaatccccgacagcctgaagaactgcgtgaacaaggaccacctgaccgccgccacccactgggccagcatggaccccgccgtggtgcaccccgagctgaacggcgccgcctacagatacccccccggcgtggtgggcgtggcccccaccggcatccccgccgccgtggagggcatcgtgcccagcgccatgagcctgagccacggcctgccccccgtggcccaccccccccacgcccccagccccggccagaccgtgaagcccgaggccgacagagaccacgccagcgaccagctgtag

SEQ ID NO: 10177 - DNA, 438 bp, Artificial Sequence
  Description of Artificial Sequence: Synthetic coding sequence
atgagcggcgtgagaccccccatcatgaacggccccctgcaccccagacccctggtggccctgctggacggcagagactgcaccgtggagatgcccatcctgaaggacgtggccaccgtggccttctgcgacgcccagagcacccaggagatccacgagaaggtgctgaacgaggccgtgggcgccctgatgtaccacaccatcaccctgaccagagaggacctggagaagttcaaggccctgagaatcatcgtgagaatcggcagcggcttcgacaacatcgacatcaagagcgccggcgacctgggcatcgccgtgtgcaacgtgcccgccgccagcgtggaggagaccgccgacagcaccctgtgccacatcctgaacctgtacagaagagccacctggctgcaccaggccctgagagagggcaccagagtgtag

SEQ ID NO: 10178 - DNA, 516 bp, Artificial Sequence
  Description of Artificial Sequence: Synthetic coding sequence
atgagcggcgtgagaccccccatcatgaacggccccctgcaccccagacccctggtggccctgctggacggcagagactgcaccgtggagatgcccatcctgaaggacgtggccaccgtggccttctgcgacgcccagagcacccaggagatccacgagaaggtgctgaacgaggccgtgggcgccctgatgtaccacaccatcaccctgaccagagaggacctggagaagttcaaggccctgagaatcatcgtgagaatcggcagcggcttcgacaacatcgacatcaagagcgccggcgacctgggcatcgccgtgtgcaacgtgcccgccgccagcgtggaggagaccgccgacagcaccctgtgccacatcctgaacctgtacagaagagccacctggctgcaccaggccctgagagagggcaccagagtgcagagcgtggagcagatcagagaggtggccagcggcgccgccagaatcagaggcgagaccctgggcatcatcggcctgtag

SEQ ID NO: 10179 - DNA, 2958 bp, Artificial Sequence
  Description of Artificial Sequence: Synthetic coding sequence
atgcccgtgcccagcagacacatcaacatcggcagaagccagagctgggacgccgccggctggtacgagggcccctgggagaacgccgagagcctgagacccctgggcagaagaagcagcctgacctacggcaccgccgagggcacctggttcgagcccaaccacagaccccaggacgccgccctgcccgtggccgccgagccctacctgtacagagaggccgtgtacaacagcgtggccgccagaaagggcagcacccccgacttcaccttctacgacagcagacaggccgtgatgagcggcagaagccccctgctgcccagagagtactacagcgaccccagcggcgccgccagagtgcccaaggagccccccctgtacagagaccccggcgtgagcagacccgtgcccagctacggcgtgctgggcagcagaaccagctgggaccccatgcagggcagaagccccgccctgcaggacgccggccacctgtacagagaccccggcggcaagatgatcccccagggcagacagacccagagcagagccgccagccccggcagatacggcagagagcagcccgacaccagatacggcgccgaggtgcccgcctaccccctgagccaggtgttcagcgacatcagcgagagacccatcgaccccgcccccgccagacaggtggcccccacctgcctggtggtggaccccagcagcgccgccgcccccgagggcagcaccggcgtggcccccggcgccctgaacagaggctacggccccgccagagagagcatccccagcaagatggcctacgagacctacgaggccgacctgagcaccttccagggccccggcggcaagagaaccgtgctgcccgagttcctggccttcctgagagccgagggcctggccgaggccaccctgggcgccctgctgcagcagggcttcgacagccccgccgtgctggccaccctggaggacgccgacatcaagagcgtggcccccaacctgggccaggccagagtgctgagcagactggccaacagctgcagaaccgagatgcagctgagaagacaggacagaggcggccccctgcccagagccagaagcagcagcttcagccacagaagcgagctgctgcacggcgacctggccagcctgggcgccgccgcccccctgcagaccgccagccccagagccggcgaccccgccagaagacccagcagcgcccccagccagcacctgctggagaccgccgccacctacagcgcccccggcgtgggcacccacgccccccacttccccagcaacagcggctacagcagccccaccccctgcgccctgaccgccagactgagccccacctaccccctgcaggccggcgtggccctgaccaaccccggccccagcaaccccctgcaccccggccccagaaccgcctacagcaccgcctacaccgtgcccatggagctgctgaagagagagagaaacgtggccgccagccccctgcccagcccccacggcagcccccaggtgctgagaaagcccggcgcccccctgggccccagcaccctgccccccgccagccagagcctgcacaccccccacagcccctaccagaaggtggccagaagaaccggcgcccccatcatcgtgagcaccatgctggcccccgagcccagcatcagaccccagatcatgaacggccccctgcaccccagacccctggtggccctgctggacggcagagactgcaccgtggagatgcccatcctgaaggacctggccaccgtggccttctgcgacgcccagagcacccaggagatccacgagaaggtgctgaacgaggccgtgggcgccatgatgtaccacaccatcaccctgaccagagaggacctggagaagttcaaggccctgagagtgatcgtgagaatcggcagcggctacgacaacgtggacatcaaggccgccggcgagctgggcatcgccgtgtgcaacatccccagcgccgccgtggaggagaccgccgacagcaccatctgccacatcctgaacctgtacagaagaaacacctggctgtaccaggccctgagagagggcaccagagtgcagagcgtggagcagatcagagaggtggccagcggcgccgccagaatcagaggcgagaccctgggcctgatcggcttcggcagaaccggccaggccgtggccgtgagagccaaggccttcggcttcagcgtgatcttctacgacccctacctgcaggacggcatcgagagaagcctgggcgtgcagagagtgtacaccctgcaggacctgctgtaccagagcgactgcgtgagcctgcactgcaacctgaacgagcacaaccaccacctgatcaacgacttcaccatcaagcagatgagacagggcgccttcctggtgaacgccgccagaggcggcctggtggacgagaaggccctggcccaggccctgaaggagggcagaatcagaggcgccgccctggacgtgcacgagagcgagcccttcagcttcgcccagggccccctgaaggacgcccccaacctgatctgcaccccccacaccgcctggtacagcgagcaggccagcctggagatgagagaggccgccgccaccgagatcagaagagccatcaccggcagaatccccgagagcctgagaaactgcgtgaacaaggagttcttcgtgaccagcgccccctggagcgtgatcgaccagcaggccatccaccccgagctgaacggcgccacctacagatacccccccggcatcgtgggcgtggcccccggcggcctgcccgccgccatggagggcatcatccccggcggcatccccgtgacccacaacctgcccaccgtggcccaccccagccaggcccccagccccaaccagcccaccaagcacggcgacaacagagagcaccccaacgagcagtag

SEQ ID NO: 10180 - DNA, 1338 bp, Artificial Sequence
  Description of Artificial Sequence: Synthetic coding sequence
atggccctggtggacaagcacaaggtgaagagacagagactggacagaatctgcgagggcatcagaccccagatcatgaacggccccctgcaccccagacccctggtggccctgctggacggcagagactgcaccgtggagatgcccatcctgaaggacctggccaccgtggccttctgcgacgcccagagcacccaggagatccacgagaaggtgctgaacgaggccgtgggcgccatgatgtaccacaccatcaccctgaccagagaggacctggagaagttcaaggccctgagagtgatcgtgagaatcggcagcggctacgacaacgtggacatcaaggccgccggcgagctgggcatcgccgtgtgcaacatccccagcgccgccgtggaggagaccgccgacagcaccatctgccacatcctgaacctgtacagaagaaacacctggctgtaccaggccctgagagagggcaccagagtgcagagcgtggagcagatcagagaggtggccagcggcgccgccagaatcagaggcgagaccctgggcctgatcggcttcggcagaaccggccaggccgtggccgtgagagccaaggccttcggcttcagcgtgatcttctacgacccctacctgcaggacggcatcgagagaagcctgggcgtgcagagagtgtacaccctgcaggacctgctgtaccagagcgactgcgtgagcctgcactgcaacctgaacgagcacaaccaccacctgatcaacgacttcaccatcaagcagatgagacagggcgccttcctggtgaacgccgccagaggcggcctggtggacgagaaggccctggcccaggccctgaaggagggcagaatcagaggcgccgccctggacgtgcacgagagcgagcccttcagcttcgcccagggccccctgaaggacgcccccaacctgatctgcaccccccacaccgcctggtacagcgagcaggccagcctggagatgagagaggccgccgccaccgagatcagaagagccatcaccggcagaatccccgagagcctgagaaactgcgtgaacaaggagttcttcgtgaccagcgccccctggagcgtgatcgaccagcaggccatccaccccgagctgaacggcgccacctacagatacccccccggcatcgtgggcgtggcccccggcggcctgcccgccgccatggagggcatcatccccggcggcatccccgtgacccacaacctgcccaccgtggcccaccccagccaggcccccagccccaaccagcccaccaagcacggcgacaacagagagcaccccaacgagcagtag

SEQ ID NO: 10181 - DNA, 1338 bp, Artificial Sequence; identical to SEQ ID NO: 10180
  Description of Artificial Sequence: Synthetic coding sequence

SEQ ID NO: 10182 - DNA, 1338 bp, Artificial Sequence; identical to SEQ ID NO: 10180
  Description of Artificial Sequence: Synthetic coding sequence

SEQ ID NO: 10183 - DNA, 12 bp, Artificial Sequence
  Description of Artificial Sequence: Synthetic coding sequence
atggccctgtag

SEQ ID NO: 10184 - DNA, 1338 bp, Artificial Sequence; identical to SEQ ID NO: 10180
  Description of Artificial Sequence: Synthetic coding sequence

SEQ ID NO: 10185 - DNA, 2331 bp, Artificial Sequence
  Description of Artificial Sequence: Synthetic coding sequence
atgagcagcaccagaagccagaacccccacggcctgaagcagatcggcctggaccagatctgggacgacctgagagccggcatccagcaggtgtacaccagacagagcatggccaagagcagatacatggagctgtacacccacgtgtacaactactgcaccagcgtgcaccagagcaaccaggccagaggcgccggcgtgccccccagcaagagcaagaagggccagacccccggcggcgcccagttcgtgggcctggagctgtacaagagactgaaggagttcctgaagaactacctgaccaacctgctgaaggacggcgaggacctgatggacgagagcgtgctgaagttctacacccagcagtgggaggactacagattcagcagcaaggtgctgaacggcatctgcgcctacctgaacagacactgggtgagaagagagtgcgacgagggcagaaagggcatctacgagatctacagcctggccctggtgacctggagagactgcctgttcagacccctgaacaagcaggtgaccaacgccgtgctgaagctgatcgagaaggagagaaacggcgagaccatcaacaccagactgatcagcggcgtggtgcagagctacgtggagctgggcctgaacgaggacgacgccttcgccaagggccccaccctgaccgtgtacaaggagagcttcgagagccagttcctggccgacaccgagagattctacaccagagagagcaccgagttcctgcagcagaaccccgtgaccgagtacatgaagaaggccgaggccagactgctggaggagcagagaagagtgcaggtgtacctgcacgagagcacccaggacgagctggccagaaagtgcgagcaggtgctgatcgagaagcacctggagatcttccacaccgagttccagaacctgctggacgccgacaagaacgaggacctgggcagaatgtacaacctggtgagcagaatccaggacggcctgggcgagctgaagaagctgctggagacccacatccacaaccagggcctggccgccatcgagaagtgcggcgaggccgccctgaacgaccccaagatgtacgtgcagaccgtgctggacgtgcacaagaagtacaacgccctggtgatgagcgccttcaacaacgacgccggcttcgtggccgccctggacaaggcctgcggcagattcatcaacaacaacgccgtgaccaagatggcccagagcagcagcaagagccccgagctgctggccagatactgcgacagcctgctgaagaagagcagcaagaaccccgaggaggccgagctggaggacaccctgaaccaggtgatggtggtgttcaagtacatcgaggacaaggacgtgttccagaagttctacgccaagatgctggccaagagactggtgcaccagaacagcgccagcgacgacgccgaggccagcatgatcagcaagctgaagcaggcctgcggcttcgagtacaccagcaagctgcagagaatgttccaggacatcggcgtgagcaaggacctgaacgagcagttcaagaagcacctgaccaacagcgagcccctggacctggacttcagcatccaggtgctgagcagcggcagctggcccttccagcagagctgcaccttcgccctgcccagcgagctggagagaagctaccagagattcaccgccttctacgccagcagacacagcggcagaaagctgacctggctgtaccagctgagcaagggcgagctggtgaccaactgcttcaagaacagatacaccctgcaggccagcaccttccagatggccatcctgctgcagtacaacaccgaggacgcctacaccgtgcagcagctgaccgacagcacccagatcaagatggacatcctggcccaggtgctgcagatcctgctgaagagcaagctgctggtgctggaggacgagaacgccaacgtggacgaggtggagctgaagcccgacaccctgatcaagctgtacctgggctacaagaacaagaagctgagagtgaacatcaacgtgcccatgaagaccgagcagaagcaggagcaggagaccacccacaagaacatcgaggaggacagaaagctgctgatccaggccgccatcgtgagaatcatgaagatgagaaaggtgctgaagcaccagcagctgctgggcgaggtgctgacccagctgagcagcagattcaagcccagagtgcccgtgatcaagaagtgcatcgacatcctgatcgagaaggagtacctggagagagtggacggcgagaaggacacctacagctacctggcctag

SEQ ID NO: 10186 - DNA, 2331 bp, Artificial Sequence; identical to SEQ ID NO: 10185
  Description of Artificial Sequence: Synthetic coding sequence

SEQ ID NO: 10187 - DNA, 2112 bp, Artificial Sequence
  Description of Artificial Sequence: Synthetic coding sequence
atgagcagcaccagaagccagaacccccacggcctgaagcagatcggcctggaccagatctgggacgacctgagagccggcatccagcaggtgtacaccagacagagcatggccaagagcagatacatggagctgtacacccagcagtgggaggactacagattcagcagcaaggtgctgaacggcatctgcgcctacctgaacagacactgggtgagaagagagtgcgacgagggcagaaagggcatctacgagatctacagcctggccctggtgacctggagagactgcctgttcagacccctgaacaagcaggtgaccaacgccgtgctgaagctgatcgagaaggagagaaacggcgagaccatcaacaccagactgatcagcggcgtggtgcagagctacgtggagctgggcctgaacgaggacgacgccttcgccaagggccccaccctgaccgtgtacaaggagagcttcgagagccagttcctggccgacaccgagagattctacaccagagagagcaccgagttcctgcagcagaaccccgtgaccgagtacatgaagaaggccgaggccagactgctggaggagcagagaagagtgcaggtgtacctgcacgagagcacccaggacgagctggccagaaagtgcgagcaggtgctgatcgagaagcacctggagatcttccacaccgagttccagaacctgctggacgccgacaagaacgaggacctgggcagaatgtacaacctggtgagcagaatccaggacggcctgggcgagctgaagaagctgctggagacccacatccacaaccagggcctggccgccatcgagaagtgcggcgaggccgccctgaacgaccccaagatgtacgtgcagaccgtgctggacgtgcacaagaagtacaacgccctggtgatgagcgccttcaacaacgacgccggcttcgtggccgccctggacaaggcctgcggcagattcatcaacaacaacgccgtgaccaagatggcccagagcagcagcaagagccccgagctgctggccagatactgcgacagcctgctgaagaagagcagcaagaaccccgaggaggccgagctggaggacaccctgaaccaggtgatggtggtgttcaagtacatcgaggacaaggacgtgttccagaagttctacgccaagatgctggccaagagactggtgcaccagaacagcgccagcgacgacgccgaggccagcatgatcagcaagctgaagcaggcctgcggcttcgagtacaccagcaagctgcagagaatgttccaggacatcggcgtgagcaaggacctgaacgagcagttcaagaagcacctgaccaacagcgagcccctggacctggacttcagcatccaggtgctgagcagcggcagctggcccttccagcagagctgcaccttcgccctgcccagcgagctggagagaagctaccagagattcaccgccttctacgccagcagacacagcggcagaaagctgacctggctgtaccagctgagcaagggcgagctggtgaccaactgcttcaagaacagatacaccctgcaggccagcaccttccagatggccatcctgctgcagtacaacaccgaggacgcctacaccgtgcagcagctgaccgacagcacccagatcaagatggacatcctggcccaggtgctgcagatcctgctgaagagcaagctgctggtgctggaggacgagaacgccaacgtggacgaggtggagctgaagcccgacaccctgatcaagctgtacctgggctacaagaacaagaagctgagagtgaacatcaacgtgcccatgaagaccgagcagaagcaggagcaggagaccacccacaagaacatcgaggaggacagaaagctgctgatccaggccgccatcgtgagaatcatgaagatgagaaaggtgctgaagcaccagcagctgctgggcgaggtgctgacccagctgagcagcagattcaagcccagagtgcccgtgatcaagaagtgcatcgacatcctgatcgagaaggagtacctggagagagtggacggcgagaaggacacctacagctacctggcctag

SEQ ID NO: 10188 - DNA, 1824 bp, Artificial Sequence
  Description of Artificial Sequence: Synthetic coding sequence
atggagctgtacacccacgtgtacaactactgcaccagcgtgcaccagagcaaccaggccagaggcgccggcgtgccccccagcaagagcaagaagggccagacccccggcggcgcccagttcgtgggcctggagctgtacaagagactgaaggagttcctgaagaactacctgaccaacctgctgaaggacggcgaggacctgatggacgagagcgtgctgaagttctacacccagcagtgggaggactacagattcagcagcaaggtgctgaacggcatctgcgcctacctgaacagacactgggtgagaagagagtgcgacgagggcagaaagggcatctacgagatctacagcctggccctggtgacctggagagactgcctgttcagacccctgaacaagcaggtgaccaacgccgtgctgaagctgatcgagaaggagagaaacggcgagaccatcaacaccagactgatcagcggcgtggtgcagagctacgtggagctgggcctgaacgaggacgacgccttcgccaagggccccaccctgaccgtgtacaaggagagcttcgagagccagttcctggccgacaccgagagattctacaccagagagagcaccgagttcctgcagcagaaccccgtgaccgagtacatgaagaaggccgaggccagactgctggaggagcagagaagagtgcaggtgtacctgcacgagagcacccaggacgagctggccagaaagtgcgagcaggtgctgatcgagaagcacctggagatcttccacaccgagttccagaacctgctggacgccgacaagaacgaggacctgggcagaatgtacaacctggtgagcagaatccaggacggcctgggcgagctgaagaagctgctggagacccacatccacaaccagggcctggccgccatcgagaagtgcggcgaggccgccctgaacgaccccaagatgtacgtgcagaccgtgctggacgtgcacaagaagtacaacgccctggtgatgagcgccttcaacaacgacgccggcttcgtggccgccctggacaaggcctgcggcagattcatcaacaacaacgccgtgaccaagatggcccagagcagcagcaagagccccgagctgctggccagatactgcgacagcctgctgaagaagagcagcaagaaccccgaggaggccgagctggaggacaccctgaaccaggtgatggtggtgttcaagtacatcgaggacaaggacgtgttccagaagttctacgccaagatgctggccaagagactggtgcaccagaacagcgccagcgacgacgccgaggccagcatgatcagcaagctgaagcaggcctgcggcttcgagtacaccagcaagctgcagagaatgttccaggacatcggcgtgagcaaggacctgaacgagcagttcaagaagcacctgaccaacagcgagcccctggacctggacttcagcatccaggtgctgagcagcggcagctggcccttccagcagagctgcaccttcgccctgcccagcgagctggagagaagctaccagagattcaccgccttctacgccagcagacacagcggcagaaagctgacctggctgtaccagctgagcaagggcgagctggtgaccaactgcttcaagaacagatacaccctgcaggccagcaccttccagatggccatcctgctgcagtacaacaccgaggacgcctacaccgtgcagcagctgaccgacagcacccagatcaagatggacatcctggcccaggtgctgcagatcctgctgaagagcaagctgctgtag

SEQ ID NO: 10189 - DNA, 2121 bp, Artificial Sequence
  Description of Artificial Sequence: Synthetic coding sequence
atgagcctgaagcccagagtggtggacttcgacgagacctggaacaagctgctgaccaccatcaaggccgtggtgatgctggagtacgtggagagagccacctggaacgacagattcagcgacatctacgccctgtgcgtggcctaccccgagcccctgggcgagagactgtacaccgagaccaagatcttcctggagaaccacgtgagacacctgcacaagagagtgctggagagcgaggagcaggtgctggtgatgtaccacagatactgggaggagtacagcaagggcgccgactacatggactgcctgtacagatacctgaacacccagttcatcaagaagaacaagctgaccgaggccgacctgcagtacggctacggcggcgtggacatgaacgagcccctgatggagatcggcgagctggccctggacatgtggagaaagctgatggtggagcccctgcaggccatcctgatcagaatgctgctgagagagatcaagaacgacagaggcggcgaggaccccaaccagaaggtgatccacggcgtgatcaacagcttcgtgcacgtggagcagtacaagaagaagttccccctgaagttctaccaggagatcttcgagagccccttcctgaccgagaccggcgagtactacaagcaggaggccagcaacctgctgcaggagagcaactgcagccagtacatggagaaggtgctgggcagactgaaggacgaggagatcagatgcagaaagtacctgcaccccagcagctacaccaaggtgatccacgagtgccagcagagaatggtggccgaccacctgcagttcctgcacgccgagtgccacaacatcatcagacaggagaagaagaacgacatggccaacatgtacgtgctgctgagagccgtgagcaccggcctgccccacatgatccaggagctgcagaaccacatccacgacgagggcctgagagccaccagcaacctgacccaggagaacatgcccaccctgttcgtggagagcgtgctggaggtgcacggcaagttcgtgcagctgatcaacaccgtgctgaacggcgaccagcacttcatgagcgccctggacaaggccctgaccagcgtggtgaactacagagagcccaagagcgtgtgcaaggcccccgagctgctggccaagtactgcgacaacctgctgaagaagagcgccaagggcatgaccgagaacgaggtggaggacagactgaccagcttcatcaccgtgttcaagtacatcgacgacaaggacgtgttccagaagttctacgccagaatgctggccaagagactgatccacggcctgagcatgagcatggacagcgaggaggccatgatcaacaagctgaagcaggcctgcggctacgagttcaccagcaagctgcacagaatgtacaccgacatgagcgtgagcgccgacctgaacaacaagttcaacaacttcatcaagaaccaggacaccgtgatcgacctgggcatcagcttccagatctacgtgctgcaggccggcgcctggcccctgacccaggcccccagcagcaccttcgccatcccccaggagctggagaagagcgtgcagatgttcgagctgttctacagccagcacttcagcggcagaaagctgacctggctgcactacctgtgcaccggcgaggtgaagatgaactacctgggcaagccctacgtggccatggtgaccacctaccagatggccgtgctgctggccttcaacaacagcgagaccgtgagctacaaggagctgcaggacagcacccagatgaacgagaaggagctgaccaagaccatcaagagcctgctggacgtgaagatgatcaaccacgacagcgagaaggaggacatcgacgccgagagcagcttcagcctgaacatgaacttcagcagcaagagaaccaagttcaagatcaccaccagcatgcagaaggacaccccccaggtgatcagccagagcagagccagattcaaccccagcatcagcatgatcaagaagtgcatcgaggtgctgatcgacaagcagtacatcgagagaagccaggccagcgccgacgagtacagctacgtggcctag

SEQ ID NO: 10190 - DNA, 2121 bp, Artificial Sequence; identical to SEQ ID NO: 10189
  Description of Artificial Sequence: Synthetic coding sequence

SEQ ID NO: 10191 - DNA, 2238 bp, Artificial Sequence
  Description of Artificial Sequence: Synthetic coding sequence
atgagcctgaagcccagagtggtggacttcgacgagacctggaacaagctgctgaccaccatcaaggccgtggtgatgctggagtacgtggagagagccacctggaacgacagattcagcgacatctacgccctgtgcgtggcctaccccgagcccctgggcgagagactgtacaccgagaccaagatcttcctggagaaccacgtgagacacctgcacaagagagtgctggagagcgaggagcaggtgctggtgatgtaccacagatactgggaggagtacagcaagggcgccgactacatggactgcctgtacagatacctgaacacccagttcatcaagaagaacaagctgaccgaggccgacctgcagtacggctacggcggcgtggacatgaacgagcccctgatggagatcggcgagctggccctggacatgtggagaaagctgatggtggagcccctgcaggccatcctgatcagaatgctgctgagagagatcaagaacgacagaggcggcgaggaccccaaccagaaggtgatccacggcgtgatcaacagcttcgtgcacgtggagcagtacaagaagaagttccccctgaagttctaccaggagatcttcgagagccccttcctgaccgagaccggcgagtactacaagcaggaggccagcaacctgctgcaggagagcaactgcagccagtacatggagaaggtgctgggcagactgaaggacgaggagatcagatgcagaaagtacctgcaccccagcagctacaccaaggtgatccacgagtgccagcagagaatggtggccgaccacctgcagttcctgcacgccgagtgccacaacatcatcagacaggagaagaagaacgacatggccaacatgtacgtgctgctgagagccgtgagcaccggcctgccccacatgatccaggagctgcagaaccacatccacgacgagggcctgagagccaccagcaacctgacccaggagaacatgcccaccctgttcgtggagagcgtgctggaggtgcacggcaagttcgtgcagctgatcaacaccgtgctgaacggcgaccagcacttcatgagcgccctggacaaggccctgaccagcgtggtgaactacagagagcccaagagcgtgtgcaaggcccccgagctgctggccaagtactgcgacaacctgctgaagaagagcgccaagggcatgaccgagaacgaggtggaggacagactgaccagcttcatcaccgtgttcaagtacatcgacgacaaggacgtgttccagaagttctacgccagaatgctggccaagagactgatccacggcctgagcatgagcatggacagcgaggaggccatgatcaacaagctgaagcaggcctgcggctacgagttcaccagcaagctgcacagaatgtacaccgacatgagcgtgagcgccgacctgaacaacaagttcaacaacttcatcaagaaccaggacaccgtgatcgacctgggcatcagcttccagatctacgtgctgcaggccggcgcctggcccctgacccaggcccccagcagcaccttcgccatcccccaggagctggagaagagcgtgcagatgttcgagctgttctacagccagcacttcagcggcagaaagctgacctggctgcactacctgtgcaccggcgaggtgaagatgaactacctgggcaagccctacgtggccatggtgaccacctaccagatggccgtgctgctggccttcaacaacagcgagaccgtgagctacaaggagctgcaggacagcacccagatgaacgagaaggagctgaccaagaccatcaagagcctgctggacgtgaagatgatcaaccacgacagcgagaaggaggacatcgacgccgagagcagcttcagcctgaacatgaacttcagcagcaagagaaccaagttcaagatcaccaccagcatgcagaaggacaccccccaggagatggagcagaccagaagcgccgtggacgaggacagaaagatgtacctgcaggccgccatcgtgagaatcatgaaggccagaaaggtgctgagacacaacgccctgatccaggaggtgatcagccagagcagagccagattcaaccccagcatcagcatgatcaagaagtgcatcgaggtgctgatcgacaagcagtacatcgagagaagccaggccagcgccgacgagtacagctacgtggcctag

SEQ ID NO: 10192 - DNA, 2238 bp, Artificial Sequence; identical to SEQ ID NO: 10191
  Description of Artificial Sequence: Synthetic coding sequence

SEQ ID NO: 10193 - DNA, 2238 bp, Artificial Sequence; identical to SEQ ID NO: 10191
  Description of Artificial Sequence: Synthetic coding sequence

SEQ ID NO: 10194 - DNA, 2067 bp, Artificial Sequence
  Description of Artificial Sequence: Synthetic coding sequence
atgctgtacgtgtggcccatcctgaaccccctggagaaggacttcatccagaagctgagattcttctggaagatcatgttcggcatctgcatcagatactgggaggagtacagcaagggcgccgactacatggactgcctgtacagatacctgaacacccagttcatcaagaagaacaagctgaccgaggccgacctgcagtacggctacggcggcgtggacatgaacgagcccctgatggagatcggcgagctggccctggacatgtggagaaagctgatggtggagcccctgcaggccatcctgatcagaatgctgctgagagagatcaagaacgacagaggcggcgaggaccccaaccagaaggtgatccacggcgtgatcaacagcttcgtgcacgtggagcagtacaagaagaagttccccctgaagttctaccaggagatcttcgagagccccttcctgaccgagaccggcgagtactacaagcaggaggccagcaacctgctgcaggagagcaactgcagccagtacatggagaaggtgctgggcagactgaaggacgaggagatcagatgcagaaagtacctgcaccccagcagctacaccaaggtgatccacgagtgccagcagagaatggtggccgaccacctgcagttcctgcacgccgagtgccacaacatcatcagacaggagaagaagaacgacatggccaacatgtacgtgctgctgagagccgtgagcaccggcctgccccacatgatccaggagctgcagaaccacatccacgacgagggcctgagagccaccagcaacctgacccaggagaacatgcccaccctgttcgtggagagcgtgctggaggtgcacggcaagttcgtgcagctgatcaacaccgtgctgaacggcgaccagcacttcatgagcgccctggacaaggccctgaccagcgtggtgaactacagagagcccaagagcgtgtgcaaggcccccgagctgctggccaagtactgcgacaacctgctgaagaagagcgccaagggcatgaccgagaacgaggtggaggacagactgaccagcttcatcaccgtgttcaagtacatcgacgacaaggacgtgttccagaagttctacgccagaatgctggccaagagactgatccacggcctgagcatgagcatggacagcgaggaggccatgatcaacaagctgaagcaggcctgcggctacgagttcaccagcaagctgcacagaatgtacaccgacatgagcgtgagcgccgacctgaacaacaagttcaacaacttcatcaagaaccaggacaccgtgatcgacctgggcatcagcttccagatctacgtgctgcaggccggcgcctggcccctgacccaggcccccagcagcaccttcgccatcccccaggagctggagaagagcgtgcagatgttcgagctgttctacagccagcacttcagcggcagaaagctgacctggctgcactacctgtgcaccggcgaggtgaagatgaactacctgggcaagccctacgtggccatggtgaccacctaccagatggccgtgctgctggccttcaacaacagcgagaccgtgagctacaaggagctgcaggacagcacccagatgaacgagaaggagctgaccaagaccatcaagagcctgctggacgtgaagatgatcaaccacgacagcgagaaggaggacatcgacgccgagagcagcttcagcctgaacatgaacttcagcagcaagagaaccaagttcaagatcaccaccagcatgcagaaggacaccccccaggagatggagcagaccagaagcgccgtggacgaggacagaaagatgtacctgcaggccgccatcgtgagaatcatgaaggccagaaaggtgctgagacacaacgccctgatccaggaggtgatcagccagagcagagccagattcaaccccagcatcagcatgatcaagaagtgcatcgaggtgctgatcgacaagcagtacatcgagagaagccaggccagcgccgacgagtacagctacgtggcctag

SEQ ID NO: 10195 - DNA, 651 bp, Artificial Sequence
  Description of Artificial Sequence: Synthetic coding sequence
atgagcctgaagcccagagtggtggacttcgacgagacctggaacaagctgctgaccaccatcaaggccgtggtgatgctggagtacgtggagagagccacctggaacgacagattcagcgacatctacgccctgtgcgtggcctaccccgagcccctgggcgagagactgtacaccgagaccaagatcttcctggagaaccacgtgagacacctgcacaagagagtgctggagagcgaggagcaggtgctggtgatgtaccacagatactgggaggagtacagcaagggcgccgactacatggactgcctgtacagatacctgaacacccagttcatcaagaagaacaagctgaccgaggccgacctgcagtacggctacggcggcgtggacatgaacgagcccctgatggagatcggcgagctggccctggacatgtggagaaagctgatggtggagcccctgcaggccatcctgatcagaatgctgctgagagagatcaagaacgacagaggcggcgaggaccccaaccagaaggtgatccacggcgtgatcaacagcttcgtgcacgtggagcagtacaagaagaagttccccctgaagttctaccaggagatcttcgagagccccttcctgaccgagaccggctag

SEQ ID NO: 10196 - DNA, 2295 bp, Artificial Sequence
  Description of Artificial Sequence: Synthetic coding sequence
atgtacagagtgacctggagcaccttctggctgagattccagcactacacctgcaccatgagcctgaagcccagagtggtggacttcgacgagacctggaacaagctgctgaccaccatcaaggccgtggtgatgctggagtacgtggagagagccacctggaacgacagattcagcgacatctacgccctgtgcgtggcctaccccgagcccctgggcgagagactgtacaccgagaccaagatcttcctggagaaccacgtgagacacctgcacaagagagtgctggagagcgaggagcaggtgctggtgatgtaccacagatactgggaggagtacagcaagggcgccgactacatggactgcctgtacagatacctgaacacccagttcatcaagaagaacaagctgaccgaggccgacctgcagtacggctacggcggcgtggacatgaacgagcccctgatggagatcggcgagctggccctggacatgtggagaaagctgatggtggagcccctgcaggccatcctgatcagaatgctgctgagagagatcaagaacgacagaggcggcgaggaccccaaccagaaggtgatccacggcgtgatcaacagcttcgtgcacgtggagcagtacaagaagaagttccccctgaagttctaccaggagatcttcgagagccccttcctgaccgagaccggcgagtactacaagcaggaggccagcaacctgctgcaggagagcaactgcagccagtacatggagaaggtgctgggcagactgaaggacgaggagatcagatgcagaaagtacctgcaccccagcagctacaccaaggtgatccacgagtgccagcagagaatggtggccgaccacctgcagttcctgcacgccgagtgccacaacatcatcagacaggagaagaagaacgacatggccaacatgtacgtgctgctgagagccgtgagcaccggcctgccccacatgatccaggagctgcagaaccacatccacgacgagggcctgagagccaccagcaacctgacccaggagaacatgcccaccctgttcgtggagagcgtgctggaggtgcacggcaagttcgtgcagctgatcaacaccgtgctgaacggcgaccagcacttcatgagcgccctggacaaggccctgaccagcgtggtgaactacagagagcccaagagcgtgtgcaaggcccccgagctgctggccaagtactgcgacaacctgctgaagaagagcgccaagggcatgaccgagaacgaggtggaggacagactgaccagcttcatcaccgtgttcaagtacatcgacgacaaggacgtgttccagaagttctacgccagaatgctggccaagagactgatccacggcctgagcatgagcatggacagcgaggaggccatgatcaacaagctgaagcaggcctgcggctacgagttcaccagcaagctgcacagaatgtacaccgacatgagcgtgagcgccgacctgaacaacaagttcaacaacttcatcaagaaccaggacaccgtgatcgacctgggcatcagcttccagatctacgtgctgcaggccggcgcctggcccctgacccaggcccccagcagcaccttcgccatcccccaggagctggagaagagcgtgcagatgttcgagctgttctacagccagcacttcagcggcagaaagctgacctggctgcactacctgtgcaccggcgaggtgaagatgaactacctgggcaagccctacgtggccatggtgaccacctaccagatggccgtgctgctggccttcaacaacagcgagaccgtgagctacaaggagctgcaggacagcacccagatgaacgagaaggagctgaccaagaccatcaagagcctgctggacgtgaagatgatcaaccacgacagcgagaaggaggacatcgacgccgagagcagcttcagcctgaacatgaacttcagcagcaagagaaccaagttcaagatcaccaccagcatgcagaaggacaccccccaggagatggagcagaccagaagcgccgtggacgaggacagaaagatgtacctgcaggccgccatcgtgagaatcatgaaggccagaaaggtgctgagacacaacgccctgatccaggaggtgatcagccagagcagagccagattcaaccccagcatcagcatgatcaagaagtgcatcgaggtgctgatcgacaagcagtacatcgagagaagccaggccagcgccgacgagtacagctacgtggcctag

SEQ ID NO: 10197 - DNA, 2307 bp, Artificial Sequence
  Description of Artificial Sequence: Synthetic coding sequence
atgagcaacctgagcaagggcaccggcagcagaaaggacaccaagatgagaatcagagccttccccatgaccatggacgagaagtacgtgaacagcatctgggacctgctgaagaacgccatccaggagatccagagaaagaacaacagcggcctgagcttcgaggagctgtacagaaacgcctacaccatggtgctgcacaagcacggcgagaagctgtacaccggcctgagagaggtggtgaccgagcacctgatcaacaaggtgagagaggacgtgctgaacagcctgaacaacaacttcctgcagaccctgaaccaggcctggaacgaccaccagaccgccatggtgatgatcagagacatcctgatgtacatggacagagtgtacgtgcagcagaacaacgtggagaacgtgtacaacctgggcctgatcatcttcagagaccaggtggtgagatacggctgcatcagagaccacctgagacagaccctgctggacatgatcgccagagagagaaagggcgaggtggtggacagaggcgccatcagaaacgcctgccagatgctgatgatcctgggcctggagggcagaagcgtgtacgaggaggacttcgaggcccccttcctggagatgagcgccgagttcttccagatggagagccagaagttcctggccgagaacagcgccagcgtgtacatcaagaaggtggaggccagaatcaacgaggagatcgagagagtgatgcactgcctggacaagagcaccgaggagcccatcgtgaaggtggtggagagagagctgatcagcaagcacatgaagaccatcgtggagatggagaacagcggcctggtgcacatgctgaagaacggcaagaccgaggacctgggctgcatgtacaagctgttcagcagagtgcccaacggcctgaagaccatgtgcgagtgcatgagcagctacctgagagagcagggcaaggccctggtgagcgaggagggcgagggcaagaaccccgtggactacatccagggcctgctggacctgaagagcagattcgacagattcctgctggagagcttcaacaacgacagactgttcaagcagaccatcgccggcgacttcgagtacttcctgaacctgaacagcagaagccccgagtacctgagcctgttcatcgacgacaagctgaagaagggcgtgaagggcctgaccgagcaggaggtggagaccatcctggacaaggccatggtgctgttcagattcatgcaggagaaggacgtgttcgagagatactacaagcagcacctggccagaagactgctgaccaacaagagcgtgagcgacgacagcgagaagaacatgatcagcaagctgaagaccgagtgcggctgccagttcaccagcaagctggagggcatgttcagagacatgagcatcagcaacaccaccatggacgagttcagacagcacctgcaggccaccggcgtgagcctgggcggcgtggacctgaccgtgagagtgctgaccaccggctactggcccacccagagcgccacccccaagtgcaacatcccccccgcccccagacacgccttcgagatcttcagaagattctacctggccaagcacagcggcagacagctgaccctgcagcaccacatgggcagcgccgacctgaacgccaccttctacggccccgtgaagaaggaggacggcagcgaggtgggcgtgggcggcgcccaggtgaccggcagcaacaccagaaagcacatcctgcaggtgagcaccttccagatgaccatcctgatgctgttcaacaacagagagaagtacaccttcgaggagatccagcaggagaccgacatccccgagagagagctggtgagagccctgcagagcctggcctgcggcaagcccacccagagagtgctgaccaaggagcccaagagcaaggagatcgagaacggccacatcttcaccgtgaacgaccagttcaccagcaagctgcacagagtgaagatccagaccgtggccgccaagcagggcgagagcgaccccgagagaaaggagaccagacagaaggtggacgacgacagaaagcacgagatcgaggccgccatcgtgagaatcatgaagagcagaaagaagatgcagcacaacgtgctggtggccgaggtgacccagcagctgaaggccagattcctgcccagccccgtggtgatcaagaagagaatcgagggcctgatcgagagagagtacctggccagaacccccgaggacagaaaggtgtacacctacgtggcctag

SEQ ID NO: 10198 - DNA, 2109 bp, Artificial Sequence
  Description of Artificial Sequence: Synthetic coding sequence
atgagcaacctgagcaagggcaccggcagcagaaaggacaccaagatgagaatcagagccttccccgtgagagaggacgtgctgaacagcctgaacaacaacttcctgcagaccctgaaccaggcctggaacgaccaccagaccgccatggtgatgatcagagacatcctgatgtacatggacagagtgtacgtgcagcagaacaacgtggagaacgtgtacaacctgggcctgatcatcttcagagaccaggtggtgagatacggctgcatcagagaccacctgagacagaccctgctggacatgatcgccagagagagaaagggcgaggtggtggacagaggcgccatcagaaacgcctgccagatgctgatgatcctgggcctggagggcagaagcgtgtacgaggaggacttcgaggcccccttcctggagatgagcgccgagttcttccagatggagagccagaagttcctggccgagaacagcgccagcgtgtacatcaagaaggtggaggccagaatcaacgaggagatcgagagagtgatgcactgcctggacaagagcaccgaggagcccatcgtgaaggtggtggagagagagctgatcagcaagcacatgaagaccatcgtggagatggagaacagcggcctggtgcacatgctgaagaacggcaagaccgaggacctgggctgcatgtacaagctgttcagcagagtgcccaacggcctgaagaccatgtgcgagtgcatgagcagctacctgagagagcagggcaaggccctggtgagcgaggagggcgagggcaagaaccccgtggactacatccagggcctgctggacctgaagagcagattcgacagattcctgctggagagcttcaacaacgacagactgttcaagcagaccatcgccggcgacttcgagtacttcctgaacctgaacagcagaagccccgagtacctgagcctgttcatcgacgacaagctgaagaagggcgtgaagggcctgaccgagcaggaggtggagaccatcctggacaaggccatggtgctgttcagattcatgcaggagaaggacgtgttcgagagatactacaagcagcacctggccagaagactgctgaccaacaagagcgtgagcgacgacagcgagaagaacatgatcagcaagctgaagaccgagtgcggctgccagttcaccagcaagctggagggcatgttcagagacatgagcatcagcaacaccaccatggacgagttcagacagcacctgcaggccaccggcgtgagcctgggcggcgtggacctgaccgtgagagtgctgaccaccggctactggcccacccagagcgccacccccaagtgcaacatcccccccgcccccagacacgccttcgagatcttcagaagattctacctggccaagcacagcggcagacagctgaccctgcagcaccacatgggcagcgccgacctgaacgccaccttctacggccccgtgaagaaggaggacggcagcgaggtgggcgtgggcggcgcccaggtgaccggcagcaacaccagaaagcacatcctgcaggtgagcaccttccagatgaccatcctgatgctgttcaacaacagagagaagtacaccttcgaggagatccagcaggagaccgacatccccgagagagagctggtgagagccctgcagagcctggcctgcggcaagcccacccagagagtgctgaccaaggagcccaagagcaaggagatcgagaacggccacatcttcaccgtgaacgaccagttcaccagcaagctgcacagagtgaagatccagaccgtggccgccaagcagggcgagagcgaccccgagagaaaggagaccagacagaaggtggacgacgacagaaagcacgagatcgaggccgccatcgtgagaatcatgaagagcagaaagaagatgcagcacaacgtgctggtggccgaggtgacccagcagctgaaggccagattcctgcccagccccgtggtgatcaagaagagaatcgagggcctgatcgagagagagtacctggccagaacccccgaggacagaaaggtgtacacctacgtggcctag

SEQ ID NO: 10199 - DNA, 2235 bp, Artificial Sequence
  Description of Artificial Sequence: Synthetic coding sequence
atggacgagaagtacgtgaacagcatctgggacctgctgaagaacgccatccaggagatccagagaaagaacaacagcggcctgagcttcgaggagctgtacagaaacgcctacaccatggtgctgcacaagcacggcgagaagctgtacaccggcctgagagaggtggtgaccgagcacctgatcaacaaggtgagagaggacgtgctgaacagcctgaacaacaacttcctgcagaccctgaaccaggcctggaacgaccaccagaccgccatggtgatgatcagagacatcctgatgtacatggacagagtgtacgtgcagcagaacaacgtggagaacgtgtacaacctgggcctgatcatcttcagagaccaggtggtgagatacggctgcatcagagaccacctgagacagaccctgctggacatgatcgccagagagagaaagggcgaggtggtggacagaggcgccatcagaaacgcctgccagatgctgatgatcctgggcctggagggcagaagcgtgtacgaggaggacttcgaggcccccttcctggagatgagcgccgagttcttccagatggagagccagaagttcctggccgagaacagcgccagcgtgtacatcaagaaggtggaggccagaatcaacgaggagatcgagagagtgatgcactgcctggacaagagcaccgaggagcccatcgtgaaggtggtggagagagagctgatcagcaagcacatgaagaccatcgtggagatggagaacagcggcctggtgcacatgctgaagaacggcaagaccgaggacctgggctgcatgtacaagctgttcagcagagtgcccaacggcctgaagaccatgtgcgagtgcatgagcagctacctgagagagcagggcaaggccctggtgagcgaggagggcgagggcaagaaccccgtggactacatccagggcctgctggacctgaagagcagattcgacagattcctgctggagagcttcaacaacgacagactgttcaagcagaccatcgccggcgacttcgagtacttcctgaacctgaacagcagaagccccgagtacctgagcctgttcatcgacgacaagctgaagaagggcgtgaagggcctgaccgagcaggaggtggagaccatcctggacaaggccatggtgctgttcagattcatgcaggagaaggacgtgttcgagagatactacaagcagcacctggccagaagactgctgaccaacaagagcgtgagcgacgacagcgagaagaacatgatcagcaagctgaagaccgagtgcggctgccagttcaccagcaagctggagggcatgttcagagacatgagcatcagcaacaccaccatggacgagttcagacagcacctgcaggccaccggcgtgagcctgggcggcgtggacctgaccgtgagagtgctgaccaccggctactggcccacccagagcgccacccccaagtgcaacatcccccccgcccccagacacgccttcgagatcttcagaagattctacctggccaagcacagcggcagacagctgaccctgcagcaccacatgggcagcgccgacctgaacgccaccttctacggccccgtgaagaaggaggacggcagcgaggtgggcgtgggcggcgcccaggtgaccggcagcaacaccagaaagcacatcctgcaggtgagcaccttccagatgaccatcctgatgctgttcaacaacagagagaagtacaccttcgaggagatccagcaggagaccgacatccccgagagagagctggtgagagccctgcagagcctggcctgcggcaagcccacccagagagtgctgaccaaggagcccaagagcaaggagatcgagaacggccacatcttcaccgtgaacgaccagttcaccagcaagctgcacagagtgaagatccagaccgtggccgccaagcagggcgagagcgaccccgagagaaaggagaccagacagaaggtggacgacgacagaaagcacgagatcgaggccgccatcgtgagaatcatgaagagcagaaagaagatgcagcacaacgtgctggtggccgaggtgacccagcagctgaaggccagattcctgcccagccccgtggtgatcaagaagagaatcgagggcctgatcgagagagagtacctggccagaacccccgaggacagaaaggtgtacacctacgtggcctag

SEQ ID NO: 10200 - DNA, 2235 bp, Artificial Sequence; identical to SEQ ID NO: 10199
  Description of Artificial Sequence: Synthetic coding sequence

SEQ ID NO: 10201 - DNA, 1398 bp, Artificial Sequence
  Description of Artificial Sequence: Synthetic coding sequence
atggagaccggcttccccgccatcatgtaccccggcagcttcatcggcggctggggcgaggagtacctgagctgggagggccccggcctgcccgacttcgtgttccagcagcagcccgtggagagcgaggccatgcactgcagcaaccccaagagcggcgtggtgctggccaccgtggccagaggccccgacgcctgccagatcctgaccagagcccccctgggccaggaccccccccagagaaccgtgctgggcctgctgaccgccaacggccagtacagaagaacctgcggccagggcatcaccagaatcagatgctacagcggcagcgagaacgccttcccccccgccggcaagaaggccctgcccgactgcggcgtgcaggagccccccaagcagggcttcgacatctacatggacgagctggagcagggcgacagagacagctgcagcgtgagagagggcatggccttcgaggacgtgtacgaggtggacaccggcaccctgaagagcgacctgcacttcctgctggacttcaacaccgtgagccccatgctggtggacagcagcctgctgagccagagcgaggacatcagcagcctgggcaccgacgtgatcaacgtgaccgagtacgccgaggagatctaccagtacctgagagaggccgagatcagacacagacccaaggcccactacatgaagaagcagcccgacatcaccgagggcatgagaaccatcctggtggactggctggtggaggtgggcgaggagtacaagctgagagccgagaccctgtacctggccgtgaacttcctggacagattcctgagctgcatgagcgtgctgagaggcaagctgcagctggtgggcaccgccgccatgctgctggccagcaagtacgaggagatctacccccccgaggtggacgagttcgtgtacatcaccgacgacacctacaccaagagacagctgctgaagatggagcacctgctgctgaaggtgctggccttcgacctgaccgtgcccaccaccaaccagttcctgctgcagtacctgagaagacagggcgtgtgcgtgagaaccgagaacctggccaagtacgtggccgagctgagcctgctggaggccgaccccttcctgaagtacctgcccagcctgatcgccgccgccgccttctgcctggccaactacaccgtgaacaagcacttctggcccgagaccctggccgccttcaccggctacagcctgagcgagatcgtgccctgcctgagcgagctgcacaaggcctacctggacatcccccacagaccccagcaggccatcagagagaagtacaaggccagcaagtacctgtgcgtgagcctgatggagccccccgccgtgctgctgctgcagtag

SEQ ID NO: 10202 - DNA, 1395 bp, Artificial Sequence
  Description of Artificial Sequence: Synthetic coding sequence
atggagaccggcttccccgccatcatgtaccccggcagcttcatcggcggctggggcgaggagtacctgagctgggagggccccggcctgcccgacttcgtgttccagcagcccgtggagagcgaggccatgcactgcagcaaccccaagagcggcgtggtgctggccaccgtggccagaggccccgacgcctgccagatcctgaccagagcccccctgggccaggaccccccccagagaaccgtgctgggcctgctgaccgccaacggccagtacagaagaacctgcggccagggcatcaccagaatcagatgctacagcggcagcgagaacgccttcccccccgccggcaagaaggccctgcccgactgcggcgtgcaggagccccccaagcagggcttcgacatctacatggacgagctggagcagggcgacagagacagctgcagcgtgagagagggcatggccttcgaggacgtgtacgaggtggacaccggcaccctgaagagcgacctgcacttcctgctggacttcaacaccgtgagccccatgctggtggacagcagcctgctgagccagagcgaggacatcagcagcctgggcaccgacgtgatcaacgtgaccgagtacgccgaggagatctaccagtacctgagagaggccgagatcagacacagacccaaggcccactacatgaagaagcagcccgacatcaccgagggcatgagaaccatcctggtggactggctggtggaggtgggcgaggagtacaagctgagagccgagaccctgtacctggccgtgaacttcctggacagattcctgagctgcatgagcgtgctgagaggcaagctgcagctggtgggcaccgccgccatgctgctggccagcaagtacgaggagatctacccccccgaggtggacgagttcgtgtacatcaccgacgacacctacaccaagagacagctgctgaagatggagcacctgctgctgaaggtgctggccttcgacctgaccgtgcccaccaccaaccagttcctgctgcagtacctgagaagacagggcgtgtgcgtgagaaccgagaacctggccaagtacgtggccgagctgagcctgctggaggccgaccccttcctgaagtacctgcccagcctgatcgccgccgccgccttctgcctggccaactacaccgtgaacaagcacttctggcccgagaccctggccgccttcaccggctacagcctgagcgagatcgtgccctgcctgagcgagctgcacaaggcctacctggacatcccccacagaccccagcaggccatcagagagaagtacaaggccagcaagtacctgtgcgtgagcctgatggagccccccgccgtgctgctgctgcagtag

SEQ ID NO: 10203 - DNA, 1266 bp, Artificial Sequence
  Description of Artificial Sequence: Synthetic coding sequence
atgcactgcagcaaccccaagagcggcgtggtgctggccaccgtggccagaggccccgacgcctgccagatcctgaccagagcccccctgggccaggaccccccccagagaaccgtgctgggcctgctgaccgccaacggccagtacagaagaacctgcggccagggcatcaccagaatcagatgctacagcggcagcgagaacgccttcccccccgccggcaagaaggccctgcccgactgcggcgtgcaggagccccccaagcagggcttcgacatctacatggacgagctggagcagggcgacagagacagctgcagcgtgagagagggcatggccttcgaggacgtgtacgaggtggacaccggcaccctgaagagcgacctgcacttcctgctggacttcaacaccgtgagccccatgctggtggacagcagcctgctgagccagagcgaggacatcagcagcctgggcaccgacgtgatcaacgtgaccgagtacgccgaggagatctaccagtacctgagagaggccgagatcagacacagacccaaggcccactacatgaagaagcagcccgacatcaccgagggcatgagaaccatcctggtggactggctggtggaggtgggcgaggagtacaagctgagagccgagaccctgtacctggccgtgaacttcctggacagattcctgagctgcatgagcgtgctgagaggcaagctgcagctggtgggcaccgccgccatgctgctggccagcaagtacgaggagatctacccccccgaggtggacgagttcgtgtacatcaccgacgacacctacaccaagagacagctgctgaagatggagcacctgctgctgaaggtgctggccttcgacctgaccgtgcccaccaccaaccagttcctgctgcagtacctgagaagacagggcgtgtgcgtgagaaccgagaacctggccaagtacgtggccgagctgagcctgctggaggccgaccccttcctgaagtacctgcccagcctgatcgccgccgccgccttctgcctggccaactacaccgtgaacaagcacttctggcccgagaccctggccgccttcaccggctacagcctgagcgagatcgtgccctgcctgagcgagctgcacaaggcctacctggacatcccccacagaccccagcaggccatcagagagaagtacaaggccagcaagtacctgtgcgtgagcctgatggagccccccgccgtgctgctgctgcagtag

SEQ ID NO: 10204 - DNA, 1266 bp, Artificial Sequence; identical to SEQ ID NO: 10203
  Description of Artificial Sequence: Synthetic coding sequence

SEQ ID NO: 10205 - DNA, 1299 bp, Artificial Sequence
  Description of Artificial Sequence: Synthetic coding sequence
atgctgggcaacagcgcccccggccccgccaccagagaggccggcagcgccctgctggccctgcagcagaccgccctgcaggaggaccaggagaacatcaaccccgagaaggccgcccccgtgcagcagcccagaaccagagccgccctggccgtgctgaagagcggcaaccccagaggcctggcccagcagcagagacccaagaccagaagagtggcccccctgaaggacctgcccgtgaacgacgagcacgtgaccgtgcccccctggaaggccaacagcaagcagcccgccttcaccatccacgtggacgaggccgagaaggaggcccagaagaagcccgccgagagccagaagatcgagagagaggacgccctggccttcaacagcgccatcagcctgcccggccccagaaagcccctggtgcccctggactaccccatggacggcagcttcgagagcccccacaccatggacatgagcatcatcctggaggacgagaagcccgtgagcgtgaacgaggtgcccgactaccacgaggacatccacacctacctgagagagatggaggtgaagtgcaagcccaaggtgggctacatgaagaagcagcccgacatcaccaacagcatgagagccatcctggtggactggctggtggaggtgggcgaggagtacaagctgcagaacgagaccctgcacctggccgtgaactacatcgacagattcctgagcagcatgagcgtgctgagaggcaagctgcagctggtgggcaccgccgccatgctgctggccagcaagttcgaggagatctacccccccgaggtggccgagttcgtgtacatcaccgacgacacctacaccaagaagcaggtgctgagaatggagcacctggtgctgaaggtgctgaccttcgacctggccgcccccaccgtgaaccagttcctgacccagtacttcctgcaccagcagcccgccaactgcaaggtggagagcctggccatgttcctgggcgagctgagcctgatcgacgccgacccctacctgaagtacctgcccagcgtgatcgccggcgccgccttccacctggccctgtacaccgtgaccggccagagctggcccgagagcctgatcagaaagaccggctacaccctggagagcctgaagccctgcctgatggacctgcaccagacctacctgaaggccccccagcacgcccagcagagcatcagagagaagtacaagaacagcaagtaccacggcgtgagcctgctgaacccccccgagaccctgaacctgtag

SEQ ID NO: 10206 - DNA, 1302 bp, Artificial Sequence
  Description of Artificial Sequence: Synthetic coding sequence
atggccctgagagtgaccagaaacagcaagatcaacgccgagaacaaggccaagatcaacatggccggcgccaagagagtgcccaccgcccccgccgccaccagcaagcccggcctgagacccagaaccgccctgggcgacatcggcaacaaggtgagcgagcagctgcaggccaagatgcccatgaagaaggaggccaagcccagcgccaccggcaaggtgatcgacaagaagctgcccaagcccctggagaaggtgcccatgctggtgcccgtgcccgtgagcgagcccgtgcccgagcccgagcccgagcccgagcccgagcccgtgaaggaggagaagctgagccccgagcccatcctggtggacaccgccagccccagccccatggagaccagcggctgcgcccccgccgaggaggacctgtgccaggccttcagcgacgtgatcctggccgtgaacgacgtggacgccgaggacggcgccgaccccaacctgtgcagcgagtacgtgaaggacatctacgcctacctgagacagctggaggaggagcaggccgtgagacccaagtacctgctgggcagagaggtgaccggcaacatgagagccatcctgatcgactggctggtgcaggtgcagatgaagttcagactgctgcaggagaccatgtacatgaccgtgagcatcatcgacagattcatgcagaacaactgcgtgcccaagaagatgctgcagctggtgggcgtgaccgccatgttcatcgccagcaagtacgaggagatgtacccccccgagatcggcgacttcgccttcgtgaccgacaacacctacaccaagcaccagatcagacagatggagatgaagatcctgagagccctgaacttcggcctgggcagacccctgcccctgcacttcctgagaagagccagcaagatcggcgaggtggacgtggagcagcacaccctggccaagtacctgatggagctgaccatgctggactacgacatggtgcacttcccccccagccagatcgccgccggcgccttctgcctggccctgaagatcctggacaacggcgagtggacccccaccctgcagcactacctgagctacaccgaggagagcctgctgcccgtgatgcagcacctggccaagaacgtggtgatggtgaaccagggcctgaccaagcacatgaccgtgaagaacaagtacgccaccagcaagcacgccaagatcagcaccctgccccagctgaacagcgccctggtgcaggacctggccaaggccgtggccaaggtgtag

SEQ ID NO: 10207 - DNA, 1191 bp, Artificial Sequence
  Description of Artificial Sequence: Synthetic coding sequence
atggccctgagagtgaccagaaacagcaagatcaacgccgagaacaaggccaagatcaacatggccggcgccaagagagtgcccaccgcccccgccgccaccagcaagcccggcctgagacccagaaccgccctgggcgacatcggcaacaaggtgagcgagcagctgcaggccaagatgcccatgaagaaggaggccaagcccagcgccaccggcaaggtgatcgacaagaagctgcccaagcccctggagaaggtgcccatgctggtgcccgtgcccgtgagcgagcccgtgcccgagcccgagcccgagcccgagcccgagcccgtgaaggaggagaagctgagccccgagcccatcctggtggacaccgccagccccagccccatggagaccagcggctgcgcccccgccgaggaggacctgtgccaggccttcagcgacgtgatcctggccgtgaacgacgtggacgccgaggacggcgccgaccccaacctgtgcagcgagtacgtgaaggacatctacgcctacctgagacagctggaggaggagcaggccgtgagacccaagtacctgctgggcagagaggtgaccggcaacatgagagccatcctgatcgactggctggtgcaggtgcagatgaagttcagactgctgcaggagaccatgtacatgaccgtgagcatcatcgacagattcatgcagaacaactgcgtgcccaagaagatgctgcagctggtgggcgtgaccgccatgttcatcgccagcaagtacgaggagatgtacccccccgagatcggcgacttcgccttcgtgaccgacaacacctacaccaagcaccagatcagacagatggagatgaagatcctgagagccctgaacttcggcctgggcagacccctgcccctgcacttcctgagaagagccagcaagatcggcgaggtggacgtggagcagcacaccctggccaagtacctgatggagctgaccatgctggactacgacatggtgcacttcccccccagccagatcgccgccggcgccttctgcctggccctgaagatcctggacaacggcgagtggaccgtgaagaacaagtacgccaccagcaagcacgccaagatcagcaccctgccccagctgaacagcgccctggtgcaggacctggccaaggccgtggccaaggtgtag

SEQ ID NO: 10208 - DNA, 1206 bp, Artificial Sequence
  Description of Artificial Sequence: Synthetic coding sequence
atggccctgagagtgaccagaaacagcaagatcaacgccgagaacaaggccaagatcaacatggccggcgccaagagagtgcccaccgcccccgccgccaccagcaagcccggcctgagacccagaaccgccctgggcgacatcggcaacaaggtgagcgagcagctgcaggccaagatgcccatgaagaaggaggccaagcccagcgccaccggcaaggtgatcgacaagaagctgcccaagcccctggagaaggtgcccatgctggtgcccgtgcccgtgagcgagcccgtgcccgagcccgagcccgagcccgagcccgagcccgtgaaggaggagaagctgagccccgagcccatcctggtggacaccgccagccccagccccatggagaccagcggctgcgcccccgccgaggaggacctgtgccaggccttcagcgacgtgatcctggccgtgaacgacgtggacgccgaggacggcgccgaccccaacctgtgcagcgagtacgtgaaggacatctacgcctacctgagacagctggaggaggagcaggccgtgagacccaagtacctgctgggcagagaggtgaccggcaacatgagagccatcctgatcgactggctggtgcaggtgcagatgaagttcagactgctgcaggagaccatgtacatgaccgtgagcatcatcgacagattcatgcagaacaactgcgtgcccaagaagatgctgcagctggtgggcgtgaccgccatgttcatcgccagcaagtacgaggagatgtacccccccgagatcggcgacttcgccttcgtgaccgacaacacctacaccaagcaccagatcagacagatggagatgaagatcctgagagccctgaacttcggcctgggcagacccctgcccctgcacttcctgagaagagccagcaagatcggcgaggtggacgtggagcagcacaccctggccaagtacctgatggagctgaccatgctggactacgacatggtgcacttcccccccagccagatcgccgccggcgccttctgcctggccctgaagatcctggacaacggcgagtggacccccaccctgcagcactacctgagctacaccgaggagagcctgctgcccgtgatgcagcacctggccaagaacgtggtgatggtgaaccagggcctgaccaagcacatggtgagccagtag

SEQ ID NO: 10209 - DNA, 1197 bp, Artificial Sequence
  Description of Artificial Sequence: Synthetic coding sequence
atggccctgctgagaagacccaccgtgagcagcgacctggagaacatcgacaccggcgtgaacagcaaggtgaagagccacgtgaccatcagaagaaccgtgctggaggagatcggcaacagagtgaccaccagagccgcccaggtggccaagaaggcccagaacaccaaggtgcccgtgcagcccaccaagaccaccaacgtgaacaagcagctgaagcccaccgccagcgtgaagcccgtgcagatggagaagctggcccccaagggccccagccccacccccgaggacgtgagcatgaaggaggagaacctgtgccaggccttcagcgacgccctgctgtgcaagatcgaggacatcgacaacgaggactgggagaacccccagctgtgcagcgactacgtgaaggacatctaccagtacctgagacagctggaggtgctgcagagcatcaacccccacttcctggacggcagagacatcaacggcagaatgagagccatcctggtggactggctggtgcaggtgcacagcaagttcagactgctgcaggagaccctgtacatgtgcgtgggcatcatggacagattcctgcaggtgcagcccgtgagcagaaagaagctgcagctggtgggcatcaccgccctgctgctggccagcaagtacgaggagatgttcagccccaacatcgaggacttcgtgtacatcaccgacaacgcctacaccagcagccagatcagagagatggagaccctgatcctgaaggagctgaagttcgagctgggcagacccctgcccctgcacttcctgagaagagccagcaaggccggcgaggtggacgtggagcagcacaccctggccaagtacctgatggagctgaccctgatcgactacgacatggtgcactaccaccccagcaaggtggccgccgccgccagctgcctgagccagaaggtgctgggccagggcaagtggaacctgaagcagcagtactacaccggctacaccgagaacgaggtgctggaggtgatgcagcacatggccaagaacgtggtgaaggtgaacgagaacctgaccaagttcatcgccatcaagaacaagtacgccagcagcaagctgctgaagatcagcatgatcccccagctgaacagcaaggccgtgaaggacctggccagccccctgatcggcagaagctag

SEQ ID NO: 10210 - DNA, 432 bp, Artificial Sequence
  Description of Artificial Sequence: Synthetic coding sequence
atggccggcaacttctggcagagcagccactacctgcagtggatcctggacaagcaggacctgctgaaggagagacagaaggacctgaagttcctgagcgaggaggagtactggaagctgcagatcttcttcaccaacgtgatccaggccctgggcgagcacctgaagctgagacagcaggtgatcgccaccgccaccgtgtacttcaagagattctacgccagatacagcctgaagagcatcgaccccgtgctgatggcccccacctgcgtgttcctggccagcaaggtggaggagttcggcgtggtgagcaacaccagactgatcgccgccgccaccagcgtgtgcaagtgcaagaagtacatctgcttcaaggacgtgatcctgaagaaggcccccgagtacatcgacttcttcttcttcagcctgtag

SEQ ID NO: 10211 - DNA, 852 bp, Artificial Sequence
  Description of Artificial Sequence: Synthetic coding sequence
atggccggcaacttctggcagagcagccactacctgcagtggatcctggacaagcaggacctgctgaaggagagacagaaggacctgaagttcctgagcgaggaggagtactggaagctgcagatcttcttcaccaacgtgatccaggccctgggcgagcacctgaagctgagacagcaggtgatcgccaccgccaccgtgtacttcaagagattctacgccagatacagcctgaagagcatcgaccccgtgctgatggcccccacctgcgtgttcctggccagcaaggtggaggagttcggcgtggtgagcaacaccagactgatcgccgccgccaccagcgtgctgaagaccagattcagctacgccttccccaaggagttcccctacagaatgaaccacatcctggagtgcgagttctacctgctggagctgatggactgctgcctgatcgtgtaccacccctacagacccctgctgcagtacgtgcaggacatgggccaggaggacatgctgctgcccctggcctggagaatcgtgaacgacacctacagaaccgacctgtgcctgctgtacccccccttcatgatcgccctggcctgcctgcacgtggcctgcgtggtgcagcagaaggacgccagacagtggttcgccgagctgagcgtggacatggagaagatcctggagatcatcagagtgatcctgaagctgtacgagcagtggaagaacttcgacgagagaaaggagatggccaccatcctgagcaagatgcccaagcccaagcccccccccaacagcgagggcgagcagggccccaacggcagccagaacagcagctacagccagagctag

SEQ ID NO: 10212 - DNA, 597 bp, Artificial Sequence
  Description of Artificial Sequence: Synthetic coding sequence
atggcccccacctgcgtgttcctggccagcaaggtggaggagttcggcgtggtgagcaacaccagactgatcgccgccgccaccagcgtgctgaagaccagattcagctacgccttccccaaggagttcccctacagaatgaaccacatcctggagtgcgagttctacctgctggagctgatggactgctgcctgatcgtgtaccacccctacagacccctgctgcagtacgtgcaggacatgggccaggaggacatgctgctgcccctggcctggagaatcgtgaacgacacctacagaaccgacctgtgcctgctgtacccccccttcatgatcgccctggcctgcctgcacgtggcctgcgtggtgcagcagaaggacgccagacagtggttcgccgagctgagcgtggacatggagaagatcctggagatcatcagagtgatcctgaagctgtacgagcagtggaagaacttcgacgagagaaaggagatggccaccatcctgagcaagatgcccaagcccaagcccccccccaacagcgagggcgagcagggccccaacggcagccagaacagcagctacagccagagctag

SEQ ID NO: 10213 - DNA, 597 bp, Artificial Sequence; identical to SEQ ID NO: 10212
  Description of Artificial Sequence: Synthetic coding sequence

SEQ ID NO: 10214 - DNA, 489 bp, Artificial Sequence
  Description of Artificial Sequence: Synthetic coding sequence
atggcccccacctgcgtgttcctggccagcaaggtggaggagttcggcgtggtgagcaacaccagactgatcgccgccgccaccagcgtgctgaagaccagattcagctacgccttccccaaggagttcccctacagaatgaaccacatcctggagtgcgagttctacctgctggagctgatggactgctgcctgatcgtgtaccacccctacagacccctgctgcagtacgtgcaggacatgggccaggaggacatgctgctgcccctggcctggagaatcgtgaacgacacctacagaaccgacctgtgcctgctgtacccccccttcatgatcgccctggcctgcctgcacgtggcctgcgtggtgcagcagaaggacgccagacagtggttcgccgagctgagcgtggacatggagaagatcctggagatcatcagagtgatcctgaagctgtacgagcagtggaagaacttcgacgagagatag

SEQ ID NO: 10215 - DNA, 2283 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaaggacttctacagaaccatcgcctggggcctgaacagacccctgttcgccgtgtacagaagagtgctgagaatgtacgacgacagaaaccacgtgggcaagtacacccccgaggagatcgagaagctgaaggagctgagaatcaagcacggcaacgactgggccaccatcggcgccgccctgggcagaagcgccagcagcgtgaaggacagatgcagactgatgaaggacacctgcaacaccggcaagtggaccgaggaggaggagaagagactggccgaggtggtgcacgagctgaccagcaccgagcccggcgacatcgtgacccagggcgtgagctgggccgccgtggccgagagagtgggcaccagaagcgagaagcagtgcagaagcaagtggctgaactacctgaactggaagcagagcggcggcaccgagtggaccaaggaggacgagatcaacctgatcctgagaatcgccgagctggacgtggccgacgagaacgacatcaactgggacctgctggccgagggctggagcagcgtgagaagcccccagtggctgagaagcaagtggtggaccatcaagagacagatcgccaaccacaaggacgtgagcttccccgtgctgatcaagggcctgaagcagctgcacgagaaccagaagaacaaccccaccctgctggagaacaagagcggcagcggcgtgcccaacagcaacaccaacagcagcgtgcagcacgtgcagatcagagtggccagactggaggacaacaccgccatcagcagcagccccatggccgccctgcagatccccgtgcagatcacccacgtgagcagcgccgacagccccgccaccgtggacagcgagaccatcaccctgaacagcggcaccctgcagaccttcgagatcctgcccagcttccacctgcagcccaccggcacccccggcacctacctgctgcagaccagcagcagccagggcctgcccctgaccctgaccgccagccccaccgtgaccctgaccgccgccgcccccgccagccccgagcagatcatcgtgcacgccctgagccccgagcacctgctgaacaccagcgacaacgtgaccgtgcagtgccacacccccagagtgatcatccagaccgtggccaccgaggacatcaccagcagcatcagccaggccgagctgaccgtggacagcgacatccagagcagcgacttccccgagccccccgacgccctggaggccgacaccttccccgacgagatccaccaccccaagatgaccgtggagcccagcttcaacgacgcccacgtgagcaagttcagcgaccagaacagcaccgagctgatgaacagcgtgatggtgagaaccgaggaggagatcagcgacaccgacctgaagcaggaggagagccccagcgacctggccagcgcctacgtgaccgagggcctggagagccccaccatcgaggagcaggtggaccagaccatcgacgacgagaccatcctgatcgtgcccagcccccacggcttcatccaggccagcgacgtgatcgacaccgagagcgtgctgcccctgaccaccctgaccgaccccatcctgcagcaccaccaggaggagagcaacatcatcggcagcagcctgggcagccccgtgagcgaggacagcaaggacgtggaggacctggtgaactgccactag

SEQ ID NO: 10216 - DNA, 858 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaaggacttctacagaaccatcgcctggggcctgaacagacccctgttcgccgtgtacagaagagtgctgagaatgtacgacgacagaaaccacgtgggcaagtacacccccgaggagatcgagaagctgaaggagaagaaggccatcgccgcctgcttcttcttcacccacagacagctgtggacccccaagaagggccacaccttcaagctgtggctgagcaagtactgctgcccccagctgcccaaccagagcaacggcaagaagaagaacgaggagtag

SEQ ID NO: 10217 - DNA, 2283 bp, Artificial Sequence; identical to SEQ ID NO: 10215
  Description of Artificial Sequence: Synthetic coding sequence

SEQ ID NO: 10218 - DNA, 735 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgtgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaaggacttctacagaaccatcgcctggggcctgaacagacccctgttcgccgtgtacagaagagtgctgagaatgtacgacgacagaaaccacgtgggcaagtacacccccgaggagatcgagaagctgaaggagaagaaggccatcgccgcctgcttcttcttcacccacagacagctgtggacccccaagaagggccacaccttcaagctgtggctgagcaagtactgctgcccccagctgcccaaccagagcaacggcaagaagaagaacgaggagtag

SEQ ID NO: 10219 - DNA, 819 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaaggacttctacagaaccatcgcctggggcctgaacagacccctgttcgccgtgtacagaagagtgctgagaatgtacgacgacagaaaccacgtgggcaagtacacccccgaggagatcgagaagctgaaggagcagctgtggacccccaagaagggccacaccttcaagctgtggctgagcaagtactgctgcccccagctgcccaaccagagcaacggcaagaagaagaacgaggagtag

SEQ ID NO: 10220 - DNA, 2073 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaaggacttctacagaaccatcgcctggggcctgaacagacccctgttcgccgtgtacagaagagtgctgagaatgtacgacgacagaaaccacgtgggcaagtacacccccgaggagatcgagaagctgaaggagctgagaatcaagcacggcaacgactgggccaccatcggcgccgccctgggcagaagcgccagcagcgtgaaggacagatgcagactgatgaaggacacctgcaacaccggcaagtggaccgaggaggaggagaagagactggccgaggtggtgcacgagctgaccagcaccgagcccggcgacatcgtgacccagggcgtgagctgggccgccgtggccgagagagtgggcaccagaagcgagaagcagtgcagaagcaagtggctgaactacctgaactggaagcagagcggcggcaccgagtggaccaaggaggacgagatcaacctgatcctgagaatcgccgagctggacgtggccgacgagaacgacatcaactgggacctgctggccgagggctggagcagcgtgagaagcccccagtggctgagaagcaagtggtggaccatcaagagacagatcgccaaccacaaggacgtgagcttccccgccagcgccgacagccccgccaccgtggacagcgagaccatcaccctgaacagcggcaccctgcagaccttcgagatcctgcccagcttccacctgcagcccaccggcacccccggcacctacctgctgcagaccagcagcagccagggcctgcccctgaccctgaccgccagccccaccgtgaccctgaccgccgccgcccccgccagccccgagcagatcatcgtgcacgccctgagccccgagcacctgctgaacaccagcgacaacgtgaccgtgcagtgccacacccccagagtgatcatccagaccgtggccaccgaggacatcaccagcagcatcagccaggccgagctgaccgtggacagcgacatccagagcagcgacttccccgagccccccgacgccctggaggccgacaccttccccgacgagatccaccaccccaagatgaccgtggagcccagcttcaacgacgcccacgtgagcaagttcagcgaccagaacagcaccgagctgatgaacagcgtgatggtgagaaccgaggaggagatcagcgacaccgacctgaagcaggaggagagccccagcgacctggccagcgcctacgtgaccgagggcctggagagccccaccatcgaggagcaggtggaccagaccatcgacgacgagaccatcctgatcgtgcccagcccccacggcttcatccaggccagcgacgtgatcgacaccgagagcgtgctgcccctgaccaccctgaccgaccccatcctgcagcaccaccaggaggagagcaacatcatcggcagcagcctgggcagccccgtgagcgaggacagcaaggacgtggaggacctggtgaactgccactag

SEQ ID NO: 10221 - DNA, 1485 bp, Artificial Sequence
  Description of Artificial Sequence: Synthetic coding sequence
atgaaggacacctgcaacaccggcaagtggaccgaggaggaggagaagagactggccgaggtggtgcacgagctgaccagcaccgagcccggcgacatcgtgacccagggcgtgagctgggccgccgtggccgagagagtgggcaccagaagcgagaagcagtgcagaagcaagtggctgaactacctgaactggaagcagagcggcggcaccgagtggaccaaggaggacgagatcaacctgatcctgagaatcgccgagctggacgtggccgacgagaacgacatcaactgggacctgctggccgagggctggagcagcgtgagaagcccccagtggctgagaagcaagtggtggaccatcaagagacagatcgccaaccacaaggacgtgagcttccccgtgctgatcaagggcctgaagcagctgcacgagaaccagaagaacaaccccaccctgctggagaacaagagcggcagcggcgtgcccaacagcaacaccaacagcagcgtgcagcacgtgcagatcagagtggccagactggaggacaacaccgccatcagcagcagccccatggccgccctgcagatccccgtgcagatcacccacgtgagcagcgccgacagccccgccaccgtggacagcgagaccatcaccctgaacagcggcaccctgcagaccttcgagatcctgcccagcttccacctgcagcccaccggcacccccggcacctacctgctgcagaccagcagcagccagggcctgcccctgaccctgaccgccagccccaccgtgaccctgaccgccgccgcccccgccagccccgagcagatcatcgtgcacgccctgagccccgagcacctgctgaacaccagcgacaacgtgaccgtgcagtgccacacccccagagtgatcatccagaccgtggccaccgaggacatcaccagcagcatcagccaggccgagctgaccgtggacagcgacatccagagcagcgacttccccgagccccccgacgccctggaggccgacaccttccccgacgagatccaccaccccaagatgaccgtggagcccagcttcaacgacgcccacgtgagcaagttcagcgaccagaacagcaccgagctgatgaacagcgtgatggtgagaaccgaggaggagatcagcgacaccgacctgaagcaggaggagagccccagcgacctggccagcgcctacgtgaccgagggcctggagagccccaccatcgaggagcaggtggaccagaccatcgacgacgagaccatcctgatcgtgcccagcccccacggcttcatccaggccagcgacgtgatcgacaccgagagcgtgctgcccctgaccaccctgaccgaccccatcctgcagcaccaccaggaggagagcaacatcatcggcagcagcctgggcagccccgtgagcgaggacagcaaggacgtggaggacctggtgaactgccactag

SEQ ID NO: 10222 - DNA, 111 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaactag

SEQ ID NO: 10223 - DNA, 33 bp, Artificial Sequence
  Description of Artificial Sequence: Synthetic coding sequence
atgaccgccaccaccgaggtggccgacgactag

SEQ ID NO: 10224 - DNA, 111 bp, Artificial Sequence; identical to SEQ ID NO: 10222
  Description of Artificial Sequence: Synthetic coding sequence

SEQ ID NO: 10225 - DNA, 735 bp, Artificial Sequence; identical to SEQ ID NO: 10218
  Description of Artificial Sequence: Synthetic coding sequence

SEQ ID NO: 10226 - DNA, 582 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaagtag

SEQ ID NO: 10227 - DNA, 84 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggctag

SEQ ID NO: 10228 - DNA, 444 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagtag

SEQ ID NO: 10229 - DNA, 222 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtgtag

SEQ ID NO: 10230 - DNA, 2019 bp, Artificial Sequence
  Description of Artificial Sequence: Synthetic coding sequence
atgaccgccaccaccgaggtggccgacgacgaggtgaccgagggcaccgtgacccagatccagatcctgcagaacgagcagctggacgagatcagccccctgggcaacgaggaggtgagcgccgtgagccaggcctggttcaccaccaaggaggacaaggacagcctgaccaacaagggccacaagtggaagcagggcatgtggagcaaggaggagatcgacatcctgatgaacaacatcgagagatacctgaaggccagaggcatcaaggacgccaccgagatcatcttcgagatgagcaaggacgagagaaaggacttctacagaaccatcgcctggggcctgaacagacccctgttcgccgtgtacagaagagtgctgagaatgtacgacgacagaaaccacgtgggcaagtacacccccgaggagatcgagaagctgaaggagctgagaatcaagcacggcaacgactgggccaccatcggcgccgccctgggcagaagcgccagcagcgtgaaggacagatgcagactgatgaaggacacctgcaacaccggcaagtggaccgaggaggaggagaagagactggccgaggtggtgcacgagctgaccagcaccgagcccggcgacatcgtgacccagggcgtgagctgggccgccgtggccgagagagtgggcaccagaagcgagaagcagtgcagaagcaagtggctgaactacctgaactggaagcagagcggcggcaccgagtggaccaaggaggacgagatcaacctgatcctgagaatcgccgagctggacgtggccgacgagaacgacatcaactgggacctgctggccgagggctggagcagcgtgagaagcccccagtggctgagaagcaagtggtggaccatcaagagacagatcgccaaccacaaggacgtgagcttccccgtgctgatcaagggcctgaagcagctgcacgagaaccagaagaacaaccccaccctgctggagaacaagagcggcagcggcgtgcccaacagcaacaccaacagcagcgtgcagcacgtgcagatcagagtggccagactggaggacaacaccgccatcagcagcagccccatggccgccctgcagatccccgtgcagatcacccacgtgagcagcgccgacagccccgccaccgtggacagcgagaccatcaccctgaacagcggcaccctgcagaccttcgagatcctgcccagcttccacctgcagcccaccggcacccccggcacctacctgctgcagaccagcagcagccagggcctgcccctgaccctgaccgccagccccaccgtgaccctgaccgccgccgcccccgccagccccgagcagatcatcgtgcacgccctgagccccgagcacctgctgaacaccagcgacaacgtgaccgtgcagtgccacacccccagagtgatcatccagaccgtggccaccgaggacatcaccagcagcatcagccaggccgagctgaccgtggacagcgacatccagagcagcgacttccccgagccccccgacgccctggaggccgacaccttccccgacgagatccaccaccccaagatgaccgtggagcccagcttcaacgacgcccacgtgagcaagttcagcgaccagaacagcaccgagctgatgaacagcgtgatggtgagaaccgaggaggagatcagcgacaccgacctgaagcaggaggagagccccagcgacctggccagcgcctacgtgaccgagggcctggagagccccaccatcgaggagcaggtggaccagaccatcgacgacgagaccatcctgatcgtgcccagcccccacggcttcatccaggccagcgacgtgatcgacaccgagagcgtgctgcccctgaccaccctgaccgaccccatcctgcagcaccaccaggaggagagcaacatcatcggcagcagcctgggcagccccgtgagcgaggacagcaaggacgtggaggacctggtgaactgccactag

SEQ ID NO: 10231 - DNA, 291 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggcctag

SEQ ID NO: 10232 - DNA, 171 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgtag

SEQ ID NO: 10233 - DNA, 858 bp, Artificial Sequence; identical to SEQ ID NO: 10216
  Description of Artificial Sequence: Synthetic coding sequence

SEQ ID NO: 10234 - DNA, 150 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagccctag

SEQ ID NO: 10235 - DNA, 330 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgccaccaccgaggtggccgacgacgaggtgaccgagggcaccgtgacccagatccagtag

SEQ ID NO: 10236 - DNA, 276 bp, Artificial Sequence
  Description of Artificial Sequence: Synthetic coding sequence
atgagcaccgtggaggaggacagcgacaccgtgaccgtggagaccgtgaacagcgtgaccctgacccaggacaccgagggcaacctgatcctgcactgcccccagaacgaggccgacgagatcgacagcgaggacagcatcgagcccccccacaagagactgtgcctgagcagcgaggacgaccagagcatcgacgacagcaccccctgcatcagcgtggtggccctgcccctgagcgagaacgaccagagcttcgaggtgaccatgaccgcctag

SEQ ID NO: 10237 - DNA, 1647 bp, Artificial Sequence
  Description of Artificial Sequence: Synthetic coding sequence
atggccaccggcgccaacgccacccccctggacttccccagcaagaagagaaagagaagcagatggaaccaggacaccatggagcagaagaccgtgatccccggcatgcccaccgtgatcccccccggcctgaccagagagcaggagagagcctacatcgtgcagctgcagatcgaggacctgaccagaaagctgagaaccggcgacctgggcatcccccccaaccccgaggacagaagccccagccccgagcccatctacaacagcgagggcaagagactgaacaccagagagttcagaaccagaaagaagctggaggaggagagacacaacctgatcaccgagatggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatggaccagtacctgggcagcacccccgtgggcagcggcgtgtacagactgcaccagggcaagggcatgatgccccccccccccatgggcatgatgcccccccccccccccccccccagcggccagcccccccccccccccagcggccccctgcccccctggcagcagcagcagcagcagcccccccccccccccccccccagcagcagcatggccagcagcacccccctgccctggcagcagagaagcctgcccgccgccgccatggccagagccatgagagtgagaaccttcagagcccactggtag

SEQ ID NO: 10238 - DNA, 486 bp, Artificial Sequence
  Description of Artificial Sequence: Synthetic coding sequence
atggagcaccagctgctgtgctgcgaggtggagaccatcagaagagcctaccccgacgccaacctgctgaacgacagagtgctgagagccatgctgaaggccgaggagacctgcgcccccagcgtgagctacttcaagtgcgtgcagaccttcgtggccctgtgcgccaccgacgtgaagttcatcagcaacccccccagcatggtggccgccggcagcgtggtggccgccgtgcagggcctgaacctgagaagccccaacaacttcctgagctactacagactgaccagattcctgagcagagtgatcaagtgcgaccccgactgcctgagagcctgccaggagcagatcgaggccctgctggagagcagcctgagacaggcccagcagaacatggaccccaaggccgccgaggaggaggaggaggaggaggaggaggtggacctggcctgcacccccaccgacgtgagagacgtggacatctag

SEQ ID NO: 10239 - DNA, 870 bp, Artificial Sequence
  Description of Artificial Sequence: Synthetic coding sequence
atggagctgctgtgccacgaggtggaccccgtgagaagagccgtgagagacagaaacctgctgagagacgacagagtgctgcagaacctgctgaccatcgaggagagatacctgccccagtgcagctacttcaagtgcgtgcagaaggacatccagccctacatgagaagaatggtggccacctggatgctggaggtgtgcgaggagcagaagtgcgaggaggaggtgttccccctggccatgaactacctggacagattcctggccggcgtgcccacccccaagagccacctgcagctgctgggcgccgtgtgcatgttcctggccagcaagctgaaggagaccagccccctgaccgccgagaagctgtgcatctacaccgacaacagcatcaagccccaggagctgctggagtgggagctggtggtgctgggcaagctgaagtggaacctggccgccgtgaccccccacgacttcatcgagcacatcctgagaaagctgccccagcagagagagaagctgagcctgatcagaaagcacgcccagaccttcatcgccctgtgcgccaccgacttcaagttcgccatgtacccccccagcatgatcgccaccggcagcgtgggcgccgccatctgcggcctgcagcaggacgaggaggtgagcagcctgacctgcgacgccctgaccgagctgctggccaagatcaccaacaccgacgtggactgcctgaaggcctgccaggagcagatcgaggccgtgctgctgaacagcctgcagcagtacagacaggaccagagagacggcagcaagagcgaggacgagctggaccaggccagcacccccaccgacgtgagagacatcgacctgtag

SEQ ID NO: 10240 - DNA, 729 bp, Artificial Sequence
  Description of Artificial Sequence: Synthetic coding sequence
atgaagagcgccggcggcagcggcagaagcctgctgcccagccccagagtgtgcgaggagcagagatgcgaggaggaggtgttccccctggccatgaactacctggacagatacctgagctgcgtgcccaccagaaaggcccagctgcagctgctgggcgccgtgtgcatgctgctggccagcaagctgagagagaccacccccctgaccatcgagaagctgtgcatctacaccgaccacgccgtgagccccagacagctgagagactgggaggtgctggtgctgggcaagctgaagtgggacctggccgccgtgatcgcccacgacttcctggccttcatcctgcacagactgagcctgcccagagacagacaggccctggtgaagaagcacgcccagaccttcctggccctgtgcgccaccgactacaccttcgccatgtacccccccagcatgatcgccaccggcagcatcggcgccgccgtgcagggcctgggcgcctgcagcatgagcggcgacgagctgaccgagctgctggccggcatcaccggcaccgaggtggactgcctgagagcctgccaggagcagatcgaggccgccctgagagagagcctgagagaggccagccagaccagcagcagccccgcccccaaggcccccagaggcagcagcagccagggccccagccagaccagcacccccaccgacgtgaccgccatccacctgtag

SEQ ID NO: 10241 - DNA, 636 bp, Artificial Sequence
  Description of Artificial Sequence: Synthetic coding sequence
atgaactacctggacagatacctgagctgcgtgcccaccagaaaggcccagctgcagctgctgggcgccgtgtgcatgctgctggccagcaagctgagagagaccacccccctgaccatcgagaagctgtgcatctacaccgaccacgccgtgagccccagacagctgagagactgggaggtgctggtgctgggcaagctgaagtgggacctggccgccgtgatcgcccacgacttcctggccttcatcctgcacagactgagcctgcccagagacagacaggccctggtgaagaagcacgcccagaccttcctggccctgtgcgccaccgactacaccttcgccatgtacccccccagcatgatcgccaccggcagcatcggcgccgccgtgcagggcctgggcgcctgcagcatgagcggcgacgagctgaccgagctgctggccggcatcaccggcaccgaggtggactgcctgagagcctgccaggagcagatcgaggccgccctgagagagagcctgagagaggccagccagaccagcagcagccccgcccccaaggcccccagaggcagcagcagccagggccccagccagaccagcacccccaccgacgtgaccgccatccacctgtag

SEQ ID NO: 10242 - DNA, 879 bp, Artificial Sequence
  Description of Artificial Sequence: Synthetic coding sequence
atggagctgctgtgctgcgagggcaccagacacgcccccagagccggccccgaccccagactgctgggcgaccagagagtgctgcagagcctgctgagactggaggagagatacgtgcccagagccagctacttccagtgcgtgcagagagagatcaagccccacatgagaaagatgctggcctactggatgctggaggtgtgcgaggagcagagatgcgaggaggaggtgttccccctggccatgaactacctggacagatacctgagctgcgtgcccaccagaaaggcccagctgcagctgctgggcgccgtgtgcatgctgctggccagcaagctgagagagaccacccccctgaccatcgagaagctgtgcatctacaccgaccacgccgtgagccccagacagctgagagactgggaggtgctggtgctgggcaagctgaagtgggacctggccgccgtgatcgcccacgacttcctggccttcatcctgcacagactgagcctgcccagagacagacaggccctggtgaagaagcacgcccagaccttcctggccctgtgcgccaccgactacaccttcgccatgtacccccccagcatgatcgccaccggcagcatcggcgccgccgtgcagggcctgggcgcctgcagcatgagcggcgacgagctgaccgagctgctggccggcatcaccggcaccgaggtggactgcctgagagcctgccaggagcagatcgaggccgccctgagagagagcctgagagaggccagccagaccagcagcagccccgcccccaaggcccccagaggcagcagcagccagggccccagccagaccagcacccccaccgacgtgaccgccatccacctgtag

SEQ ID NO: 10243 - DNA, 663 bp, Artificial Sequence
  Description of Artificial Sequence: Synthetic coding sequence
atggagctgctgtgctgcgagggcaccagacacgcccccagagccggccccgaccccagactgctgggcgaccagagagtgctgcagagcctgctgagactggaggagagatacgtgcccagagccagctacttccagtgcgtgcagagagagatcaagccccacatgagaaagatgctggcctactggatgctggaggactgggaggtgctggtgctgggcaagctgaagtgggacctggccgccgtgatcgcccacgacttcctggccttcatcctgcacagactgagcctgcccagagacagacaggccctggtgaagaagcacgcccagaccttcctggccctgtgcgccaccgactacaccttcgccatgtacccccccagcatgatcgccaccggcagcatcggcgccgccgtgcagggcctgggcgcctgcagcatgagcggcgacgagctgaccgagctgctggccggcatcaccggcaccgaggtggactgcctgagagcctgccaggagcagatcgaggccgccctgagagagagcctgagagaggccagccagaccagcagcagccccgcccccaaggcccccagaggcagcagcagccagggccccagccagaccagcacccccaccgacgtgaccgccatccacctgtag

SEQ ID NO: 10244 - DNA, 291 bp, Artificial Sequence
  Description of Artificial Sequence: Synthetic coding sequence
atgtacccccccagcatgatcgccaccggcagcatcggcgccgccgtgcagggcctgggcgcctgcagcatgagcggcgacgagctgaccgagctgctggccggcatcaccggcaccgaggtggactgcctgagagcctgccaggagcagatcgaggccgccctgagagagagcctgagagaggccagccagaccagcagcagccccgcccccaaggcccccagaggcagcagcagccagggccccagccagaccagcacccccaccgacgtgaccgccatccacctgtag

SEQ ID NO: 10245 - DNA, 132 bp, Artificial Sequence
  Description of Artificial Sequence: Synthetic coding sequence
atgaactacctggacagatacctgagctgcgtgcccaccagaaaggcccagctgcagctgctgggcgccgtgtgcatgctgctggccagcaagctgagagagaccacccccctgaccatcgagaagctgtag

SEQ ID NO: 10246 - DNA, 357 bp, Artificial Sequence
  Description of Artificial Sequence: Synthetic coding sequence
atgaactacctggacagatacctgagctgcgtgcccaccagaaaggcccagctgcagctgctgggcgccgtgtgcatgctgctggccagcaagctgagagagaccacccccctgaccatcgagaagctgtgcatctacaccgaccacgccgtgagccccagacagctgagagactgggaggtgctggtgctgggcaagctgaagtgggacctggccgccgtgatcgcccacgacttcctggccttcatcctgcacagactgagcctgcccagagacagacaggccctggtgaagaagcacgcccagaccttcctggccctgtgcgccaccgactacaccttcgccatgtacccctag

SEQ ID NO: 10247 - DNA, 33 bp, Artificial Sequence
  Description of Artificial Sequence: Synthetic coding sequence
atgtacccccccagcatgatcgccaccggctag

SEQ ID NO: 10248 - DNA, 636 bp, Artificial Sequence; identical to SEQ ID NO: 10241
  Description of Artificial Sequence: Synthetic coding sequence

SEQ ID NO: 10249 - DNA, 1233 bp, Artificial Sequence
  Description of Artificial Sequence: Synthetic coding sequence
atgcccagagagagaagagagagagacgccaaggagagagacaccatgaaggaggacggcggcgccgagttcagcgccagaagcagaaagagaaaggccaacgtgaccgtgttcctgcaggaccccgacgaggagatggccaagatcgacagaaccgccagagaccagtgcggcagccagccctgggacaacaacgccgtgtgcgccgacccctgcagcctgatccccacccccgacaaggaggacgacgacagagtgtaccccaacagcacctgcaagcccagaatcatcgcccccagcagaggcagccccctgcccgtgctgagctgggccaacagagaggaggtgtggaagatcatgctgaacaaggagaagacctacctgagagaccagcacttcctggagcagcaccccctgctgcagcccaagatgagagccatcctgctggactggctgatggaggtgtgcgaggtgtacaagctgcacagagagaccttctacctggcccaggacttcttcgacagatacatggccacccaggagaacgtggtgaagaccctgctgcagctgatcggcatcagcagcctgttcatcgccgccaagctggaggagatctacccccccaagctgcaccagttcgcctacgtgaccgacggcgcctgcagcggcgacgagatcctgaccatggagctgatgatcatgaaggccctgaagtggagactgagccccctgaccatcgtgagctggctgaacgtgtacatgcaggtggcctacctgaacgacctgcacgaggtgctgctgccccagtacccccagcagatcttcatccagatcgccgagctgctggacctgtgcgtgctggacgtggactgcctggagttcccctacggcatcctggccgccagcgccctgtaccacttcagcagcagcgagctgatgcagaaggtgagcggctaccagtggtgcgacatcgagaactgcgtgaagtggatggtgcccttcgccatggtgatcagagagaccggcagcagcaagctgaagcacttcagaggcgtggccgacgaggacgcccacaacatccagacccacagagacagcctggacctgctggacaaggccagagccaagaaggccatgctgagcgagcagaacagagccagccccctgcccagcggcctgctgacccccccccagagcggcaagaagcagagcagcggccccgagatggcctag

SEQ ID NO: 10250 - DNA, 1104 bp, Artificial Sequence
  Description of Artificial Sequence: Synthetic coding sequence
atgcccagagagagaagagagagagacgccaaggagagagacaccatgaaggaggacggcggcgccgagttcagcgccagaagcagaaagagaaaggccaacgtgaccgtgttcctgcaggaccccgacgaggagatggccaagatcgacagaaccgccagagaccagtgcggcagccagccctgggacaacaacgccgtgtgcgccgacccctgcagcctgatccccacccccgacaaggaggacgacgacagagtgtaccccaacagcacctgcaagcccagaatcatcgcccccagcagaggcagccccctgcccgtgctgagctgggccaacagagaggaggtgtggaagatcatgctgaacaaggagaagacctacctgagagaccagcacttcctggagcagcaccccctgctgcagcccaagatgagagccatcctgctggactggctgatggaggtgagcctgagcctgcccgagatctacccccccaagctgcaccagttcgcctacgtgaccgacggcgcctgcagcggcgacgagatcctgaccatggagctgatgatcatgaaggccctgaagtggagactgagccccctgaccatcgtgagctggctgaacgtgtacatgcaggtggcctacctgaacgacctgcacgaggtgctgctgccccagtacccccagcagatcttcatccagatcgccgagctgctggacctgtgcgtgctggacgtggactgcctggagttcccctacggcatcctggccgccagcgccctgtaccacttcagcagcagcgagctgatgcagaaggtgagcggctaccagtggtgcgacatcgagaactgcgtgaagtggatggtgcccttcgccatggtgatcagagagaccggcagcagcaagctgaagcacttcagaggcgtggccgacgaggacgcccacaacatccagacccacagagacagcctggacctgctggacaaggccagagccaagaaggccatgctgagcgagcagaacagagccagccccctgcccagcggcctgctgacccccccccagagcggcaagaagcagagcagcggccccgagatggcctag

SEQ ID NO: 10251 - DNA, 1188 bp, Artificial Sequence
  Description of Artificial Sequence: Synthetic coding sequence
atgaaggaggacggcggcgccgagttcagcgccagaagcagaaagagaaaggccaacgtgaccgtgttcctgcaggaccccgacgaggagatggccaagatcgacagaaccgccagagaccagtgcggcagccagccctgggacaacaacgccgtgtgcgccgacccctgcagcctgatccccacccccgacaaggaggacgacgacagagtgtaccccaacagcacctgcaagcccagaatcatcgcccccagcagaggcagccccctgcccgtgctgagctgggccaacagagaggaggtgtggaagatcatgctgaacaaggagaagacctacctgagagaccagcacttcctggagcagcaccccctgctgcagcccaagatgagagccatcctgctggactggctgatggaggtgtgcgaggtgtacaagctgcacagagagaccttctacctggcccaggacttcttcgacagatacatggccacccaggagaacgtggtgaagaccctgctgcagctgatcggcatcagcagcctgttcatcgccgccaagctggaggagatctacccccccaagctgcaccagttcgcctacgtgaccgacggcgcctgcagcggcgacgagatcctgaccatggagctgatgatcatgaaggccctgaagtggagactgagccccctgaccatcgtgagctggctgaacgtgtacatgcaggtggcctacctgaacgacctgcacgaggtgctgctgccccagtacccccagcagatcttcatccagatcgccgagctgctggacctgtgcgtgctggacgtggactgcctggagttcccctacggcatcctggccgccagcgccctgtaccacttcagcagcagcgagctgatgcagaaggtgagcggctaccagtggtgcgacatcgagaactgcgtgaagtggatggtgcccttcgccatggtgatcagagagaccggcagcagcaagctgaagcacttcagaggcgtggccgacgaggacgcccacaacatccagacccacagagacagcctggacctgctggacaaggccagagccaagaaggccatgctgagcgagcagaacagagccagccccctgcccagcggcctgctgacccccccccagagcggcaagaagcagagcagcggccccgagatggcctag

SEQ ID NO: 10252 - DNA, 2106 bp, Artificial Sequence
  Description of Artificial Sequence: Synthetic coding sequence
agaaccagctggcccagcgagctggccgccgagaagggcaacttcgaggccgccgtgaagctgggcatcgcctacctgtacaacgagggcctgagcgtgagcgacgaggccagagccgaggtgaacggcctgaaggccagcagattcttcagcctggccgagagactgaacgtgggcgccgcccccttcatctggctgttcatcagacccccctggagcgtgagcggcagctgctgcaaggccgtggtgcacgagagcctgagagccgagtgccagctgcagagaacccacaaggccagcatcctgcactgcctgggcagagtgctgagcctgttcgaggacgaggagaagcagcagcaggcccacgacctgttcgaggaggccgcccaccagggctgcctgaccagcagctacctgctgtgggagagcgacagaagaaccgacgtgagcgaccccggcagatgcctgcacagcttcagaaagctgagagactacgccgccaagggctgctgggaggcccagctgagcctggccaaggcctgcgccaacgccaaccagctgggcctggaggtgagagccagcagcgagatcgtgtgccagctgttccaggccagccaggccgtgagcaagcagcaggtgttcagcgtgcagaagggcctgaacgacaccatgagatacatcctgatcgactggctggtggaggtggccaccatgaaggacttcaccagcctgtgcctgcacctgaccgtggagtgcgtggacagatacctgagaagaagactggtgcccagatacagactgcagctgctgggcatcgcctgcatggtgatctgcaccagattcatcagcaaggagatcctgaccatcagagaggccgtgtggctgaccgacaacacctacaagtacgaggacctggtgagaatgatgggcgagatcgtgagcgccctggagggcaagatcagagtgcccaccgtggtggactacaaggaggtgctgctgaccctggtgcccgtggagctgagaacccagcacctgtgcagcttcctgtgcgagctgagcctgctgcacaccagcctgagcgcctacgcccccgccagactggccgccgccgccctgctgctggccagactgacccacggccagacccagccctggaccacccagctgtgggacctgaccggcttcagctacgaggacctgatcccctgcgtgctgagcctgcacaagaagtgcttccacgacgacgcccccaaggactacagacaggtgagcctgaccgccgtgaagcagagattcgaggacaagagatacggcgagatcagccaggaggaggtgctgagctacagccagctgtgcgccgccctgggcgtgacccaggacagccccgacccccccaccttcctgagcaccggcgagatccacgccttcctgagcagccccagcggcagaagaaccaagagaaagagagagaacagcctgcaggaggacagaggcagcttcgtgaccacccccaccgccgagctgagcagccaggaggagaccctgctgggcagcttcctggactggagcctggactgctgcagcggctacgagggcgaccaggagagcgagggcgagaaggagggcgacgtgaccgcccccagcggcatcctggacgtgaccgtggtgtacctgaaccccgagcagcactgctgccaggagagcagcgacgaggaggcctgccccgaggacaagggcccccaggacccccaggccctggccctggacacccagatccccgccacccccggccccaagcccctggtgagaaccagcagagagcccggcaaggacgtgaccaccagcggctacagcagcgtgagcaccgccagccccaccagcagcgtggacggcggcctgggcgccctgccccagcccaccagcgtgctgagcctggacagcgacagccacacccagccctgccaccaccaggccagaaagagctgcctgcagtgcagaccccccagcccccccgagagcagcgtgccccagcagcaggtgaagagaatcaacctgtgcatccacagcgaggaggaggacatgaacctgggcctggtgagactgtag

SEQ ID NO: 10253 - DNA, 2361 bp, Artificial Sequence
  Description of Artificial Sequence: Synthetic coding sequence
atgggcagcggcggcgtggtgcactgcagatgcgccaagtgcttctgctaccccaccaagagaagaatcagaagaagacccagaaacctgaccatcctgagcctgcccgaggacgtgctgttccacatcctgaagtggctgagcgtggaggacatcctggccgtgagagccgtgcacagccagctgaaggacctggtggacaaccacgccagcgtgtgggcctgcgccagcttccaggagctgtggcccagccccggcaacctgaagctgttcgagagagccgccgagaagggcaacttcgaggccgccgtgaagctgggcatcgcctacctgtacaacgagggcctgagcgtgagcgacgaggccagagccgaggtgaacggcctgaaggccagcagattcttcagcctggccgagagactgaacgtgggcgccgcccccttcatctggctgttcatcagacccccctggagcgtgagcggcagctgctgcaaggccgtggtgcacgagagcctgagagccgagtgccagctgcagagaacccacaaggccagcatcctgcactgcctgggcagagtgctgagcctgttcgaggacgaggagaagcagcagcaggcccacgacctgttcgaggaggccgcccaccagggctgcctgaccagcagctacctgctgtgggagagcgacagaagaaccgacgtgagcgaccccggcagatgcctgcacagcttcagaaagctgagagactacgccgccaagggctgctgggaggcccagctgagcctggccaaggcctgcgccaacgccaaccagctgggcctggaggtgagagccagcagcgagatcgtgtgccagctgttccaggccagccaggccgtgagcaagcagcaggtgttcagcgtgcagaagggcctgaacgacaccatgagatacatcctgatcgactggctggtggaggtggccaccatgaaggacttcaccagcctgtgcctgcacctgaccgtggagtgcgtggacagatacctgagaagaagactggtgcccagatacagactgcagctgctgggcatcgcctgcatggtgatctgcaccagattcatcagcaaggagatcctgaccatcagagaggccgtgtggctgaccgacaacacctacaagtacgaggacctggtgagaatgatgggcgagatcgtgagcgccctggagggcaagatcagagtgcccaccgtggtggactacaaggaggtgctgctgaccctggtgcccgtggagctgagaacccagcacctgtgcagcttcctgtgcgagctgagcctgctgcacaccagcctgagcgcctacgcccccgccagactggccgccgccgccctgctgctggccagactgacccacggccagacccagccctggaccacccagctgtgggacctgaccggcttcagctacgaggacctgatcccctgcgtgctgagcctgcacaagaagtgcttccacgacgacgcccccaaggactacagacaggtgagcctgaccgccgtgaagcagagattcgaggacaagagatacggcgagatcagccaggaggaggtgctgagctacagccagctgtgcgccgccctgggcgtgacccaggacagccccgacccccccaccttcctgagcaccggcgagatccacgccttcctgagcagccccagcggcagaagaaccaagagaaagagagagaacagcctgcaggaggacagaggcagcttcgtgaccacccccaccgccgagctgagcagccaggaggagaccctgctgggcagcttcctggactggagcctggactgctgcagcggctacgagggcgaccaggagagcgagggcgagaaggagggcgacgtgaccgcccccagcggcatcctggacgtgaccgtggtgtacctgaaccccgagcagcactgctgccaggagagcagcgacgaggaggcctgccccgaggacaagggcccccaggacccccaggccctggccctggacacccagatccccgccacccccggccccaagcccctggtgagaaccagcagagagcccggcaaggacgtgaccaccagcggctacagcagcgtgagcaccgccagccccaccagcagcgtggacggcggcctgggcgccctgccccagcccaccagcgtgctgagcctggacagcgacagccacacccagccctgccaccaccaggccagaaagagctgcctgcagtgcagaccccccagcccccccgagagcagcgtgccccagcagcaggtgaagagaatcaacctgtgcatccacagcgaggaggaggacatgaacctgggcctggtgagactgtag

SEQ ID NO: 10254 - DNA, 888 bp, Artificial Sequence
  Description of Artificial Sequence: Synthetic coding sequence
atgatcgaggtgctgaccaccaccgacagccagaagctgctgcaccagctgaacgccctgctggagcaggagagcagatgccagcccaaggtgtgcggcctgagactgatcgagagcgcccacgacaacggcctgagaatgaccgccagactgagagacttcgaggtgaaggacctgctgagcctgacccagttcttcggcttcgacaccgagaccttcagcctggccgtgaacctgctggacagattcctgagcaagatgaaggtgcagcccaagcacctgggctgcgtgggcctgagctgcttctacctggccgtgaagagcatcgaggaggagagaaacgtgcccctggccaccgacctgatcagaatcagccagtacagattcaccgtgagcgacctgatgagaatggagaagatcgtgctggagaaggtgtgctggaaggtgaaggccaccaccgccttccagttcctgcagctgtactacagcctgctgcaggagaacctgcccctggagagaagaaacagcatcaacttcgagagactggaggcccagctgaaggcctgccactgcagaatcatcttcagcaaggccaagcccagcgtgctggccctgagcatcatcgccctggagatccaggcccagaagtgcgtggagctgaccgagggcatcgagtgcctgcagaagcacagcaagatcaacggcagagacctgaccttctggcaggagctggtgagcaagtgcctgaccgagtacagcagcaacaagtgcagcaagcccaacgtgcagaagctgaagtggatcgtgagcggcagaaccgccagacagctgaagcacagctactacagaatcacccacctgcccaccatccccgagatggtgccctag

SEQ ID NO: 10255 - DNA, 888 bp, Artificial Sequence; identical to SEQ ID NO: 10254
  Description of Artificial Sequence: Synthetic coding sequence

SEQ ID NO: 10256 - DNA, 411 bp, Artificial Sequence
  Description of Artificial Sequence: Synthetic coding sequence
atgatcgaggtgctgaccaccaccgacagccagaagctgctgcaccagctgaacgccctgctggagcaggagagcagatgccagcccaaggtgtgcggcctgagactgatcgagagcgcccacgacaacggcctgagaatgaccgccagactgagagacttcgaggtgaaggacctgctgagcctgacccagttcttcggcttcgacaccgagaccttcagcctggccgtgaacctgctggacagattcctgagcaagatgaaggtgcagcccaagcacctgggctgcgtgggcctgagctgcttctacctggccgtgaagagcatcgaggaggagagaaacgtgcccctggccaccgacctgatcagaatcagccagtacagattcaccgtgagcgacctgatgagatag

SEQ ID NO: 10257 - DNA, 411 bp, Artificial Sequence; identical to SEQ ID NO: 10256
  Description of Artificial Sequence: Synthetic coding sequence

SEQ ID NO: 10258 - DNA, 504 bp, Artificial Sequence
  Description of Artificial Sequence: Synthetic coding sequence
atgagcgccaaggacctgatgagaatggagaagatcgtgctggagaaggtgtgctggaaggtgaaggccaccaccgccttccagttcctgcagctgtactacagcctgctgcaggagaacctgcccctggagagaagaaacagcatcaacttcgagagactggaggcccagctgaaggcctgccactgcagaatcatcttcagcaaggccaagcccagcgtgctggccctgagcatcatcgccctggagatccaggcccagaagtgcgtggagctgaccgagggcatcgagtgcctgcagaagcacagcaagatcaacggcagagacctgaccttctggcaggagctggtgagcaagtgcctgaccgagtacagcagcaacaagtgcagcaagcccaacgtgcagaagctgaagtggatcgtgagcggcagaaccgccagacagctgaagcacagctactacagaatcacccacctgcccaccatccccgagatggtgccctag

SEQ ID NO: 10259 - DNA, 348 bp, Artificial Sequence
  Description of Artificial Sequence: Synthetic coding sequence
atgatcgaggtgctgaccaccaccgacagccagaagctgctgcaccagctgaacgccctgctggagcaggagagcagatgccagcccaaggtgtgcggcctgagactgatcgagagcgcccacgacaacggcctgagaatgaccgccagactgagagacttcgaggtgaaggacctgctgagcctgacccagttcttcggcttcgacaccgagaccttcagcctggccgtgaacctgctggacagattcctgagcaagatgaaggtgcagcccaagcacctgggctgcgtgggcctgagctgcttctacctggccgtgaagagcatcgaggaggagagaaacgtgtag

SEQ ID NO: 10260 - DNA, 486 bp, Artificial Sequence
  Description of Artificial Sequence: Synthetic coding sequence
atgagaatggagaagatcgtgctggagaaggtgtgctggaaggtgaaggccaccaccgccttccagttcctgcagctgtactacagcctgctgcaggagaacctgcccctggagagaagaaacagcatcaacttcgagagactggaggcccagctgaaggcctgccactgcagaatcatcttcagcaaggccaagcccagcgtgctggccctgagcatcatcgccctggagatccaggcccagaagtgcgtggagctgaccgagggcatcgagtgcctgcagaagcacagcaagatcaacggcagagacctgaccttctggcaggagctggtgagcaagtgcctgaccgagtacagcagcaacaagtgcagcaagcccaacgtgcagaagctgaagtggatcgtgagcggcagaaccgccagacagctgaagcacagctactacagaatcacccacctgcccaccatccccgagatggtgccctag

SEQ ID NO: 10261 - DNA, 486 bp, Artificial Sequence; identical to SEQ ID NO: 10260
  Description of Artificial Sequence: Synthetic coding sequence

SEQ ID NO: 10262 - DNA, 105 bp, Artificial Sequence
  Description of Artificial Sequence: Synthetic coding sequence
atgatcgaggtgctgaccaccaccgacagccagaagctgctgcaccagctgaacgccctgctggagcaggagagcagatgccagcccaagagacacttcctgtag

SEQ ID NO: 10263 - DNA, 1035 bp, Artificial Sequence
  Description of Artificial Sequence: Synthetic coding sequence
atgaaggacctgggcgccgagcacctggccggccacgagggcgtgcagctgctgggcctgctgaacgtgtacctggagcaggaggagagattccagcccagagagaagggcctgagcctgatcgaggccacccccgagaacgacaacaccctgtgccccggcctgagaaacgccaaggtggaggacctgagaagcctggccaacttcttcggcagctgcaccgagaccttcgtgctggccgtgaacatcctggacagattcctggccctgatgaaggtgaagcccaagcacctgagctgcatcggcgtgtgcagcttcctgctggccgccagaatcgtggaggaggactgcaacatccccagcacccacgacgtgatcagaatcagccagtgcaagtgcaccgccagcgacatcaagagaatggagaagatcatcagcgagaagctgcactacgagctggaggccaccaccgccctgaacttcctgcacctgtaccacaccatcatcctgtgccacaccagcgagagaaaggagatcctgagcctggacaagctggaggcccagctgaaggcctgcaactgcagactgatcttcagcaaggccaagcccagcgtgctggccctgtgcctgctgaacctggaggtggagaccctgaagagcgtggagctgctggagatcctgctgctggtgaagaagcacagcaagatcaacgacaccgagttcttctactggagagagctggtgagcaagtgcctggccgagtacagcagccccgagtgctgcaagcccgacctgaagaagctggtgtggatcgtgagcagaagaaccgcccagaacctgcacaacagctactacagcgtgcccgagctgcccaccatccccgagggcggctgcttcgacgagagcgagagcgaggacagctgcgaggacatgagctgcggcgaggagagcctgagcagcagcccccccagcgaccaggagtgcaccttcttcttcaacttcaaggtggcccagaccctgtgcttccccagctag

SEQ ID NO: 10264 - DNA, 1035 bp, Artificial Sequence
  Description of Artificial Sequence: Synthetic coding sequence
atgaaggacctgggcgccgagcacctggccggccacgagggcgtgcagctgctgggcctgctgaacgtgtacctggagcaggaggagagattccagcccagagagaagggcctgagcctgatcgaggccacccccgagaacgacaacaccctgtgccccggcctgagaaacgccaaggtggaggacctgagaagcctggccaacttcttcggcagctgcaccgagaccttcgtgctggccgtgaacatcctggacagattcctggccctgatgaaggtgaagcccaagcacctgagctgcatcggcgtgtgcagcttcctgctggccgccagaatcgtggaggaggactgcaacatccccagcacccacgacgtgatcagaatcagccagtgcaagtgcaccgccagcgacatcaagagaatggagaagatcatcagcgagaagctgcactacgagctggaggccaccaccgccctgaacttcctgcacctgtaccacaccatcatcctgtgccacaccagcgagagaaaggagatcctgagcctggacaagctggaggcccagctgaaggcctgcaactgcagactgatcttcagcaaggccaagcccagcgtgctggccctgtgcctgctgaacctggaggtggagaccctgaagagcgtggagctgctggagatcctgctgctggtgaagaagcacagcaagatcaacgacaccgagttcttctactggagagagctggtgagcaagtgcctggccgagtacagcagccccgagtgctgcaagcccgacctgaagaagctggtgtggatcgtgagcagaagaaccgcccagaacctgcacaacagctactacagcgtgcccgagctgcccaccatccccgagggcggctgcttcgacgagagcgagagcagcgtggcccaggccggcgtgcagtggcccgacctgagcagcttccagcccccccccaccagattcaagagattcagctgcctgagcctgagaagcagctgggactacagcagctggacctag

SEQ ID NO: 10265 - DNA, 1035 bp, Artificial Sequence; identical to SEQ ID NO: 10263
  Description of Artificial Sequence: Synthetic coding sequence

SEQ ID NO: 10266 - DNA, 1035 bp, Artificial Sequence; identical to SEQ ID NO: 10263
  Description of Artificial Sequence: Synthetic coding sequence

SEQ ID NO: 10267 - DNA, 483 bp, Artificial Sequence
  Description of Artificial Sequence: Synthetic coding sequence
atgaaggacctgggcgccgagcacctggccggccacgagggcgtgcagctgctgggcctgctgaacgtgtacctggagcaggaggagagattccagcccagagagaagggcctgagcctgatcgaggccacccccgagaacgacaacaccctgtgccccggcctgagaaacgccaaggtggaggacctgagaagcctggccaacttcttcggcagctgcaccgagaccttcgtgctggccgtgaacatcctggacagattcctggccctgatgaaggtgaagcccaagcacctgagctgcatcggcgtgtgcagcttcctgctggccgccagaatcgtggaggaggactgcaacatccccagcacccacgacgtgatcagaatcagccagtgcaagtgcaccgccagcgacatcaagagaatggagaagatcatcagcgagaagctgcactacgagctggaggccaccaccgccctgaactag

SEQ ID NO: 10268 - DNA, 972 bp, Artificial Sequence
  Description of Artificial Sequence: Synthetic coding sequence
atgtaccacaacagcagccagaagagacactggaccttcagcagcgaggagcagctggccagactgagagccgacgccaacagaaagttcagatgcaaggccgtggccaacggcaaggtgctgcccaacgaccccgtgttcctggagccccacgaggagatgaccctgtgcaagtactacgagaagagactgctggagttctgcagcgtgttcaagcccgccatgcccagaagcgtggtgggcaccgcctgcatgtacttcaagagattctacctgaacaacagcgtgatggagtaccaccccagaatcatcatgctgacctgcgccttcctggcctgcaaggtggacgagttcaacgtgagcagcccccagttcgtgggcaacctgagagagagccccctgggccaggagaaggccctggagcagatcctggagtacgagctgctgctgatccagcagctgaacttccacctgatcgtgcacaacccctacagacccttcgagggcttcctgatcgacctgaagaccagataccccatcctggagaaccccgagatcctgagaaagaccgccgacgacttcctgaacagaatcgccctgaccgacgcctacctgctgtacacccccagccagatcgccctgaccgccatcctgagcagcgccagcagagccggcatcaccatggagagctacctgagcgagagcctgatgctgaaggagaacagaacctgcctgagccagctgctggacatcatgaagagcatgagaaacctggtgaagaagtacgagccccccagaagcgaggaggtggccgtgctgaagcagaagctggagagatgccacagcgccgagctggccctgaacgtgatcaccaagaagagaaagggctacgaggacgacgactacgtgagcaagaagagcaagcacgaggaggaggagtggaccgacgacgacctggtggagagcctgtag

SEQ ID NO: 10269 - DNA, 768 bp, Artificial Sequence
  Description of Artificial Sequence: Synthetic coding sequence
atgcccagaagcgtggtgggcaccgcctgcatgtacttcaagagattctacctgaacaacagcgtgatggagtaccaccccagaatcatcatgctgacctgcgccttcctggcctgcaaggtggacgagttcaacgtgagcagcccccagttcgtgggcaacctgagagagagccccctgggccaggagaaggccctggagcagatcctggagtacgagctgctgctgatccagcagctgaacttccacctgatcgtgcacaacccctacagacccttcgagggcttcctgatcgacctgaagaccagataccccatcctggagaaccccgagatcctgagaaagaccgccgacgacttcctgaacagaatcgccctgaccgacgcctacctgctgtacacccccagccagatcgccctgaccgccatcctgagcagcgccagcagagccggcatcaccatggagagctacctgagcgagagcctgatgctgaaggagaacagaacctgcctgagccagctgctggacatcatgaagagcatgagaaacctggtgaagaagtacgagccccccagaagcgaggaggtggccgtgctgaagcagaagctggagagatgccacagcgccgagctggccctgaacgtgatcaccaagaagagaaagggctacgaggacgacgactacgtgagcaagaagagcaagcacgaggaggtgtgcttcacccccaagatgaacagcaagctgttcctgctgtacatcctggtgtag

SEQ ID NO: 10270 - DNA, 750 bp, Artificial Sequence
  Description of Artificial Sequence: Synthetic coding sequence
atgcccagaagcgtggtgggcaccgcctgcatgtacttcaagagattctacctgaacaacagcgtgatggagtaccaccccagaatcatcatgctgacctgcgccttcctggcctgcaaggtggacgagttcaacgtgagcagcccccagttcgtgggcaacctgagagagagccccctgggccaggagaaggccctggagcagatcctggagtacgagctgctgctgatccagcagctgaacttccacctgatcgtgcacaacccctacagacccttcgagggcttcctgatcgacctgaagaccagataccccatcctggagaaccccgagatcctgagaaagaccgccgacgacttcctgaacagaatcgccctgaccgacgcctacctgctgtacacccccagccagatcgccctgaccgccatcctgagcagcgccagcagagccggcatcaccatggagagctacctgagcgagagcctgatgctgaaggagaacagaacctgcctgagccagctgctggacatcatgaagagcatgagaaacctggtgaagaagtacgagccccccagaagcgaggaggtggccgtgctgaagcagaagctggagagatgccacagcgccgagctggccctgaacgtgatcaccaagaagagaaagggctacgaggacgacgactacgtgagcaagaagagcaagcacgaggaggaggagtggaccgacgacgacctggtggagagcctgtag

SEQ ID NO: 10271 - DNA, 1053 bp, Artificial Sequence
  Description of Artificial Sequence: Synthetic coding sequence
atggtgaccccctgccccaccagccccagcagccccgccgccagagccggcagaagagacaacgaccagaacctgagagcccccgtgaagaagagcagaagacccagactgagaagaaagcagcccctgcaccccctgaacccctgccccctgcccggcgacagcggcatctgcgacctgttcgagagccccagcagcggcagcgacggcgccgagagccccagcgccgccagaggcggcagccccctgcccggccccgcccagcccgtggcccagctggacctgcagaccttcagagactacggccagagctgctacgccttcagaaaggcccaggagagccacttccaccccagagaggccctggccagacagccccaggtgaccgccgagagcagatgcaagctgctgagctggctgatccccgtgcacagacagttcggcctgagcttcgagagcctgtgcctgaccgtgaacaccctggacagattcctgaccaccacccccgtggccgccgactgcttccagctgctgggcgtgaccagcctgctgatcgcctgcaagcaggtggaggtgcacccccccagagtgaagcagctgctggccctgtgctgcggcgccttcagcagacagcagctgtgcaacctggagtgcatcgtgctgcacaagctgcacttcaccctgggcgcccccaccatcagcttcttcctggagcacttcacccacgccagagtggaggccggccaggccgaggccagcgaggccctggaggcccaggccctggccagaggcgtggccgagctgagcctggccgactacgccttcaccagctacagccccagcctgctggccatctgctgcctggccctggccgacagaatgctgagagtgagcagacccgtggacctgagactgggcgaccaccccgaggccgccctggaggactgcatgggcaagctgcagctgctggtggccatcaacagcaccagcctgacccacatgctgcccgtgcagatctgcgagaagtgcagcctgccccccagcagcaagtag

SEQ ID NO: 10272 - DNA, 2181 bp, Artificial Sequence
  Description of Artificial Sequence: Synthetic coding sequence
atggagggcgagagaaagaacaacaacaagagatggtacttcaccagagagcagctggagaacagccccagcagaagattcggcgtggaccccgacaaggagctgagctacagacagcaggccgccaacctgctgcaggacatgggccagagactgaacgtgagccagctgaccatcaacaccgccatcgtgtacatgcacagattctacatgatccagagcttcacccagttccccggcaacagcgtggcccccgccgccctgttcctggccgccaaggtggaggagcagcccaagaagctggagcacgtgatcaaggtggcccacacctgcctgcacccccaggagagcctgcccgacaccagaagcgaggcctacctgcagcaggtgcaggacctggtgatcctggagagcatcatcctgcagaccctgggcttcgagctgaccatcgaccacccccacacccacgtggtgaagtgcacccagctggtgagagccagcaaggacctggcccagaccagctacttcatggccaccaacagcctgcacctgaccaccttcagcctgcagtacaccccccccgtggtggcctgcgtgtgcatccacctggcctgcaagtggagcaactgggagatccccgtgagcaccgacggcaagcactggtgggagtacgtggacgccaccgtgaccctggagctgctggacgagctgacccacgagttcctgcagatcctggagaagacccccaacagactgaagagaatctggaactggagagcctgcgaggccgccaagaagaccaaggccgacgacagaggcaccgacgagaagaccagcgagcagaccatcctgaacatgatcagccagagcagcagcgacaccaccatcgccggcctgatgagcatgagcaccagcaccaccagcgccgtgcccagcctgcccgtgagcgaggagagcagcagcaacctgaccagcgtggagatgctgcccggcaagagatggctgagcagccagcccagcttcaagctggagcccacccagggccacagaaccagcgagaacctggccctgaccggcgtggaccacagcctgccccaggacggcagcaacgccttcatcagccagaagcagaacagcaagagcgtgcccagcgccaaggtgagcctgaaggagtacagagccaagcacgccgaggagctggccgcccagaagagacagctggagaacatggaggccaacgtgaagagccagtacgcctacgccgcccagaacctgctgagccaccacgacagccacagcagcgtgatcctgaagatgcccatcgagggcagcgagaaccccgagagacccttcctggagaaggccgacaagaccgccctgaagatgagaatccccgtggccggcggcgacaaggccgccagcagcaagcccgaggagatcaagatgagaatcaaggtgcacgccgccgccgacaagcacaacagcgtggaggacagcgtgaccaagagcagagagcacaaggagaagcacaagacccaccccagcaaccaccaccaccaccacaaccaccacagccacaagcacagccacagccagctgcccgtgggcaccggcaacaagagacccggcgaccccaagcacagcagccagaccagcaacctggcccacaagacctacagcctgagcagcagcttcagcagcagcagcagcaccagaaagagaggccccagcgaggagaccggcggcgccgtgttcgaccaccccgccaagatcgccaagagcaccaagagcagcagcctgaacttcagcttccccagcctgcccaccatgggccagatgcccggccacagcagcgacaccagcggcctgagcttcagccagcccagctgcaagaccagagtgccccacagcaagctggacaagggccccaccggcgccaacggccacaacaccacccagaccatcgactaccaggacaccgtgaacatgctgcacagcctgctgagcgcccagggcgtgcagcccacccagcccaccgccttcgagttcgtgagaccctacagcgactacctgaaccccagaagcggcggcatcagcagcagaagcggcaacaccgacaagcccagacccccccccctgcccagcgagccccccccccccctgccccccctgcccaagtag

SEQ ID NO: 10273 - DNA, 723 bp, Artificial Sequence
  Description of Artificial Sequence: Synthetic coding sequence
atggaggactacaccaagatcgagaagatcggcgagggcacctacggcgtggtgtacaagggcagacacaagaccaccggccaggtggtggccatgaagaagatcagactggagagcgaggaggagggcgtgcccagcaccgccatcagagagatcagcctgctgaaggagctgagacaccccaacatcgtgagcctgcaggacgtgctgatgcaggacagcagactgtacctgatcttcgagttcctgagcatggacctgaagaagtacctggacagcatcccccccggccagtacatggacagcagcctggtgaaggtggtgaccctgtggtacagaagccccgaggtgctgctgggcagcgccagatacagcacccccgtggacatctggagcatcggcaccatcttcgccgagctggccaccaagaagcccctgttccacggcgacagcgagatcgaccagctgttcagaatcttcagagccctgggcacccccaacaacgaggtgtggcccgaggtggagagcctgcaggactacaagaacaccttccccaagtggaagcccggcagcctggccagccacgtgaagaacctggacgagaacggcctggacctgctgagcaagatgctgatctacgaccccgccaagagaatcagcggcaagatggccctgaaccacccctacttcaacgacctggacaaccagatcaagaagatgtag

SEQ ID NO: 10274 - DNA, 723 bp, Artificial Sequence; identical to SEQ ID NO: 10273
  Description of Artificial Sequence: Synthetic coding sequence

SEQ ID NO: 10275 - DNA, 894 bp, Artificial Sequence
  Description of Artificial Sequence: Synthetic coding sequence
atggaggactacaccaagatcgagaagatcggcgagggcacctacggcgtggtgtacaagggcagacacaagaccaccggccaggtggtggccatgaagaagatcagactggagagcgaggaggagggcgtgcccagcaccgccatcagagagatcagcctgctgaaggagctgagacaccccaacatcgtgagcctgcaggacgtgctgatgcaggacagcagactgtacctgatcttcgagttcctgagcatggacctgaagaagtacctggacagcatcccccccggccagtacatggacagcagcctggtgaagagctacctgtaccagatcctgcagggcatcgtgttctgccacagcagaagagtgctgcacagagacctgaagccccagaacctgctgatcgacgacaagggcaccatcaagctggccgacttcggcctggccagagccttcggcatccccatcagagtgtacacccacgaggtggtgaccctgtggtacagaagccccgaggtgctgctgggcagcgccagatacagcacccccgtggacatctggagcatcggcaccatcttcgccgagctggccaccaagaagcccctgttccacggcgacagcgagatcgaccagctgttcagaatcttcagagccctgggcacccccaacaacgaggtgtggcccgaggtggagagcctgcaggactacaagaacaccttccccaagtggaagcccggcagcctggccagccacgtgaagaacctggacgagaacggcctggacctgctgagcaagatgctgatctacgaccccgccaagagaatcagcggcaagatggccctgaaccacccctacttcaacgacctggacaaccagatcaagaagatgtag

SEQ ID NO: 10276 - DNA, 894 bp, Artificial Sequence
  Description of Artificial Sequence: Synthetic coding sequence
atggaggactacaccaagatcgagaagatcggcgagggcacctacggcgtggtgtacaagggcagacacaagaccaccggccaggtggtggccatgaagaagatcagactggagagcgaggaggagggcgtgcccagcaccgccatcagagagatcagcctgctgaaggagctgagacaccccaacatcgtgagcctgcaggacgtgctgatgcaggacagcagactgtacctgatcttcgagttcctgagcatggacctgaagaagtacctggacagcatcccccccggccagtacatggacagcagcctggtgaagagctacctgtaccagatcctgcagggcatcgtgttctgccacagcagaagagtgctgcacagagacctgaagccccagaacctgctgatcgacgacaagggcaccatcaagctggccgacttcggcctggccagagccttcggcatccccatcagagtgtacacccacgaggccatcaccctgtggtacagaagccccgaggtgctgctgggcagcgccagatacagcacccccgtggacatctggagcatcggcaccatcttcgccgagctggccaccaagaagcccctgttccacggcgacagcgagatcgaccagctgttcagaatcttcagagccctgggcacccccaacaacgaggtgtggcccgaggtggagagcctgcaggactacaagaacaccttccccaagtggaagcccggcagcctggccagccacgtgaagaacctggacgagaacggcctggacctgctgagcaagatgctgatctacgaccccgccaagagaatcagcggcaagatggccctgaaccacccctacttcaacgacctggacaaccagatcaagaagatgtag

SEQ ID NO: 10277 - DNA, 570 bp, Artificial Sequence
  Description of Artificial Sequence: Synthetic coding sequence
atggaggactacaccaagatcgagaagatcggcgagggcacctacggcgtggtgtacaagggcagacacaagaccaccggccaggtggtggccatgaagaagatcagactggagagcgaggaggagggcgtgcccagcaccgccatcagagagatcagcctgctgaaggagctgagacaccccaacatcgtgagcctgcaggacgtgctgatgcaggacagcagactgtacctgatcttcgagttcctgagcatggacctgaagaagtacctggacagcatcccccccggccagtacatggacagcagcctggtgaagagctacctgtaccagatcctgcagggcatcgtgttctgccacagcagaagagtgctgcacagagacctgaagccccagaacctgctgatcgacgacaagggcaccatcaagctggccgacttcggcctggccagagccttcggcatccccatcagagtgtacacccacgaggccatcaccctgtggtacagaagccccgaggtgctgctgggcagcgccagatacagcacccccgtggacatctggagctag

SEQ ID NO: 10278 - DNA, 897 bp, Artificial Sequence
  Description of Artificial Sequence: Synthetic coding sequence
atggagaacttccagaaggtggagaagatcggcgagggcacctacggcgtggtgtacaaggccagaaacaagctgaccggcgaggtggtggccctgaagaagatcagactggacaccgagaccgagggcgtgcccagcaccgccatcagagagatcagcctgctgaaggagctgaaccaccccaacatcgtgaagctgctggacgtgatccacaccgagaacaagctgtacctggtgttcgagttcctgcaccaggacctgaagaagttcatggacgccagcgccctgaccggcatccccctgcccctgatcaagagctacctgttccagctgctgcagggcctggccttctgccacagccacagagtgctgcacagagacctgaagccccagaacctgctgatcaacaccgagggcgccatcaagctggccgacttcggcctggccagagccttcggcgtgcccgtgagaacctacacccacgaggtggtgaccctgtggtacagagcccccgagatcctgctgggctgcaagtactacagcaccgccgtggacatctggagcctgggctgcatcttcgccgagatggtgaccagaagagccctgttccccggcgacagcgagatcgaccagctgttcagaatcttcagaaccctgggcacccccgacgaggtggtgtggcccggcgtgaccagcatgcccgactacaagcccagcttccccaagtgggccagacaggacttcagcaaggtggtgccccccctggacgaggacggcagaagcctgctgagccagatgctgcactacgaccccaacaagagaatcagcgccaaggccgccctggcccaccccttcttccaggacgtgaccaagcccgtgccccacctgagactgtag

SEQ ID NO: 10279 - DNA, 795 bp, Artificial Sequence
  Description of Artificial Sequence: Synthetic coding sequence
atggagaacttccagaaggtggagaagatcggcgagggcacctacggcgtggtgtacaaggccagaaacaagctgaccggcgaggtggtggccctgaagaagatcagactggacaccgagaccgagggcgtgcccagcaccgccatcagagagatcagcctgctgaaggagctgaaccaccccaacatcgtgaagctgctggacgtgatccacaccgagaacaagctgtacctggtgttcgagttcctgcaccaggacctgaagaagttcatggacgccagcgccctgaccggcatccccctgcccctgatcaagagctacctgttccagctgctgcagggcctggccttctgccacagccacagagtgctgcacagagacctgaagccccagaacctgctgatcaacaccgagggcgccatcaagctggccgacttcggcctggccagagccttcggcgtgcccgtgagaacctacacccacgaggtgaccagaagagccctgttccccggcgacagcgagatcgaccagctgttcagaatcttcagaaccctgggcacccccgacgaggtggtgtggcccggcgtgaccagcatgcccgactacaagcccagcttccccaagtgggccagacaggacttcagcaaggtggtgccccccctggacgaggacggcagaagcctgctgagccagatgctgcactacgaccccaacaagagaatcagcgccaaggccgccctggcccaccccttcttccaggacgtgaccaagcccgtgccccacctgagactgtag

SEQ ID NO: 10280 - DNA, 348 bp, Artificial Sequence
  Description of Artificial Sequence: Synthetic coding sequence
atgagctacaagcccaacctggccgcccacatgcccgccgccgccctgaacgccgccggcagcgtgcacagccccagcaccagcatggccaccagcagccagtacagacagctgctgagcgactacggcccccccagcctgggctacacccagggcaccggcaacagccaggtgccccagagcaagtacgccgagctgctggccatcatcgaggagctgggcaaggagatcagacccacctacgccggcagcaagagcgccatggagagactgaagagaggcatcatccacgccagaggcctggtgagagagtgcctggccgagaccgagagaaacgccagaagctag

SEQ ID NO: 10281 - DNA, 912 bp, Artificial Sequence
  Description of Artificial Sequence: Synthetic coding sequence
atggccaccagcagatacgagcccgtggccgagatcggcgtgggcgcctacggcaccgtgtacaaggccagagacccccacagcggccacttcgtggccctgaagagcgtgagagtgcccaacggcggcggcggcggcggcggcctgcccatcagcaccgtgagagaggtggccctgctgagaagactggaggccttcgagcaccccaacgtggtgagactgatggacgtgtgcgccaccagcagaaccgacagagagatcaaggtgaccctggtgttcgagcacgtggaccaggacctgagaacctacctggacaaggcccccccccccggcctgcccgccgagaccatcaaggacctgatgagacagttcctgagaggcctggacttcctgcacgccaactgcatcgtgcacagagacctgaagcccgagaacatcctggtgaccagcggcggcaccgtgaagctggccgacttcggcctggccagaatctacagctaccagatggccctgacccccgtggtggtgaccctgtggtacagagcccccgaggtgctgctgcagagcacctacgccacccccgtggacatgtggagcgtgggctgcatcttcgccgagatgttcagaagaaagcccctgttctgcggcaacagcgaggccgaccagctgggcaagatcttcgacctgatcggcctgccccccgaggacgactggcccagagacgtgagcctgcccagaggcgccttcccccccagaggccccagacccgtgcagagcgtggtgcccgagatggaggagagcggcgcccagctgctgctggagatgctgaccttcaacccccacaagagaatcagcgccttcagagccctgcagcacagctacctgcacaaggacgagggcaaccccgagtag

SEQ ID NO: 10282 - DNA, 336 bp, Artificial Sequence
  Description of Artificial Sequence: Synthetic coding sequence
atggccaccagcagatacgagcccgtggccgagatcggcgtgggcgcctacggcaccgtgtacaaggccagagacccccacagcggccacttcgtggccctgaagagcgtgagagtgcccaacggcggcggcggcggcggcggcctgcccatcagcaccgtgagagaggtggccctgctgagaagactggaggccttcgagcaccccaacgtggtgagactgatggacgtgtgcgccaccagcagaaccgacagagagatcaagagatgcttcgtggagagcctgagcagcgtggagaccctgaagcccaccagctgggccaagagcctgacctag

SEQ ID NO: 10283 - DNA, 552 bp, Artificial Sequence
  Description of Artificial Sequence: Synthetic coding sequence
atgagacagttcctgagaggcctggacttcctgcacgccaactgcatcgtgcacagagacctgaagcccgagaacatcctggtgaccagcggcggcaccgtgaagctggccgacttcggcctggccagaatctacagctaccagatggccctgacccccgtggtggtgaccctgtggtacagagcccccgaggtgctgctgcagagcacctacgccacccccgtggacatgtggagcgtgggctgcatcttcgccgagatgttcagaagaaagcccctgttctgcggcaacagcgaggccgaccagctgggcaagatcttcgacctgatcggcctgccccccgaggacgactggcccagagacgtgagcctgcccagaggcgccttcccccccagaggccccagacccgtgcagagcgtggtgcccgagatggaggagagcggcgcccagctgctgctggagatgctgaccttcaacccccacaagagaatcagcgccttcagagccctgcagcacagctacctgcacaaggacgagggcaaccccgagtag

SEQ ID NO: 10284 - DNA, 9 bp, Artificial Sequence
  Description of Artificial Sequence: Synthetic coding sequence
atggcctag

SEQ ID NO: 10285 - DNA, 612 bp, Artificial Sequence
  Description of Artificial Sequence: Synthetic coding sequence
atggccaccagcagatacgagcccgtggccgagatcggcgtgggcgcctacggcaccgtgtacaaggccagagacccccacagcggccacttcgtggccctgaagagcgtgagagtgcccaacggcggcggcggcggcggcggcctgcccatcagcaccgtgagagaggtggccctgctgagaagactggaggccttcgagcaccccaacgtggtgagactgatggacgtgtgcgccaccagcagaaccgacagagagatcaaggtgaccctggtgttcgagcacgtggaccaggacctgagaacctacctggacaaggcccccccccccggcctgcccgccgagaccatcaaggacctgatgagacagttcctgagaggcctggacttcctgcacgccaactgcatcgtgcacagagacctgaagcccgagaacatcctggtgaccagcggcggcaccgtgaagctggccgacttcggcctggccagaatctacagctaccagatggccctgacccccgtggtggtgaccctgtggtacagagcccccgaggtgctgctgcagagcacctacgccacccccgtggacatgtggagcgtgggctgcatctag

SEQ ID NO: 10286 - DNA, 513 bp, Artificial Sequence
  Description of Artificial Sequence: Synthetic coding sequence
atggccaccagcagatacgagcccgtggccgagatcggcgtgggcgcctacggcaccgtgtacaaggccagagacccccacagcggccacttcgtggccctgaagagcgtgagagtgcccaacggcggcggcggcggcggcggcctgcccatcagcaccgtgagagaggtggccctgctgagaagactggaggccttcgagcaccccaacgtggtgagactgatggacgtgtgcgccaccagcagaaccgacagagagatcaaggtgaccctggtgttcgagcacgtggaccaggacctgagaacctacctggacaaggcccccccccccggcctgcccgccgagaccatcaaggacctgatgagacagttcctgagaggcctggacttcctgcacgccaactgcatcgtgcacagagacctgaagcccgagaacatcctggtgaccagcggcggcaccgtgaagctggccgacttcggcctggccagaatctacagctaccagatggcctag

SEQ ID NO: 10287 - DNA, 348 bp, Artificial Sequence
  Description of Artificial Sequence: Synthetic coding sequence
atggccaccagcagatacgagcccgtggccgagatcggcgtgggcgcctacggcaccgtgtacaaggccagagacccccacagcggccacttcgtggccctgaagagcgtgagagtgcccaacggcggcggcggcggcggcggcctgcccatcagcaccgtgagagaggtggccctgctgagaagactggaggccttcgagcaccccaacgtggtgagactgatggacgtgtgcgccaccagcagaaccgacagagagatcaaggtgaccctggtgttcgagcacgtggaccaggacctgagaacctacctggacaaggcccccccccccggcctgcccgccgagtag

SEQ ID NO: 10288 - DNA, 924 bp, Artificial Sequence
  Description of Artificial Sequence: Synthetic coding sequence
atgggcaccgtgctgagcctgagccccagctacagaaaggccaccctgttcgaggacggcgccgccaccgtgggccactacaccgccgtgcagaacagcaagaacgccaaggacaagaacctgaagagacacagcatcatcagcgtgctgccctggaagagaatcgtggccgtgagcgccaagaagaagaacagcaagaaggtgcagcccaacagcagctaccagaacaacatcacccacctgaacaacgagaacctgaagaagagcctgagctgcgccaacctgagcaccttcgcccagcccccccccgcccagccccccgccccccccgccagccagctgagcggcagccagaccggcggcagcagcagcgtgaagaaggccccccaccccgccgtgaccagcgccggcacccccaagagagtgatcgtgcaggccagcaccagcgagctgctgagatgcctgggcgagttcctgtgcagaagatgctacagactgaagcacctgagccccaccgaccccgtgctgtggctgagaagcgtggacagaagcctgctgctgcagggctggcaggaccagggcttcatcacccccgccaacgtggtgttcctgtacatgctgtgcagagacgtgatcagcagcgaggtgggcagcgaccacgagctgcaggccgtgctgctgacctgcctgtacctgagctacagctacatgggcaacgagatcagctaccccctgaagcccttcctggtggagagctgcaaggaggccttctgggacagatgcctgagcgtgatcaacctgatgagcagcaagatgctgcagatcaacgccgacccccactacttcacccaggtgttcagcgacctgaagaacgagagcggccaggaggacaagaagagactgctgctgggcctggacagatag

SEQ ID NO: 10289 - DNA, 981 bp, Artificial Sequence
  Description of Artificial Sequence: Synthetic coding sequence
atggagaaggacggcctgtgcagagccgaccagcagtacgagtgcgtggccgagatcggcgagggcgcctacggcaaggtgttcaaggccagagacctgaagaacggcggcagattcgtggccctgaagagagtgagagtgcagaccggcgaggagggcatgcccctgagcaccatcagagaggtggccgtgctgagacacctggagaccttcgagcaccccaacgtggtgagactgttcgacgtgtgcaccgtgagcagaaccgacagagagaccaagctgaccctggtgttcgagcacgtggaccaggacctgaccacctacctggacaaggtgcccgagcccggcgtgcccaccgagaccatcaaggacatgatgttccagctgctgagaggcctggacttcctgcacagccacagagtggtgcacagagacctgaagccccagaacatcctggtgaccagcagcggccagatcaagctggccgacttcggcctggccagaatctacagcttccagatggccctgaccagcgtggtggtgaccctgtggtacagagcccccgaggtgctgctgcagagcagctacgccacccccgtggacctgtggagcgtgggctgcatcttcgccgagatgttcagaagaaagcccctgttcagaggcagcagcgacgtggaccagctgggcaagatcctggacgtgatcggcctgcccggcgaggaggactggcccagagacgtggccctgcccagacaggccttccacagcaagagcgcccagcccatcgagaagttcgtgaccgacatcgacgagctgggcaaggacctgctgctgaagtgcctgaccttcaaccccgccaagagaatcagcgcctacagcgccctgagccacccctacttccaggacctggagagatgcaaggagaacctggacagccacctgccccccagccagaacaccagcgagctgaacaccgcctag

SEQ ID NO: 10290 - DNA, 981 bp, Artificial Sequence; identical to SEQ ID NO: 10289
  Description of Artificial Sequence: Synthetic coding sequence

SEQ ID NO: 10291 - DNA, 1041 bp, Artificial Sequence
  Description of Artificial Sequence: Synthetic coding sequence
atggccctggacgtgaagagcagagccaagagatacgagaagctggacttcctgggcgagggccagttcgccaccgtgtacaaggccagagacaagaacaccaaccagatcgtggccatcaagaagatcaagctgggccacagaagcgaggccaaggacggcatcaacagaaccgccctgagagagatcaagctgctgcaggagctgagccaccccaacatcatcggcctgctggacgccttcggccacaagagcaacatcagcctggtgttcgacttcatggagaccgacctggaggtgatcatcaaggacaacagcctggtgctgacccccagccacatcaaggcctacatgctgatgaccctgcagggcctggagtacctgcaccagcactggatcctgcacagagacctgaagcccaacaacctgctgctggacgagaacggcgtgctgaagctggccgacttcggcctggccaagagcttcggcagccccaacagagcctacacccaccaggtggtgaccagatggtacagagcccccgagctgctgttcggcgccagaatgtacggcgtgggcgtggacatgtgggccgtgggctgcatcctggccgagctgctgctgagagtgcccttcctgcccggcgacagcgacctggaccagctgaccagaatcttcgagaccctgggcacccccaccgaggagcagtggcccgacatgtgcagcctgcccgactacgtgaccttcaagagcttccccggcatccccctgcaccacatcttcagcgccgccggcgacgacctgctggacctgatccagggcctgttcctgttcaacccctgcgccagaatcaccgccacccaggccctgaagatgaagtacttcagcaacagacccggccccacccccggctgccagctgcccagacccaactgccccgtggagaccctgaaggagcagagcaaccccgccctggccatcaagagaaagagaaccgaggccctggagcagggcggcctgcccaagaagctgatcttctag

SEQ ID NO: 10292 - DNA, 1395 bp, Artificial Sequence
  Description of Artificial Sequence: Synthetic coding sequence
atggactacgacttcaaggtgaagctgagcagcgagagagagagagtggaggacctgttcgagtacgagggctgcaaggtgggcagaggcacctacggccacgtgtacaaggccaagagaaaggacggcaaggacgacaaggactacgccctgaagcagatcgagggcaccggcatcagcatgagcgcctgcagagagatcgccctgctgagagagctgaagcaccccaacgtgatcagcctgcagaaggtgttcctgagccacgccgacagaaaggtgtggctgctgttcgactacgccgagcacgacctgtggcacatcatcaagttccacagagccagcaaggccaacaagaagcccgtgcagctgcccagaggcatggtgaagagcctgctgtaccagatcctggacggcatccactacctgcacgccaactgggtgctgcacagagacctgaagcccgccaacatcctggtgatgggcgagggccccgagagaggcagagtgaagatcgccgacatgggcttcgccagactgttcaacagccccctgaagcccctggccgacctggaccccgtggtggtgaccttctggtacagagcccccgagctgctgctgggcgccagacactacaccaaggccatcgacatctgggccatcggctgcatcttcgccgagctgctgaccagcgagcccatcttccactgcagacaggaggacatcaagaccagcaacccctaccaccacgaccagctggacagaatcttcaacgtgatgggcttccccgccgacaaggactgggaggacatcaagaagatgcccgagcacagcaccctgatgaaggacttcagaagaaacacctacaccaactgcagcctgatcaagtacatggagaagcacaaggtgaagcccgacagcaaggccttccacctgctgcagaagctgctgaccatggaccccatcaagagaatcaccagcgagcaggccatgcaggacccctacttcctggaggaccccctgcccaccagcgacgtgttcgccggctgccagatcccctaccccaagagagagttcctgaccgaggaggagcccgacgacaagggcgacaagaagaaccagcagcagcagcagggcaacaaccacaccaacggcaccggccaccccggcaaccaggacagcagccacacccagggcccccccctgaagaaggtgagagtggtgccccccaccaccaccagcggcggcctgatcatgaccagcgactaccagagaagcaacccccacgccgcctaccccaaccccggccccagcaccagccagccccagagcagcatgggctacagcgccaccagccagcagcccccccagtacagccaccagacccacagatactag

SEQ ID NO: 10293 - DNA, 495 bp, Artificial Sequence
  Description of Artificial Sequence: Synthetic coding sequence
atggactacgacttcaaggtgaagctgagcagcgagagagagagagtggaggacctgttcgagtacgagggctgcaaggtgggcagaggcacctacggccacgtgtacaaggccaagagaaaggacggcaaggacgacaaggactacgccctgaagcagatcgagggcaccggcatcagcatgagcgcctgcagagagatcgccctgctgagagagctgaagcaccccaacgtgatcagcctgcagaaggtgttcctgagccacgccgacagaaaggtgtggctgctgttcgactacgccgagcacgacctgtggcacatcatcaagttccacagagccagcaaggccaacaagaagcccgtgcagctgcccagaggcatggtgaagagcctgctgtaccagatcctggacggcatccactacctgcacgccaactgggtgctgcacagagacctgctgacctgggccctgcccgactacctgatccacctgtag

SEQ ID NO: 10294 - DNA, 1119 bp, Artificial Sequence
  Description of Artificial Sequence: Synthetic coding sequence
atggccaagcagtacgacagcgtggagtgccccttctgcgacgaggtgagcaagtacgagaagctggccaagatcggccagggcaccttcggcgaggtgttcaaggccagacacagaaagaccggccagaaggtggccctgaagaaggtgctgatggagaacgagaaggagggcttccccatcaccgccctgagagagatcaagatcctgcagctgctgaagcacgagaacgtggtgaacctgatcgagatctgcagaaccaaggccagcccctacaacagatgcaagggcagcatctacctggtgttcgacttctgcgagcacgacctggccggcctgctgagcaacgtgctggtgaagttcaccctgagcgagatcaagagagtgatgcagatgctgctgaacggcctgtactacatccacagaaacaagatcctgcacagagacatgaaggccgccaacgtgctgatcaccagagacggcgtgctgaagctggccgacttcggcctggccagagccttcagcctggccaagaacagccagcccaacagatacaccaacagagtggtgaccctgtggtacagaccccccgagctgctgctgggcgagagagactacggcccccccatcgacctgtggggcgccggctgcatcatggccgagatgtggaccagaagccccatcatgcagggcaacaccgagcagcaccagctggccctgatcagccagctgtgcggcagcatcacccccgaggtgtggcccaacgtggacaactacgagctgtacgagaagctggagctggtgaagggccagaagagaaaggtgaaggacagactgaaggcctacgtgagagacccctacgccctggacctgatcgacaagctgctggtgctggaccccgcccagagaatcgacagcgacgacgccctgaaccacgacttcttctggagcgaccccatgcccagcgacctgaagggcatgctgagcacccacctgaccagcatgttcgagtacctggccccccccagaagaaagggcagccagatcacccagcagagcaccaaccagagcagaaaccccgccaccaccaaccagaccgagttcgagagagtgttctag

SEQ ID NO: 10295 - DNA, 1470 bp, Artificial Sequence
  Description of Artificial Sequence: Synthetic coding sequence
atgcagagagacgccccccccagagcccccgcccccgcccccagactgcccgccccccccatcggcgccgccgccagcagcggcggcggcggcggcggcggcagcggcggcggcggcggcggcgccagcgccgcccccgccccccccggcctgagcggcaccaccagccccagaggccccggcggcggcagaagagccgaggaggccggcagcgcccccagaggcagaaagtggccctggagaagaaagtggagaggcagaggcggcgcctggagcgccgccgccgccggccccggcgccggcgccgccgccgccgccaccggcggcggcggcggcgccctggaggccgccatggccaagcagtacgacagcgtggagtgccccttctgcgacgaggtgagcaagtacgagaagctggccaagatcggccagggcaccttcggcgaggtgttcaaggccagacacagaaagaccggccagaaggtggccctgaagaaggtgctgatggagaacgagaaggagggcttccccatcaccgccctgagagagatcaagatcctgcagctgctgaagcacgagaacgtggtgaacctgatcgagatctgcagaaccaaggccagcccctacaacagatgcaagggcagcatctacctggtgttcgacttctgcgagcacgacctggccggcctgctgagcaacgtgctggtgaagttcaccctgagcgagatcaagagagtgatgcagatgctgctgaacggcctgtactacatccacagaaacaagatcctgcacagagacatgaaggccgccaacgtgctgatcaccagagacggcgtgctgaagctggccgacttcggcctggccagagccttcagcctggccaagaacagccagcccaacagatacaccaacagagtggtgaccctgtggtacagaccccccgagctgctgctgggcgagagagactacggcccccccatcgacctgtggggcgccggctgcatcatggccgagatgtggaccagaagccccatcatgcagggcaacaccgagcagcaccagctggccctgatcagccagctgtgcggcagcatcacccccgaggtgtggcccaacgtggacaactacgagctgtacgagaagctggagctggtgaagggccagaagagaaaggtgaaggacagactgaaggcctacgtgagagacccctacgccctggacctgatcgacaagctgctggtgctggaccccgcccagagaatcgacagcgacgacgccctgaaccacgacttcttctggagcgaccccatgcccagcgacctgaagggcatgctgagcacccacctgaccagcatgttcgagtacctggccccccccagaagaaagggcagccagatcacccagcagagcaccaaccagagcagaaaccccgccaccaccaaccagaccgagttcgagagagtgttctag

SEQ ID NO: 10296 - DNA, 585 bp, Artificial Sequence
  Description of Artificial Sequence: Synthetic coding sequence
atgcagagagacgccccccccagagcccccgcccccgcccccagactgcccgccccccccatcggcgccgccgccagcagcggcggcggcggcggcggcggcagcggcggcggcggcggcggcgccagcgccgcccccgccccccccggcctgagcggcaccaccagccccagaggccccggcggcggcagaagagccgaggaggccggcagcgcccccagaggcagaaagtggccctggagaagaaagtggagaggcagaggcggcgcctggagcgccgccgccgccggccccggcgccggcgccgccgccgccgccaccggcggcggcggcggcgccctggaggccgccatggccaagcagtacgacagcgtggagtgccccttctgcgacgaggtgagcaagtacgagaagctggccaagatcggccagggcaccttcggcgaggtgttcaaggccagacacagaaagaccggccagaaggtggccctgaagaaggtgctgatggagaacgagaaggagggcttccccatcaccgccctgagagagatcaagatcctgcagctgctgaagcacgagaactag

SEQ ID NO: 10297 - DNA, 495 bp, Artificial Sequence
  Description of Artificial Sequence: Synthetic coding sequence
atgagcgagcccgccggcgacgtgagacagaacccctgcggcagcaaggcctgcagaagactgttcggccccgtggacagcgagcagctgagcagagactgcgacgccctgatggccggctgcatccaggaggccagagagagatggaacttcgacttcgtgaccgagacccccctggagggcgacttcgcctgggagagagtgagaggcctgggcctgcccaagctgtacctgcccaccggccccagaagaggcagagacgagctgggcggcggcagaagacccggcaccagccccgccctgctgcagggcaccgccgaggaggaccacgtggacctgagcctgagctgcaccctggtgcccagaagcggcgagcaggccgagggcagccccggcggccccggcgacagccagggcagaaagagaagacagaccagcatgaccgacttctaccacagcaagagaagactgatcttcagcaagagaaagccctag

SEQ ID NO: 10298 - DNA, 495 bp, Artificial Sequence; identical to SEQ ID NO: 10297
  Description of Artificial Sequence: Synthetic coding sequence

SEQ ID NO: 10299 - DNA, 495 bp, Artificial Sequence; identical to SEQ ID NO: 10297
  Description of Artificial Sequence: Synthetic coding sequence

SEQ ID NO: 10300 - DNA, 597 bp, Artificial Sequence
  Description of Artificial Sequence: Synthetic coding sequence
atgtggggcgtgttcagaagacagaccacccacagcagcaacccccccctgcccggccagcagagctgctgcaaccacagagacttcttctgcagcggcgccatgagcgagcccgccggcgacgtgagacagaacccctgcggcagcaaggcctgcagaagactgttcggccccgtggacagcgagcagctgagcagagactgcgacgccctgatggccggctgcatccaggaggccagagagagatggaacttcgacttcgtgaccgagacccccctggagggcgacttcgcctgggagagagtgagaggcctgggcctgcccaagctgtacctgcccaccggccccagaagaggcagagacgagctgggcggcggcagaagacccggcaccagccccgccctgctgcagggcaccgccgaggaggaccacgtggacctgagcctgagctgcaccctggtgcccagaagcggcgagcaggccgagggcagccccggcggccccggcgacagccagggcagaaagagaagacagaccagcatgaccgacttctaccacagcaagagaagactgatcttcagcaagagaaagccctag

SEQ ID NO: 10301 - DNA, 363 bp, Artificial Sequence
  Description of Artificial Sequence: Synthetic coding sequence
atggacgacagcaaggtggtgggcggcaaggtgaagaagcccggcaagagaggcagaaagcccgccaagatcgacctgaaggccaagctggagagaagcagacagagcgccagagagtgcagagccagaaagaagctgagataccagtacctggaggagctggtgagcagcagagagagagccatctgcgccctgagagaggagctggagatgtacaagcagtggtgcatggccatggaccagggcaagatccccagcgagatcaaggccctgctgaccggcgaggagcagaacaagagccagcagaacagcagcagacacaccaaggccggcaagaccgacgccaacagcaacagctggtag

SEQ ID NO: 10302 - DNA, 444 bp, Artificial Sequence
  Description of Artificial Sequence: Synthetic coding sequence
atggaggaggccagccagagaaagtggaacttcgacttccagaaccacaagcccctggagggcaagtacgagtggcaggaggtggagaagggcagcctgcccgagttctactacagaccccccagaccccccaagggcgcctgcaaggtgcccgcccaggagagccaggacgtgagcggcagcagacccgccgcccccctgatcggcgcccccgccaacagcgaggacacccacctggtggaccccaagaccgaccccagcgacagccagaccggcctggccgagcagtgcgccggcatcagaaagagacccgccaccgacgacagcagcacccagaacaagagagccaacagaaccgaggagaacgtgagcgacggcagccccaacgccggcagcgtggagcagacccccaagaagcccggcctgagaagaagacagacctag

SEQ ID NO: 10303 - DNA, 918 bp, Artificial Sequence
  Description of Artificial Sequence: Synthetic coding sequence
atggagagactggtggccagaggcaccttccccgtgctggtgagaaccagcgcctgcagaagcctgttcggccccgtggaccacgaggagctgagcagagagctgcaggccagactggccgagctgaacgccgaggaccagaacagatgggactacgacttccagcaggacatgcccctgagaggccccggcagactgcagtggaccgaggtggacagcgacagcgtgcccgccttctacagagagaccgtgcaggtgggcagatgcagactgctgctggcccccagacccgtggccgtggccgtggccgtgagcccccccctggagcccgccgccgagagcctggacggcctggaggaggcccccgagcagctgcccagcgtgcccgtgcccgcccccgccagcacccccccccccgtgcccgtgctggcccccgcccccgcccccgcccccgcccccgtggccgcccccgtggccgcccccgtggccgtggccgtgctggcccccgcccccgcccccgcccccgcccccgcccccgcccccgcccccgtggccgcccccgcccccgcccccgcccccgcccccgcccccgcccccgcccccgcccccgcccccgacgccgccccccaggagagcgccgagcagggcgccaaccagggccagagaggccaggagcccctggccgaccagctgcacagcggcatcagcggcagacccgccgccggcaccgccgccgccagcgccaacggcgccgccatcaagaagctgagcggccccctgatcagcgacttcttcgccaagagaaagagaagcgcccccgagaagagcagcggcgacgtgcccgccccctgccccagccccagcgccgcccccggcgtgggcagcgtggagcagacccccagaaagagactgagatag

SEQ ID NO: 10304 - DNA, 951 bp, Artificial Sequence
  Description of Artificial Sequence: Synthetic coding sequence
atgagcgacgccagcctgagaagcaccagcaccatggagagactggtggccagaggcaccttccccgtgctggtgagaaccagcgcctgcagaagcctgttcggccccgtggaccacgaggagctgagcagagagctgcaggccagactggccgagctgaacgccgaggaccagaacagatgggactacgacttccagcaggacatgcccctgagaggccccggcagactgcagtggaccgaggtggacagcgacagcgtgcccgccttctacagagagaccgtgcaggtgggcagatgcagactgctgctggcccccagacccgtggccgtggccgtggccgtgagcccccccctggagcccgccgccgagagcctggacggcctggaggaggcccccgagcagctgcccagcgtgcccgtgcccgcccccgccagcacccccccccccgtgcccgtgctggcccccgcccccgcccccgcccccgcccccgtggccgcccccgtggccgcccccgtggccgtggccgtgctggcccccgcccccgcccccgcccccgcccccgcccccgcccccgcccccgtggccgcccccgcccccgcccccgcccccgcccccgcccccgcccccgcccccgcccccgcccccgacgccgccccccaggagagcgccgagcagggcgccaaccagggccagagaggccaggagcccctggccgaccagctgcacagcggcatcagcggcagacccgccgccggcaccgccgccgccagcgccaacggcgccgccatcaagaagctgagcggccccctgatcagcgacttcttcgccaagagaaagagaagcgcccccgagaagagcagcggcgacgtgcccgccccctgccccagccccagcgccgcccccggcgtgggcagcgtggagcagacccccagaaagagactgagatag

SEQ ID NO: 10305 - DNA, 951 bp, Artificial Sequence; identical to SEQ ID NO: 10304
  Description of Artificial Sequence: Synthetic coding sequence

SEQ ID NO: 10306 - DNA, 918 bp, Artificial Sequence; identical to SEQ ID NO: 10303
  Description of Artificial Sequence: Synthetic coding sequence

SEQ ID NO: 10307 - DNA, 504 bp, Artificial Sequence
  Description of Artificial Sequence: Synthetic coding sequence
atggagcccgccgccggcagcagcatggagcccagcgccgactggctggccaccgccgccgccagaggcagagtggaggaggtgagagccctgctggaggccggcgccctgcccaacgcccccaacagctacggcagaagacccatccaggtgatgatgatgggcagcgccagagtggccgagctgctgctgctgcacggcgccgagcccaactgcgccgaccccgccaccctgaccagacccgtgcacgacgccgccagagagggcttcctggacaccctggtggtgctgcacagagccggcgccagactggacgtgagagacgcctggggcagactgcccgtggacctggccgaggagctgggccacagagacgtggccagatacctgagagccgccgccggcggcaccagaggcagcaaccacgccagaatcgacgccgccgagggccccagcgagatgatcggcaaccacctgtgggtgtgcagaagcagacacgcctag

SEQ ID NO: 10308 - DNA, 471 bp, Artificial Sequence
  Description of Artificial Sequence: Synthetic coding sequence
atggagcccgccgccggcagcagcatggagcccagcgccgactggctggccaccgccgccgccagaggcagagtggaggaggtgagagccctgctggaggccggcgccctgcccaacgcccccaacagctacggcagaagacccatccaggtgatgatgatgggcagcgccagagtggccgagctgctgctgctgcacggcgccgagcccaactgcgccgaccccgccaccctgaccagacccgtgcacgacgccgccagagagggcttcctggacaccctggtggtgctgcacagagccggcgccagactggacgtgagagacgcctggggcagactgcccgtggacctggccgaggagctgggccacagagacgtggccagatacctgagagccgccgccggcggcaccagaggcagcaaccacgccagaatcgacgccgccgagggccccagcgacatccccgactag

SEQ ID NO: 10309 - DNA, 522 bp, Artificial Sequence
  Description of Artificial Sequence: Synthetic coding sequence
atgggcagaggcagatgcgtgggccccagcctgcagctgagaggccaggagtggagatgcagccccctggtgcccaagggcggcgccgccgccgccgagctgggccccggcggcggcgagaacatggtgagaagattcctggtgaccctgagaatcagaagagcctgcggcccccccagagtgagagtgttcgtggtgcacatccccagactgaccggcgagtgggccgcccccggcgcccccgccgccgtggccctggtgctgatgctgctgagaagccagagactgggccagcagcccctgcccagaagacccggccacgacgacggccagagacccagcggcggcgccgccgccgcccccagaagaggcgcccagctgagaagacccagacacagccaccccaccagagccagaagatgccccggcggcctgcccggccacgccggcggcgccgcccccggcagaggcgccgccggcagagccagatgcctgggccccagcgccagaggccccggctag

SEQ ID NO: 10310 - DNA, 504 bp, Artificial Sequence; identical to SEQ ID NO: 10307
  Description of Artificial Sequence: Synthetic coding sequence

SEQ ID NO: 10311 - DNA, 399 bp, Artificial Sequence
  Description of Artificial Sequence: Synthetic coding sequence
atggtgagaagattcctggtgaccctgagaatcagaagagcctgcggcccccccagagtgagagtgttcgtggtgcacatccccagactgaccggcgagtgggccgcccccggcgcccccgccgccgtggccctggtgctgatgctgctgagaagccagagactgggccagcagcccctgcccagaagacccggccacgacgacggccagagacccagcggcggcgccgccgccgcccccagaagaggcgcccagctgagaagacccagacacagccaccccaccagagccagaagatgccccggcggcctgcccggccacgccggcggcgccgcccccggcagaggcgccgccggcagagccagatgcctgggccccagcgccagaggccccggctag

SEQ ID NO: 10312 - DNA, 417 bp, Artificial Sequence
  Description of Artificial Sequence: Synthetic coding sequence
atgagagaggagaacaagggcatgcccagcggcggcggcagcgacgagggcctggccagcgccgccgccagaggcctggtggagaaggtgagacagctgctggaggccggcgccgaccccaacggcgtgaacagattcggcagaagagccatccaggtgatgatgatgggcagcgccagagtggccgagctgctgctgctgcacggcgccgagcccaactgcgccgaccccgccaccctgaccagacccgtgcacgacgccgccagagagggcttcctggacaccctggtggtgctgcacagagccggcgccagactggacgtgagagacgcctggggcagactgcccgtggacctggccgaggagagaggccacagagacgtggccggctacctgagaaccgccaccggcgactag

SEQ ID NO: 10313 - DNA, 237 bp, Artificial Sequence
  Description of Artificial Sequence: Synthetic coding sequence
atgagagaggagaacaagggcatgcccagcggcggcggcagcgacgagggcctggccagcgccgccgccagaggcctggtggagaaggtgagacagctgctggaggccggcgccgaccccaacggcgtgaacagattcggcagaagagccatccaggtggccggcgcccccggccccagaagacagggcgccagagagagaggcgccagacccagaagaatcggcgccggcacctag

SEQ ID NO: 10314 - DNA, 237 bp, Artificial Sequence; identical to SEQ ID NO: 10313
  Description of Artificial Sequence: Synthetic coding sequence

SEQ ID NO: 10315 - DNA, 507 bp, Artificial Sequence
  Description of Artificial Sequence: Synthetic coding sequence
atggccgagccctggggcaacgagctggccagcgccgccgccagaggcgacctggagcagctgaccagcctgctgcagaacaacgtgaacgtgaacgcccagaacggcttcggcagaaccgccctgcaggtgatgaagctgggcaaccccgagatcgccagaagactgctgctgagaggcgccaaccccgacctgaaggacagaaccggcttcgccgtgatccacgacgccgccagagccggcttcctggacaccctgcagaccctgctggagttccaggccgacgtgaacatcgaggacaacgagggcaacctgcccctgcacctggccgccaaggagggccacctgagagtggtggagttcctggtgaagcacaccgccagcaacgtgggccacagaaaccacaagggcgacaccgcctgcgacctggccagactgtacggcagaaacgaggtggtgagcctgatgcaggccaacggcgccggcggcgccaccaacctgcagtag

SEQ ID NO: 10316 - DNA, 507 bp, Artificial Sequence; identical to SEQ ID NO: 10315
  Description of Artificial Sequence: Synthetic coding sequence

SEQ ID NO: 10317 - DNA, 507 bp, Artificial Sequence; identical to SEQ ID NO: 10315
  Description of Artificial Sequence: Synthetic coding sequence

SEQ ID NO: 10318 - DNA, 501 bp, Artificial Sequence
  Description of Artificial Sequence: Synthetic coding sequence
atgctgctggaggaggtgagagccggcgacagactgagcggcgccgccgccagaggcgacgtgcaggaggtgagaagactgctgcacagagagctggtgcaccccgacgccctgaacagattcggcaagaccgccctgcaggtgatgatgttcggcagcaccgccatcgccctggagctgctgaagcagggcgccagccccaacgtgcaggacaccagcggcaccagccccgtgcacgacgccgccagaaccggcttcctggacaccctgaaggtgctggtggagcacggcgccgacgtgaacgtgcccgacggcaccggcgccctgcccatccacctggccgtgcaggagggccacaccgccgtggtgagcttcctggccgccgagagcgacctgcacagaagagacgccagaggcctgacccccctggagctggccctgcagagaggcgcccaggacctggtggacatcctgcagggccacatggtggcccccctgtag

SEQ ID NO: 10319 - DNA, 501 bp, Artificial Sequence; identical to SEQ ID NO: 10318
  Description of Artificial Sequence: Synthetic coding sequence

SEQ ID NO: 10320 - DNA, 639 bp, Artificial Sequence
  Description of Artificial Sequence: Synthetic coding sequence
atgaagccccccagcagcatccagaccagcgagttcgacagcagcgacgaggagcccatcgaggacgagcagacccccatccacatcagctggctgagcctgagcagagtgaactgcagccagttcctgggcctgtgcgccctgcccggctgcaagttcaaggacgtgagaagaaacgtgcagaaggacaccgaggagctgaagagctgcggcatccaggacatcttcgtgttctgcaccagaggcgagctgagcaagtacagagtgcccaacctgctggacctgtaccagcagtgcggcatcatcacccaccaccaccccatcgccgacggcggcacccccgacatcgccagctgctgcgagatcatggaggagctgaccacctgcctgaagaactacagaaagaccctgatccactgctacggcggcctgggcagaagctgcctggtggccgcctgcctgctgctgtacctgagcgacaccatcagccccgagcaggccatcgacagcctgagagacctgagaggcagcggcgccatccagaccatcaagcagtacaactacctgcacgagttcagagacaagctggccgcccacctgagcagcagagacagccagagcagaagcgtgagcagatag

SEQ ID NO: 10321 - DNA, 501 bp, Artificial Sequence
  Description of Artificial Sequence: Synthetic coding sequence
atgaacccctgctgcaagttcaaggacgtgagaagaaacgtgcagaaggacaccgaggagctgaagagctgcggcatccaggacatcttcgtgttctgcaccagaggcgagctgagcaagtacagagtgcccaacctgctggacctgtaccagcagtgcggcatcatcacccaccaccaccccatcgccgacggcggcacccccgacatcgccagctgctgcgagatcatggaggagctgaccacctgcctgaagaactacagaaagaccctgatccactgctacggcggcctgggcagaagctgcctggtggccgcctgcctgctgctgtacctgagcgacaccatcagccccgagcaggccatcgacagcctgagagacctgagaggcagcggcgccatccagaccatcaagcagtacaactacctgcacgagttcagagacaagctggccgcccacctgagcagcagagacagccagagcagaagcgtgagcagatag

SEQ ID NO: 10322 - DNA, 210 bp, Artificial Sequence
  Description of Artificial Sequence: Synthetic coding sequence
atgaagccccccagcagcatccagaccagcgagttcgacagcagcgacgaggagcccatcgaggacgagcagacccccatccacatcagctggctgagcctgagcagagtgaactgcagccagttcctgggcctgtgcgccctgcccggctgcaagttcaaggacgtgagaagaaacgtgcagaaggagaagaagaagaagaagaagtag

SEQ ID NO: 10323 - DNA, 624 bp, Artificial Sequence
  Description of Artificial Sequence: Synthetic coding sequence
atgaagccccccagcagcatccagaccagcgagttcgacagcagcgacgaggagcccatcgaggacgagcagacccccatccacatcagctggctgagcctgagcagagtgaactgcagccagttcctgggcctgtgcgccctgcccggctgcaagttcaaggacgtgagaagaaacgtgcagaaggacaccgaggagctgaagagctgcggcatccaggacatcttcgtgttctgcaccagaggcgagctgagcaagtacagagtgcccaacctgctggacctgtaccagcagtgcggcatcatcacccaccaccaccccatcgccgacggcggcacccccgacatcgccagctgctgcgagatcatggaggagctgaccacctgcctgaagaacctgttctgctacggcggcctgggcagaagctgcctggtggccgcctgcctgctgctgtacctgagcgacaccatcagccccgagcaggccatcgacagcctgagagacctgagaggcagcggcgccatccagaccatcaagcagtacaactacctgcacgagttcagagacaagctggccgcccacctgagcagcagagacagccagagcagaagcgtgagcagatag

SEQ ID NO: 10324 - DNA, 519 bp, Artificial Sequence
  Description of Artificial Sequence: Synthetic coding sequence
atgaagccccccagcagcatccagaccagctgcaagttcaaggacgtgagaagaaacgtgcagaaggacaccgaggagctgaagagctgcggcatccaggacatcttcgtgttctgcaccagaggcgagctgagcaagtacagagtgcccaacctgctggacctgtaccagcagtgcggcatcatcacccaccaccaccccatcgccgacggcggcacccccgacatcgccagctgctgcgagatcatggaggagctgaccacctgcctgaagaactacagaaagaccctgatccactgctacggcggcctgggcagaagctgcctggtggccgcctgcctgctgctgtacctgagcgacaccatcagccccgagcaggccatcgacagcctgagagacctgagaggcagcggcgccatccagaccatcaagcagtacaactacctgcacgagttcagagacaagctggccgcccacctgagcagcagagacagccagagcagaagcgtgagcagatag

SEQ ID NO: 10325 - DNA, 2871 bp, Artificial Sequence
  Description of Artificial Sequence: Synthetic coding sequence
atgagcagcggcctgtggagccaggagaaggtgaccagcccctactgggaggagagaatcttctacctgctgctgcaggagtgcagcgtgaccgacaagcagacccagaagctgctgaaggtgcccaagggcagcatcggccagtacatccaggacagaagcgtgggccacagcagaatccccagcgccaagggcaagaagaaccagatcggcctgaagatcctggagcagccccacgccgtgctgttcgtggacgagaaggacgtggtggagatcaacgagaagttcaccgagctgctgctggccatcaccaactgcgaggagagattcagcctgttcaagaacagaaacagactgagcaagggcctgcagatcgacgtgggctgccccgtgaaggtgcagctgagaagcggcgaggagaagttccccggcgtggtgagattcagaggccccctgctggccgagagaaccgtgagcggcatcttcttcggcgtggagctgctggaggagggcagaggccagggcttcaccgacggcgtgtaccagggcaagcagctgttccagtgcgacgaggactgcggcgtgttcgtggccctggacaagctggagctgatcgaggacgacgacaccgccctggagagcgactacgccggccccggcgacaccatgcaggtggagctgccccccctggagatcaacagcagagtgagcctgaaggtgggcgagaccatcgagagcggcaccgtgatcttctgcgacgtgctgcccggcaaggagagcctgggctacttcgtgggcgtggacatggacaaccccatcggcaactgggacggcagattcgacggcgtgcagctgtgcagcttcgcctgcgtggagagcaccatcctgctgcacatcaacgacatcatccccgccctgagcgagagcgtgacccaggagagaagaccccccaagctggccttcatgagcagaggcgtgggcgacaagggcagcagcagccacaacaagcccaaggccaccggcagcaccagcgaccccggcaacagaaacagaagcgagctgttctacaccctgaacggcagcagcgtggacagccagccccagagcaagagcaagaacacctggtacatcgacgaggtggccgaggaccccgccaagagcctgaccgagatcagcaccgacttcgacagaagcagcccccccctgcagcccccccccgtgaacagcctgaccaccgagaacagattccacagcctgcccttcagcctgaccaagatgcccaacaccaacggcagcatcggccacagccccctgagcctgagcgcccagagcgtgatggaggagctgaacaccgcccccgtgcaggagagcccccccctggccatgccccccggcaacagccacggcctggaggtgggcagcctggccgaggtgaaggagaacccccccttctacggcgtgatcagatggatcggccagccccccggcctgaacgaggtgctggccggcctggagctggaggacgagtgcgccggctgcaccgacggcaccttcagaggcaccagatacttcacctgcgccctgaagaaggccctgttcgtgaagctgaagagctgcagacccgacagcagattcgccagcctgcagcccgtgagcaaccagatcgagagatgcaacagcctggccttcggcggctacctgagcgaggtggtggaggagaacaccccccccaagatggagaaggagggcctggagatcatgatcggcaagaagaagggcatccagggccactacaacagctgctacctggacagcaccctgttctgcctgttcgccttcagcagcgtgctggacaccgtgctgctgagacccaaggagaagaacgacgtggagtactacagcgagacccaggagctgctgagaaccgagatcgtgaaccccctgagaatctacggctacgtgtgcgccaccaagatcatgaagctgagaaagatcctggagaaggtggaggccgccagcggcttcaccagcgaggagaaggaccccgaggagttcctgaacatcctgttccaccacatcctgagagtggagcccctgctgaagatcagaagcgccggccagaaggtgcaggactgctacttctaccagatcttcatggagaagaacgagaaggtgggcgtgcccaccatccagcagctgctggagtggagcttcatcaacagcaacctgaagttcgccgaggcccccagctgcctgatcatccagatgcccagattcggcaaggacttcaagctgttcaagaagatcttccccagcctggagctgaacatcaccgacctgctggaggacacccccagacagtgcagaatctgcggcggcctggccatgtacgagtgcagagagtgctacgacgaccccgacatcagcgccggcaagatcaagcagttctgcaagacctgcaacacccaggtgcacctgcaccccaagagactgaaccacaagtacaaccccgtgagcctgcccaaggacctgcccgactgggactggagacacggctgcatcccctgccagaacatggagctgttcgccgtgctgtgcatcgagaccagccactacgtggccttcgtgaagtacggcaaggacgacagcgcctggctgttcttcgacagcatggccgacagagacggcggccagaacggcttcaacatcccccaggtgaccccctgccccgaggtgggcgagtacctgaagatgagcctggaggacctgcacagcctggacagcagaagaatccagggctgcgccagaagactgctgtgcgacgcctacatgtgcatgtaccagagccccaccatgagcctgtacaagtag

SEQ ID NO: 10326 - DNA, 2862 bp, Artificial Sequence
  Description of Artificial Sequence: Synthetic coding sequence
atgagcagcggcctgtggagccaggagaaggtgaccagcccctactgggaggagagaatcttctacctgctgctgcaggagtgcagcgtgaccgacaagcagacccagaagctgctgaaggtgcccaagggcagcatcggccagtacatccaggacagaagcgtgggccacagcagaatccccagcgccaagggcaagaagaaccagatcggcctgaagatcctggagcagccccacgccgtgctgttcgtggacgagaaggacgtggtggagatcaacgagaagttcaccgagctgctgctggccatcaccaactgcgaggagagattcagcctgttcaagaacagaaacagactgagcaagggcctgcagatcgacgtgggctgccccgtgaaggtgcagctgagaagcggcgaggagaagttccccggcgtggtgagattcagaggccccctgctggccgagagaaccgtgagcggcatcttcttcggcgtggagctgctggaggagggcagaggccagggcttcaccgacggcgtgtaccagggcaagcagctgttccagtgcgacgaggactgcggcgtgttcgtggccctggacaagctggagctgatcgaggacgacgacaccgccctggagagcgactacgccggccccggcgacaccatgcaggtggagctgccccccctggagatcaacagcagagtgagcctgaaggtgggcgagaccatcgagagcggcaccgtgatcttctgcgacgtgctgcccggcaaggagagcctgggctacttcgtgggcgtggacatggacaaccccatcggcaactgggacggcagattcgacggcgtgcagctgtgcagcttcgcctgcgtggagagcaccatcctgctgcacatcaacgacatcatccccgagagcgtgacccaggagagaagaccccccaagctggccttcatgagcagaggcgtgggcgacaagggcagcagcagccacaacaagcccaaggccaccggcagcaccagcgaccccggcaacagaaacagaagcgagctgttctacaccctgaacggcagcagcgtggacagccagccccagagcaagagcaagaacacctggtacatcgacgaggtggccgaggaccccgccaagagcctgaccgagatcagcaccgacttcgacagaagcagcccccccctgcagcccccccccgtgaacagcctgaccaccgagaacagattccacagcctgcccttcagcctgaccaagatgcccaacaccaacggcagcatcggccacagccccctgagcctgagcgcccagagcgtgatggaggagctgaacaccgcccccgtgcaggagagcccccccctggccatgccccccggcaacagccacggcctggaggtgggcagcctggccgaggtgaaggagaacccccccttctacggcgtgatcagatggatcggccagccccccggcctgaacgaggtgctggccggcctggagctggaggacgagtgcgccggctgcaccgacggcaccttcagaggcaccagatacttcacctgcgccctgaagaaggccctgttcgtgaagctgaagagctgcagacccgacagcagattcgccagcctgcagcccgtgagcaaccagatcgagagatgcaacagcctggccttcggcggctacctgagcgaggtggtggaggagaacaccccccccaagatggagaaggagggcctggagatcatgatcggcaagaagaagggcatccagggccactacaacagctgctacctggacagcaccctgttctgcctgttcgccttcagcagcgtgctggacaccgtgctgctgagacccaaggagaagaacgacgtggagtactacagcgagacccaggagctgctgagaaccgagatcgtgaaccccctgagaatctacggctacgtgtgcgccaccaagatcatgaagctgagaaagatcctggagaaggtggaggccgccagcggcttcaccagcgaggagaaggaccccgaggagttcctgaacatcctgttccaccacatcctgagagtggagcccctgctgaagatcagaagcgccggccagaaggtgcaggactgctacttctaccagatcttcatggagaagaacgagaaggtgggcgtgcccaccatccagcagctgctggagtggagcttcatcaacagcaacctgaagttcgccgaggcccccagctgcctgatcatccagatgcccagattcggcaaggacttcaagctgttcaagaagatcttccccagcctggagctgaacatcaccgacctgctggaggacacccccagacagtgcagaatctgcggcggcctggccatgtacgagtgcagagagtgctacgacgaccccgacatcagcgccggcaagatcaagcagttctgcaagacctgcaacacccaggtgcacctgcaccccaagagactgaaccacaagtacaaccccgtgagcctgcccaaggacctgcccgactgggactggagacacggctgcatcccctgccagaacatggagctgttcgccgtgctgtgcatcgagaccagccactacgtggccttcgtgaagtacggcaaggacgacagcgcctggctgttcttcgacagcatggccgacagagacggcggccagaacggcttcaacatcccccaggtgaccccctgccccgaggtgggcgagtacctgaagatgagcctggaggacctgcacagcctggacagcagaagaatccagggctgcgccagaagactgctgtgcgacgcctacatgtgcatgtaccagagccccaccatgagcctgtacaagtag

SEQ ID NO: 10327 - DNA, 2862 bp, Artificial Sequence; identical to SEQ ID NO: 10326
  Description of Artificial Sequence: Synthetic coding sequence

SEQ ID NO: 10328 - DNA, 2871 bp, Artificial Sequence
  Description of Artificial Sequence: Synthetic coding sequence
atgagcagcggcctgtggagccaggagaaggtgaccagcccctactgggaggagagaatcttctacctgctgctgcaggagtgcagcgtgaccgacaagcagacccagaagctgctgaaggtgcccaagggcagcatcggccagtacatccaggacagaagcgtgggccacagcagaatccccagcgccaagggcaagaagaaccagatcggcctgaagatcctggagcagccccacgccgtgctgttcgtggacgagaaggacgtggtggagatcaacgagaagttcaccgagctgctgctggccatcaccaactgcgaggagagattcagcctgttcaagaacagaaacagactgagcaagggcctgcagatcgacgtgggctgccccgtgaaggtgcagctgagaagcggcgaggagaagttccccggcgtggtgagattcagaggccccctgctggccgagagaaccgtgagcggcatcttcttcggcgtggagctgctggaggagggcagaggccagggcttcaccgacggcgtgtaccagggcaagcagctgttccagtgcgacgaggactgcggcgtgttcgtggccctggacaagctggagctgatcgaggacgacgacaccgccctggagagcgactacgccggccccggcgacaccatgcaggtggagctgccccccctggagatcaacagcagagtgagcctgaaggtgggcgagaccatcgagagcggcaccgtgatcttctgcgacgtgctgcccggcaaggagagcctgggctacttcgtgggcgtggacatggacaaccccatcggcaactgggacggcagattcgacggcgtgcagctgtgcagcttcgcctgcgtggagagcaccatcctgctgcacatcaacgacatcatccccgccgtgagcgagagcgtgacccaggagagaagaccccccaagctggccttcatgagcagaggcgtgggcgacaagggcagcagcagccacaacaagcccaaggccaccggcagcaccagcgaccccggcaacagaaacagaagcgagctgttctacaccctgaacggcagcagcgtggacagccagccccagagcaagagcaagaacacctggtacatcgacgaggtggccgaggaccccgccaagagcctgaccgagatcagcaccgacttcgacagaagcagcccccccctgcagcccccccccgtgaacagcctgaccaccgagaacagattccacagcctgcccttcagcctgaccaagatgcccaacaccaacggcagcatcggccacagccccctgagcctgagcgcccagagcgtgatggaggagctgaacaccgcccccgtgcaggagagcccccccctggccatgccccccggcaacagccacggcctggaggtgggcagcctggccgaggtgaaggagaacccccccttctacggcgtgatcagatggatcggccagccccccggcctgaacgaggtgctggccggcctggagctggaggacgagtgcgccggctgcaccgacggcaccttcagaggcaccagatacttcacctgcgccctgaagaaggccctgttcgtgaagctgaagagctgcagacccgacagcagattcgccagcctgcagcccgtgagcaaccagatcgagagatgcaacagcctggccttcggcggctacctgagcgaggtggtggaggagaacaccccccccaagatggagaaggagggcctggagatcatgatcggcaagaagaagggcatccagggccactacaacagctgctacctggacagcaccctgttctgcctgttcgccttcagcagcgtgctggacaccgtgctgctgagacccaaggagaagaacgacgtggagtactacagcgagacccaggagctgctgagaaccgagatcgtgaaccccctgagaatctacggctacgtgtgcgccaccaagatcatgaagctgagaaagatcctggagaaggtggaggccgccagcggcttcaccagcgaggagaaggaccccgaggagttcctgaacatcctgttccaccacatcctgagagtggagcccctgctgaagatcagaagcgccggccagaaggtgcaggactgctacttctaccagatcttcatggagaagaacgagaaggtgggcgtgcccaccatccagcagctgctggagtggagcttcatcaacagcaacctgaagttcgccgaggcccccagctgcctgatcatccagatgcccagattcggcaaggacttcaagctgttcaagaagatcttccccagcctggagctgaacatcaccgacctgctggaggacacccccagacagtgcagaatctgcggcggcctggccatgtacgagtgcagagagtgctacgacgaccccgacatcagcgccggcaagatcaagcagttctgcaagacctgcaacacccaggtgcacctgcaccccaagagactgaaccacaagtacaaccccgtgagcctgcccaaggacctgcccgactgggactggagacacggctgcatcccctgccagaacatggagctgttcgccgtgctgtgcatcgagaccagccactacgtggccttcgtgaagtacggcaaggacgacagcgcctggctgttcttcgacagcatggccgacagagacggcggccagaacggcttcaacatcccccaggtgaccccctgccccgaggtgggcgagtacctgaagatgagcctggaggacctgcacagcctggacagcagaagaatccagggctgcgccagaagactgctgtgcgacgcctacatgtgcatgtaccagagccccaccatgagcctgtacaagtag

SEQ ID NO: 10329 - DNA, 450 bp, Artificial Sequence
  Description of Artificial Sequence: Synthetic coding sequence
atggccagaagcaacctgcccctggccctgggcctggccctggtggccttctgcctgctggccctgcccagagacgccagagccagaccccaggagagaatggtgggcgagctgagagacctgagccccgacgacccccaggtgcagaaggccgcccaggccgccgtggccagctacaacatgggcagcaacagcatctactacttcagagacacccacatcatcaaggcccagagccagctggtggccggcatcaagtacttcctgaccatggagatgggcagcaccgactgcagaaagaccagagtgaccggcgaccacgtggacctgaccacctgccccctggccgccggcgcccagcaggagaagctgagatgcgacttcgaggtgctggtggtgccctggcagaacagcagccagctgctgaagcacaactgcgtgcagatgtag

SEQ ID NO: 10330 - DNA, 504 bp, Artificial Sequence
  Description of Artificial Sequence: Synthetic coding sequence
atgctgcccgagaaggccctgcacggccacccccagctgcccagaaccgtgcccaccagagccgccatgagagccgccggcaccctgctggccttctgctgcctggtgctgagcaccaccggcggccccagccccgacacctgcagccaggacctgaacagcagagtgaagcccggcttccccaagaccatcaagaccaacgaccccggcgtgctgcaggccgccagatacagcgtggagaagttcaacaactgcaccaacgacatgttcctgttcaaggagagcagaatcaccagagccctggtgcagatcgtgaagggcctgaagtacatgctggaggtggagatcggcagaaccacctgcaagaagaaccagcacctgagactggacgactgcgacttccagaccaaccacaccctgaagcagaccctgagctgctacagcgaggtgtgggtggtgccctggctgcagcacttcgaggtgcccgtgctgagatgccactag

SEQ ID NO: 10331 - DNA, 438 bp, Artificial Sequence
  Description of Artificial Sequence: Synthetic coding sequence
atgagagccgccggcaccctgctggccttctgctgcctggtgctgagcaccaccggcggccccagccccgacacctgcagccaggacctgaacagcagagtgaagcccggcttccccaagaccatcaagaccaacgaccccggcgtgctgcaggccgccagatacagcgtggagaagttcaacaactgcaccaacgacatgttcctgttcaaggagagcagaatcaccagagccctggtgcagatcgtgaagggcctgaagtacatgctggaggtggagatcggcagaaccacctgcaagaagaaccagcacctgagactggacgactgcgacttccagaccaaccacaccctgaagcagaccctgagctgctacagcgaggtgtgggtggtgccctggctgcagcacttcgaggtgcccgtgctgagatgccactag

SEQ ID NO: 10332 - DNA, 453 bp, Artificial Sequence
  Description of Artificial Sequence: Synthetic coding sequence
atgctgggcgccgccctgagaagatgcgccgtggccgccaccaccagagccgaccccagaggcctgctgcacagcgccagaacccccggccccgccgtggccatccagagcgtgagatgctacagccacggcagccaggagaccgacgaggagttcgacgccagatgggtgacctacttcaacaagcccgacatcgacgcctgggagctgagaaagggcatcaacaccctggtgacctacgacatggtgcccgagcccaagatcatcgacgccgccctgagagcctgcagaagactgaacgacttcgccagcaccgtgagaatcctggaggtggtgaaggacaaggccggcccccacaaggagatctacccctacgtgatccaggagctgagacccaccctgaacgagctgggcatcagcacccccgaggagctgggcctggacaaggtgtag

SEQ ID NO: 10333 - DNA, 318 bp, Artificial Sequence
  Description of Artificial Sequence: Synthetic coding sequence
atgggcgacgtggagaagggcaagaagatcttcatcatgaagtgcagccagtgccacaccgtggagaagggcggcaagcacaagaccggccccaacctgcacggcctgttcggcagaaagaccggccaggcccccggctacagctacaccgccgccaacaagaacaagggcatcatctggggcgaggacaccctgatggagtacctggagaaccccaagaagtacatccccggcaccaagatgatcttcgtgggcatcaagaagaaggaggagagagccgacctgatcgcctacctgaagaaggccaccaacgagtag

SEQ ID NO: 10334 - DNA, 318 bp, Artificial Sequence; identical to SEQ ID NO: 10333
  Description of Artificial Sequence: Synthetic coding sequence

SEQ ID NO: 10335 - DNA, 318 bp, Artificial Sequence; identical to SEQ ID NO: 10333
  Description of Artificial Sequence: Synthetic coding sequence

SEQ ID NO: 10336 - DNA, 306 bp, Artificial Sequence
  Description of Artificial Sequence: Synthetic coding sequence
atgggcgacgtggagaagggcaagaagatcttcatcatgaagtgcagccagtgccacaccgtggagaagggcggcaagcacaagaccggccccaacctgcacggcctgttcggcagaaagaccggccaggcccccggctacagctacaccgccgccaacaagaacaagggcatcatctggggcgaggacaccctgatggagtacctggagaaccccaagaagtacatccccggcaccaagatgatcttcgtgggcatcaagaagaaggaggagagagccgacctgatcgcctacctgaagaagtag

SEQ ID NO: 10337 - DNA, 1632 bp, Artificial Sequence
  Description of Artificial Sequence: Synthetic coding sequence
atgggcaccagcctgagccccaacgacccctggcccctgaaccccctgagcatccagcagaccaccctgctgctgctgctgagcgtgctggccaccgtgcacgtgggccagagactgctgagacagagaagaagacagctgagaagcgccccccccggccccttcgcctggcccctgatcggcaacgccgccgccgtgggccaggccgcccacctgagcttcgccagactggccagaagatacggcgacgtgttccagatcagactgggcagctgccccatcgtggtgctgaacggcgagagagccatccaccaggccctggtgcagcagggcagcgccttcgccgacagacccgccttcgccagcttcagagtggtgagcggcggcagaagcatggccttcggccactacagcgagcactggaaggtgcagagaagagccgcccacagcatgatgagaaacttcttcaccagacagcccagaagcagacaggtgctggagggccacgtgctgagcgaggccagagagctggtggccctgctggtgagaggcagcgccgacggcgccttcctggaccccagacccctgaccgtggtggccgtggccaacgtgatgagcgccgtgtgcttcggctgcagatacagccacgacgaccccgagttcagagagctgctgagccacaacgaggagttcggcagaaccgtgggcgccggcagcctggtggacgtgatgccctggctgcagtacttccccaaccccgtgagaaccgtgttcagagagttcgagcagctgaacagaaacttcagcaacttcatcctggacaagttcctgagacactgcgagagcctgagacccggcgccgcccccagagacatgatggacgccttcatcctgagcgccgagaagaaggccgccggcgacagccacggcggcggcgccagactggacctggagaacgtgcccgccaccatcaccgacatcttcggcgccagccaggacaccctgagcaccgccctgcagtggctgctgctgctgttcaccagataccccgacgtgcagaccagagtgcaggccgagctggaccaggtggtgggcagagacagactgccctgcatgggcgaccagcccaacctgccctacgtgctggccttcctgtacgaggccatgagattcagcagcttcgtgcccgtgaccatcccccacgccaccaccgccaacaccagcgtgctgggctaccacatccccaaggacaccgtggtgttcgtgaaccagtggagcgtgaaccacgaccccgtgaagtggcccaaccccgagaacttcgaccccgccagattcctggacaaggacggcctgatcaacaaggacctgaccagcagagtgatgatcttcagcgtgggcaagagaagatgcatcggcgaggagctgagcaagatgcagctgttcctgttcatcagcatcctggcccaccagtgcgacttcagagccaaccccaacgagcccgccaagatgaacttcagctacggcctgaccatcaagcccaagagcttcaaggtgaacgtgaccctgagagagagcatggagctgctggacagcgccgtgcagaacctgcaggccaaggagacctgccagtag

SEQ ID NO: 10338 - DNA, 1632 bp, Artificial Sequence; identical to SEQ ID NO: 10337
  Description of Artificial Sequence: Synthetic coding sequence

SEQ ID NO: 10339 - DNA, 3399 bp, Artificial Sequence
  Description of Artificial Sequence: Synthetic coding sequence
atggagcccgacagcctgctggaccaggacgacagctacgagagcccccaggagagacccggcagcagaagaagcctgcccggcagcctgagcgagaagagccccagcatggagcccagcgccgccacccccttcagagtgaccggcttcctgagcagaagactgaagggcagcatcaagagaaccaagagccagcccaagctggacagaaaccacagcttcagacacatcctgcccggcttcagaagcgccgccgccgccgccgccgacaacgagagaagccacctgatgcccagactgaaggagagcagaagccacgagagcctgctgagccccagcagcgccgtggaggccctggacctgagcatggaggaggaggtggtgatcaagcccgtgcacagcagcatcctgggccaggactactgcttcgaggtgaccaccagcagcggcagcaagtgcttcagctgcagaagcgccgccgagagagacaagtggatggagaacctgagaagagccgtgcaccccaacaaggacaacagcagaagagtggagcacatcctgaagctgtgggtgatcgaggccaaggacctgcccgccaagaagaagtacctgtgcgagctgtgcctggacgacgtgctgtacgccagaaccaccggcaagctgaagaccgacaacgtgttctggggcgagcacttcgagttccacaacctgccccccctgagaaccgtgaccgtgcacctgtacagagagaccgacaagaagaagaagaaggagagaaacagctacctgggcctggtgagcctgcccgccgccagcgtggccggcagacagttcgtggagaagtggtaccccgtggtgacccccaaccccaagggcggcaagggccccggccccatgatcagaatcaaggccagataccagaccatcaccatcctgcccatggagatgtacaaggagttcgccgagcacatcaccaaccactacctgggcctgtgcgccgccctggagcccatcctgagcgccaagaccaaggaggagatggccagcgccctggtgcacatcctgcagagcaccggcaaggtgaaggacttcctgaccgacctgatgatgagcgaggtggacagatgcggcgacaacgagcacctgatcttcagagagaacaccctggccaccaaggccatcgaggagtacctgaagctggtgggccagaagtacctgcaggacgccctgggcgagttcatcaaggccctgtacgagagcgacgagaactgcgaggtggaccccagcaagtgcagcgccgccgacctgcccgagcaccagggcaacctgaagatgtgctgcgagctggccttctgcaagatcatcaacagctactgcgtgttccccagagagctgaaggaggtgttcgccagctggagacaggagtgcagcagcagaggcagacccgacatcagcgagagactgatcagcgccagcctgttcctgagattcctgtgccccgccatcatgagccccagcctgttcaacctgctgcaggagtaccccgacgacagaaccgccagaaccctgaccctgatcgccaaggtgacccagaacctggccaacttcgccaagttcggcagcaaggaggagtacatgagcttcatgaaccagttcctggagcacgagtggaccaacatgcagagattcctgctggagatcagcaaccccgagaccctgagcaacaccgccggcttcgagggctacatcgacctgggcagagagctgagcagcctgcacagcctgctgtgggaggccgtgagccagctggagcagagcatcgtgagcaagctgggccccctgcccagaatcctgagagacgtgcacaccgccctgagcacccccggcagcggccagctgcccggcaccaacgacctggccagcacccccggcagcggcagcagcagcatcagcgccggcctgcagaagatggtgatcgagaacgacctgagcggcctgatcgacttcaccagactgcccagccccacccccgagaacaaggacctgttcttcgtgaccagaagcagcggcgtgcagcccagccccgccagaagcagcagctacagcgaggccaacgagcccgacctgcagatggccaacggcggcaagagcctgagcatggtggacctgcaggacgccagaaccctggacggcgaggccggcagccccgccggccccgacgtgctgcccaccgacggccaggccgccgccgcccagctggtggccggctggcccgccagagccacccccgtgaacctggccggcctggccaccgtgagaagagccggccagacccccaccacccccggcaccagcgagggcgcccccggcagaccccagctgctggcccccctgagcttccagaaccccgtgtaccagatggccgccggcctgcccctgagccccagaggcctgggcgacagcggcagcgagggccacagcagcctgagcagccacagcaacagcgaggagctggccgccgccgccaagctgggcagcttcagcaccgccgccgaggagctggccagaagacccggcgagctggccagaagacagatgagcctgaccgagaagggcggccagcccaccgtgcccagacagaacagcgccggcccccagagaagaatcgaccagccccccccccccccccccccccccccccccgcccccagaggcagaaccccccccaacctgctgagcaccctgcagtaccccagacccagcagcggcaccctggccagcgccagccccgactgggtgggccccagcaccagactgagacagcagagcagcagcagcaagggcgacagccccgagctgaagcccagagccgtgcacaagcagggccccagccccgtgagccccaacgccctggacagaaccgccgcctggctgctgaccatgaacgcccagctgctggaggacgagggcctgggccccgaccccccccacagagacagactgagaagcaaggacgagctgagccaggccgagaaggacctggccgtgctgcaggacaagctgagaatcagcaccaagaagctggaggagtacgagaccctgttcaagtgccaggaggagaccacccagaagctggtgctggagtaccaggccagactggaggagggcgaggagagactgagaagacagcaggaggacaaggacatccagatgaagggcatcatcagcagactgatgagcgtggaggaggagctgaagaaggaccacgccgagatgcaggccgccgtggacagcaagcagaagatcatcgacgcccaggagaagagaatcgccagcctggacgccgccaacgccagactgatgagcgccctgacccagctgaaggagagcatgcactag

SEQ ID NO: 10340 - DNA, 3198 bp, Artificial Sequence
  Description of Artificial Sequence: Synthetic coding sequence
atgcccagactgaaggagagcagaagccacgagagcctgctgagccccagcagcgccgtggaggccctggacctgagcatggaggaggaggtggtgatcaagcccgtgcacagcagcatcctgggccaggactactgcttcgaggtgaccaccagcagcggcagcaagtgcttcagctgcagaagcgccgccgagagagacaagtggatggagaacctgagaagagccgtgcaccccaacaaggacaacagcagaagagtggagcacatcctgaagctgtgggtgatcgaggccaaggacctgcccgccaagaagaagtacctgtgcgagctgtgcctggacgacgtgctgtacgccagaaccaccggcaagctgaagaccgacaacgtgttctggggcgagcacttcgagttccacaacctgccccccctgagaaccgtgaccgtgcacctgtacagagagaccgacaagaagaagaagaaggagagaaacagctacctgggcctggtgagcctgcccgccgccagcgtggccggcagacagttcgtggagaagtggtaccccgtggtgacccccaaccccaagggcggcaagggccccggccccatgatcagaatcaaggccagataccagaccatcaccatcctgcccatggagatgtacaaggagttcgccgagcacatcaccaaccactacctgggcctgtgcgccgccctggagcccatcctgagcgccaagaccaaggaggagatggccagcgccctggtgcacatcctgcagagcaccggcaaggtgaaggacttcctgaccgacctgatgatgagcgaggtggacagatgcggcgacaacgagcacctgatcttcagagagaacaccctggccaccaaggccatcgaggagtacctgaagctggtgggccagaagtacctgcaggacgccctgggcgagttcatcaaggccctgtacgagagcgacgagaactgcgaggtggaccccagcaagtgcagcgccgccgacctgcccgagcaccagggcaacctgaagatgtgctgcgagctggccttctgcaagatcatcaacagctactgcgtgttccccagagagctgaaggaggtgttcgccagctggagacaggagtgcagcagcagaggcagacccgacatcagcgagagactgatcagcgccagcctgttcctgagattcctgtgccccgccatcatgagccccagcctgttcaacctgctgcaggagtaccccgacgacagaaccgccagaaccctgaccctgatcgccaaggtgacccagaacctggccaacttcgccaagttcggcagcaaggaggagtacatgagcttcatgaaccagttcctggagcacgagtggaccaacatgcagagattcctgctggagatcagcaaccccgagaccctgagcaacaccgccggcttcgagggctacatcgacctgggcagagagctgagcagcctgcacagcctgctgtgggaggccgtgagccagctggagcagagcatcgtgagcaagctgggccccctgcccagaatcctgagagacgtgcacaccgccctgagcacccccggcagcggccagctgcccggcaccaacgacctggccagcacccccggcagcggcagcagcagcatcagcgccggcctgcagaagatggtgatcgagaacgacctgagcggcctgatcgacttcaccagactgcccagccccacccccgagaacaaggacctgttcttcgtgaccagaagcagcggcgtgcagcccagccccgccagaagcagcagctacagcgaggccaacgagcccgacctgcagatggccaacggcggcaagagcctgagcatggtggacctgcaggacgccagaaccctggacggcgaggccggcagccccgccggccccgacgtgctgcccaccgacggccaggccgccgccgcccagctggtggccggctggcccgccagagccacccccgtgaacctggccggcctggccaccgtgagaagagccggccagacccccaccacccccggcaccagcgagggcgcccccggcagaccccagctgctggcccccctgagcttccagaaccccgtgtaccagatggccgccggcctgcccctgagccccagaggcctgggcgacagcggcagcgagggccacagcagcctgagcagccacagcaacagcgaggagctggccgccgccgccaagctgggcagcttcagcaccgccgccgaggagctggccagaagacccggcgagctggccagaagacagatgagcctgaccgagaagggcggccagcccaccgtgcccagacagaacagcgccggcccccagagaagaatcgaccagccccccccccccccccccccccccccccccgcccccagaggcagaaccccccccaacctgctgagcaccctgcagtaccccagacccagcagcggcaccctggccagcgccagccccgactgggtgggccccagcaccagactgagacagcagagcagcagcagcaagggcgacagccccgagctgaagcccagagccgtgcacaagcagggccccagccccgtgagccccaacgccctggacagaaccgccgcctggctgctgaccatgaacgcccagctgctggaggacgagggcctgggccccgaccccccccacagagacagactgagaagcaaggacgagctgagccaggccgagaaggacctggccgtgctgcaggacaagctgagaatcagcaccaagaagctggaggagtacgagaccctgttcaagtgccaggaggagaccacccagaagctggtgctggagtaccaggccagactggaggagggcgaggagagactgagaagacagcaggaggacaaggacatccagatgaagggcatcatcagcagactgatgagcgtggaggaggagctgaagaaggaccacgccgagatgcaggccgccgtggacagcaagcagaagatcatcgacgcccaggagaagagaatcgccagcctggacgccgccaacgccagactgatgagcgccctgacccagctgaaggagagatacagcatgcaggccagaaacggcatcagccccaccaaccccaccaagctgcagatcaccgagaacggcgagttcagaaacagcagcaactgctag

SEQ ID NO: 10341 - DNA, 3210 bp, Artificial Sequence
  Description of Artificial Sequence: Synthetic coding sequence
agccagcccaagctggacagaaaccacagcttcagacacatcctgcccggcttcagaagcgccgccgccgccgccgccgacaacgagagaagccacctgatgcccagactgaaggagagcagaagccacgagagcctgctgagccccagcagcgccgtggaggccctggacctgagcatggaggaggaggtggtgatcaagcccgtgcacagcagcatcctgggccaggactactgcttcgaggtgaccaccagcagcggcagcaagtgcttcagctgcagaagcgccgccgagagagacaagtggatggagaacctgagaagagccgtgcaccccaacaaggacaacagcagaagagtggagcacatcctgaagctgtgggtgatcgaggccaaggacctgcccgccaagaagaagtacctgtgcgagctgtgcctggacgacgtgctgtacgccagaaccaccggcaagctgaagaccgacaacgtgttctggggcgagcacttcgagttccacaacctgccccccctgagaaccgtgaccgtgcacctgtacagagagaccgacaagaagaagaagaaggagagaaacagctacctgggcctggtgagcctgcccgccgccagcgtggccggcagacagttcgtggagaagtggtaccccgtggtgacccccaaccccaagggcggcaagggccccggccccatgatcagaatcaaggccagataccagaccatcaccatcctgcccatggagatgtacaaggagttcgccgagcacatcaccaaccactacctgggcctgtgcgccgccctggagcccatcctgagcgccaagaccaaggaggagatggccagcgccctggtgcacatcctgcagagcaccggcaaggtgaaggacttcctgaccgacctgatgatgagcgaggtggacagatgcggcgacaacgagcacctgatcttcagagagaacaccctggccaccaaggccatcgaggagtacctgaagctggtgggccagaagtacctgcaggacgccctgggcgagttcatcaaggccctgtacgagagcgacgagaactgcgaggtggaccccagcaagtgcagcgccgccgacctgcccgagcaccagggcaacctgaagatgtgctgcgagctggccttctgcaagatcatcaacagctactgcgtgttccccagagagctgaaggaggtgttcgccagctggagacaggagtgcagcagcagaggcagacccgacatcagcgagagactgatcagcgccagcctgttcctgagattcctgtgccccgccatcatgagccccagcctgttcaacctgctgcaggagtaccccgacgacagaaccgccagaaccctgaccctgatcgccaaggtgacccagaacctggccaacttcgccaagttcggcagcaaggaggagtacatgagcttcatgaaccagttcctggagcacgagtggaccaacatgcagagattcctgctggagatcagcaaccccgagaccctgagcaacaccgccggcttcgagggctacatcgacctgggcagagagctgagcagcctgcacagcctgctgtgggaggccgtgagccagctggagcagagcatcgtgagcaagctgggccccctgcccagaatcctgagagacgtgcacaccgccctgagcacccccggcagcggccagctgcccggcaccaacgacctggccagcacccccggcagcggcagcagcagcatcagcgccggcctgcagaagatggtgatcgagaacgacctgagcggcctgatcgacttcaccagactgcccagccccacccccgagaacaaggacctgttcttcgtgaccagaagcagcggcgtgcagcccagccccgccagaagcagcagctacagcgaggccaacgagcccgacctgcagatggccaacggcggcaagagcctgagcatggtggacctgcaggacgccagaaccctggacggcgaggccggcagccccgccggccccgacgtgctgcccaccgacggccaggccgccgccgcccagctggtggccggctggcccgccagagccacccccgtgaacctggccggcctggccaccgtgagaagagccggccagacccccaccacccccggcaccagcgagggcgcccccggcagaccccagctgctggcccccctgagcttccagaaccccgtgtaccagatggccgccggcctgcccctgagccccagaggcctgggcgacagcggcagcgagggccacagcagcctgagcagccacagcaacagcgaggagctggccgccgccgccaagctgggcagcttcagcaccgccgccgaggagctggccagaagacccggcgagctggccagaagacagatgagcctgaccgagaagggcggccagcccaccgtgcccagacagaacagcgccggcccccagagaagaatcgaccagccccccccccccccccccccccccccccccgcccccagaggcagaaccccccccaacctgctgagcaccctgcagtaccccagacccagcagcggcaccctggccagcgccagccccgactgggtgggccccagcaccagactgagacagcagagcagcagcagcaagggcgacagccccgagctgaagcccagagccgtgcacaagcagggccccagccccgtgagccccaacgccctggacagaaccgccgcctggctgctgaccatgaacgcccagctgctggaggacgagggcctgggccccgaccccccccacagagacagactgagaagcaaggacgagctgagccaggccgagaaggacctggccgtgctgcaggacaagctgagaatcagcaccaagaagctggaggagtacgagaccctgttcaagtgccaggaggagaccacccagaagctggtgctggagtaccaggccagactggaggagggcgaggagagactgagaagacagcaggaggacaaggacatccagatgaagggcatcatcagcagactgatgagcgtggaggaggagctgaagaaggaccacgccgagatgcaggccgccgtggacagcaagcagaagatcatcgacgcccaggagaagagaatcgccagcctggacgccgccaacgccagactgatgagcgccctgacccagctgaaggagagcatgcactag

SEQ ID NO: 10342 - DNA, 876 bp, Artificial Sequence
  Description of Artificial Sequence: Synthetic coding sequence
atggagcccgacagcctgctggaccaggacgacagctacgagagcccccaggagagacccggcagcagaagaagcctgcccggcagcctgagcgagaagagccccagcatggagcccagcgccgccacccccttcagagtgaccggcttcctgagcagaagactgaagggcagcatcaagagaaccaagagccagcccaagctggacagaaaccacagcttcagacacatcctgcccggcttcagaagcgccgccgccgccgccgccgacaacgagagaagccacctgatgcccagactgaaggagagcagaagccacgagagcctgctgagccccagcagcgccgtggaggccctggacctgagcatggaggaggaggtggtgatcaagcccgtgcacagcagcatcctgggccaggactactgcttcgaggtgaccaccagcagcggcagcaagtgcttcagctgcagaagcgccgccgagagagacaagtggatggagaacctgagaagagccgtgcaccccaacaaggacaacagcagaagagtggagcacatcctgaagctgtgggtgatcgaggccaaggacctgcccgccaagaagaagtacctgtgcgagctgtgcctggacgacgtgctgtacgccagaaccaccggcaagctgaagaccgacaacgtgttctggggcgagcacttcgagttccacaacctgccccccctgagaaccgtgaccgtgcacctgtacagagagaccgacaagaagaagaagaaggagagaaacagctacctgggcctggtgagcctgcccgccgccagcgtggccggcagacagttcgtggagaagtggtaccccgtggtgacccccaaccccaagtag

SEQ ID NO: 10343 - DNA, 3570 bp, Artificial Sequence
  Description of Artificial Sequence: Synthetic coding sequence
atgagcgccggcggcagcgccagaaagagcaccggcagaagcagctactactacagactgctgagaagacccagactgcagagacagagaagcagaagcagaagcagaaccagacccgccagagagagcccccaggagagacccggcagcagaagaagcctgcccggcagcctgagcgagaagagccccagcatggagcccagcgccgccacccccttcagagtgaccggcttcctgagcagaagactgaagggcagcatcaagagaaccaagagccagcccaagctggacagaaaccacagcttcagacacatcctgcccggcttcagaagcgccgccgccgccgccgccgacaacgagagaagccacctgatgcccagactgaaggagagcagaagccacgagagcctgctgagccccagcagcgccgtggaggccctggacctgagcatggaggaggaggtggtgatcaagcccgtgcacagcagcatcctgggccaggactactgcttcgaggtgaccaccagcagcggcagcaagtgcttcagctgcagaagcgccgccgagagagacaagtggatggagaacctgagaagagccgtgcaccccaacaaggacaacagcagaagagtggagcacatcctgaagctgtgggtgatcgaggccaaggacctgcccgccaagaagaagtacctgtgcgagctgtgcctggacgacgtgctgtacgccagaaccaccggcaagctgaagaccgacaacgtgttctggggcgagcacttcgagttccacaacctgccccccctgagaaccgtgaccgtgcacctgtacagagagaccgacaagaagaagaagaaggagagaaacagctacctgggcctggtgagcctgcccgccgccagcgtggccggcagacagttcgtggagaagtggtaccccgtggtgacccccaaccccaagggcggcaagggccccggccccatgatcagaatcaaggccagataccagaccatcaccatcctgcccatggagatgtacaaggagttcgccgagcacatcaccaaccactacctgggcctgtgcgccgccctggagcccatcctgagcgccaagaccaaggaggagatggccagcgccctggtgcacatcctgcagagcaccggcaaggtgaaggacttcctgaccgacctgatgatgagcgaggtggacagatgcggcgacaacgagcacctgatcttcagagagaacaccctggccaccaaggccatcgaggagtacctgaagctggtgggccagaagtacctgcaggacgccctgggcgagttcatcaaggccctgtacgagagcgacgagaactgcgaggtggaccccagcaagtgcagcgccgccgacctgcccgagcaccagggcaacctgaagatgtgctgcgagctggccttctgcaagatcatcaacagctactgcgtgttccccagagagctgaaggaggtgttcgccagctggagacaggagtgcagcagcagaggcagacccgacatcagcgagagactgatcagcgccagcctgttcctgagattcctgtgccccgccatcatgagccccagcctgttcaacctgctgcaggagtaccccgacgacagaaccgccagaaccctgaccctgatcgccaaggtgacccagaacctggccaacttcgccaagttcggcagcaaggaggagtacatgagcttcatgaaccagttcctggagcacgagtggaccaacatgcagagattcctgctggagatcagcaaccccgagaccctgagcaacaccgccggcttcgagggctacatcgacctgggcagagagctgagcagcctgcacagcctgctgtgggaggccgtgagccagctggagcagagcatcgtgagcaagctgggccccctgcccagaatcctgagagacgtgcacaccgccctgagcacccccggcagcggccagctgcccggcaccaacgacctggccagcacccccggcagcggcagcagcagcatcagcgccggcctgcagaagatggtgatcgagaacgacctgagcggcctgatcgacttcaccagactgcccagccccacccccgagaacaaggacctgttcttcgtgaccagaagcagcggcgtgcagcccagccccgccagaagcagcagctacagcgaggccaacgagcccgacctgcagatggccaacggcggcaagagcctgagcatggtggacctgcaggacgccagaaccctggacggcgaggccggcagccccgccggccccgacgtgctgcccaccgacggccaggccgccgccgcccagctggtggccggctggcccgccagagccacccccgtgaacctggccggcctggccaccgtgagaagagccggccagacccccaccacccccggcaccagcgagggcgcccccggcagaccccagctgctggcccccctgagcttccagaaccccgtgtaccagatggccgccggcctgcccctgagccccagaggcctgggcgacagcggcagcgagggccacagcagcctgagcagccacagcaacagcgaggagctggccgccgccgccaagctgggcagcttcagcaccgccgccgaggagctggccagaagacccggcgagctggccagaagacagatgagcctgaccgagaagggcggccagcccaccgtgcccagacagaacagcgccggcccccagagaagaatcgaccagccccccccccccccccccccccccccccccgcccccagaggcagaaccccccccaacctgctgagcaccctgcagtaccccagacccagcagcggcaccctggccagcgccagccccgactgggtgggccccagcaccagactgagacagcagagcagcagcagcaagggcgacagccccgagctgaagcccagagccgtgcacaagcagggccccagccccgtgagccccaacgccctggacagaaccgccgcctggctgctgaccatgaacgcccagctgctggaggacgagggcctgggccccgaccccccccacagagacagactgagaagcaaggacgagctgagccaggccgagaaggacctggccgtgctgcaggacaagctgagaatcagcaccaagaagctggaggagtacgagaccctgttcaagtgccaggaggagaccacccagaagctggtgctggagtaccaggccagactggaggagggcgaggagagactgagaagacagcaggaggacaaggacatccagatgaagggcatcatcagcagactgatgagcgtggaggaggagctgaagaaggaccacgccgagatgcaggccgccgtggacagcaagcagaagatcatcgacgcccaggagaagagaatcgccagcctggacgccgccaacgccagactgatgagcgccctgacccagctgaaggagagatacagcatgcaggccagaaacggcatcagccccaccaaccccaccaagctgcagatcaccgagaacggcgagttcagaaacagcagcaactgctag

SEQ ID NO: 10344 - DNA, 690 bp, Artificial Sequence
  Description of Artificial Sequence: Synthetic coding sequence
atgcccagactgaaggagagcagaagccacgagagcctgctgagccccagcagcgccgtggaggccctggacctgagcatggaggaggaggtggtgatcaagcccgtgcacagcagcatcctgggccaggactactgcttcgaggtgaccaccagcagcggcagcaagtgcttcagctgcagaagcgccgccgagagagacaagtggatggagaacctgagaagagccgtgcaccccaacaaggacaacagcagaagagtggagcacatcctgaagctgtgggtgatcgaggccaaggacctgcccgccaagaagaagtacctgtgcgagctgtgcctggacgacgtgctgtacgccagaaccaccggcaagctgaagaccgacaacgtgttctggggcgagcacttcgagttccacaacctgccccccctgagaaccgtgaccgtgcacctgtacagagagaccgacaagaagaagaagaaggagagaaacagctacctgggcctggtgagcctgcccgccgccagcgtggccggcagacagttcgtggagaagtggtaccccgtggtgacccccaaccccaagggcggcaagggccccggccccatgatcagaatcaaggccagataccagaccatcaccatcctgcccatggagatgtacaaggagttcgccgagcacatcacctag

SEQ ID NO: 10345 - DNA, 3423 bp, Artificial Sequence
  Description of Artificial Sequence: Synthetic coding sequence
atgagctacaactacgtggtgaccgcccagaagcccaccgccgtgaacggctgcgtgaccggccacttcaccagcgccgaggacctgaacctgctgatcgccaagaacaccagactggagatctacgtggtgaccgccgagggcctgagacccgtgaaggaggtgggcatgtacggcaagatcgccgtgatggagctgttcagacccaagggcgagagcaaggacctgctgttcatcctgaccgccaagtacaacgcctgcatcctggagtacaagcagagcggcgagagcatcgacatcatcaccagagcccacggcaacgtgcaggacagaatcggcagacccagcgagaccggcatcatcggcatcatcgaccccgagtgcagaatgatcggcctgagactgtacgacggcctgttcaaggtgatccccctggacagagacaacaaggagctgaaggccttcaacatcagactggaggagctgcacgtgatcgacgtgaagttcctgtacggctgccaggcccccaccatctgcttcgtgtaccaggacccccagggcagacacgtgaagacctacgaggtgagcctgagagagaaggagttcaacaagggcccctggaagcaggagaacgtggaggccgaggccagcatggtgatcgccgtgcccgagcccttcggcggcgccatcatcatcggccaggagagcatcacctaccacaacggcgacaagtacctggccatcgccccccccatcatcaagcagagcaccatcgtgtgccacaacagagtggaccccaacggcagcagatacctgctgggcgacatggagggcagactgttcatgctgctgctggagaaggaggagcagatggacggcaccgtgaccctgaaggacctgagagtggagctgctgggcgagaccagcatcgccgagtgcctgacctacctggacaacggcgtggtgttcgtgggcagcagactgggcgacagccagctggtgaagctgaacgtggacagcaacgagcagggcagctacgtggtggccatggagaccttcaccaacctgggccccatcgtggacatgtgcgtggtggacctggagagacagggccagggccagctggtgacctgcagcggcgccttcaaggagggcagcctgagaatcatcagaaacggcatcggcatccacgagcacgccagcatcgacctgcccggcatcaagggcctgtggcccctgagaagcgaccccaacagagagaccgacgacaccctggtgctgagcttcgtgggccagaccagagtgctgatgctgaacggcgaggaggtggaggagaccgagctgatgggcttcgtggacgaccagcagaccttcttctgcggcaacgtggcccaccagcagctgatccagatcaccagcgccagcgtgagactggtgagccaggagcccaaggccctggtgagcgagtggaaggagccccaggccaagaacatcagcgtggccagctgcaacagcagccaggtggtggtggccgtgggcagagccctgtactacctgcagatccacccccaggagctgagacagatcagccacaccgagatggagcacgaggtggcctgcctggacatcacccccctgggcgacagcaacggcctgagccccctgtgcgccatcggcctgtggaccgacatcagcgccagaatcctgaagctgcccagcttcgagctgctgcacaaggagatgctgggcggcgagatcatccccagaagcatcctgatgaccaccttcgagagcagccactacctgctgtgcgccctgggcgacggcgccctgttctacttcggcctgaacatcgagaccggcctgctgagcgacagaaagaaggtgaccctgggcacccagcccaccgtgctgagaaccttcagaagcctgagcaccaccaacgtgttcgcctgcagcgacagacccaccgtgatctacagcagcaaccacaagctggtgttcagcaacgtgaacctgaaggaggtgaactacatgtgccccctgaacagcgacggctaccccgacagcctggccctggccaacaacagcaccctgaccatcggcaccatcgacgagatccagaagctgcacatcagaaccgtgcccctgtacgagagccccagaaagatctgctaccaggaggtgagccagtgcttcggcgtgctgagcagcagaatcgaggtgcaggacaccagcggcggcaccaccgccctgagacccagcgccagcacccaggccctgagcagcagcgtgagcagcagcaagctgttcagcagcagcaccgccccccacgagaccagcttcggcgaggaggtggaggtgcacaacctgctgatcatcgaccagcacaccttcgaggtgctgcacgcccaccagttcctgcagaacgagtacgccctgagcctggtgagctgcaagctgggcaaggaccccaacacctacttcatcgtgggcaccgccatggtgtaccccgaggaggccgagcccaagcagggcagaatcgtggtgttccagtacagcgacggcaagctgcagaccgtggccgagaaggaggtgaagggcgccgtgtacagcatggtggagttcaacggcaagctgctggccagcatcaacagcaccgtgagactgtacgagtggaccaccgagaaggagctgagaaccgagtgcaaccactacaacaacatcatggccctgtacctgaagaccaagggcgacttcatcctggtgggcgacctgatgagaagcgtgctgctgctggcctacaagcccatggagggcaacttcgaggagatcgccagagacttcaaccccaactggatgagcgccgtggagatcctggacgacgacaacttcctgggcgccgagaacgccttcaacctgttcgtgtgccagaaggacagcgccgccaccaccgacgaggagagacagcacctgcaggaggtgggcctgttccacctgggcgagttcgtgaacgtgttctgccacggcagcctggtgatgcagaacctgggcgagaccagcacccccacccagggcagcgtgctgttcggcaccgtgaacggcatgatcggcctggtgaccagcctgagcgagagctggtacaacctgctgctggacatgcagaacagactgaacaaggtgatcaagagcgtgggcaagatcgagcacagcttctggagaagcttccacaccgagagaaagaccgagcccgccaccggcttcatcgacggcgacctgatcgagagcttcctggacatcagcagacccaagatgcaggaggtggtggccaacctgcagtacgacgacggcagcggcatgaagagagaggccaccgccgacgacctgatcaaggtggtggaggagctgaccagaatccactag

SEQ ID NO: 10346 - DNA, 1356 bp, Artificial Sequence
  Description of Artificial Sequence: Synthetic coding sequence
atgagctacaactacgtggtgaccgcccagaagcccaccgccgtgaacggctgcgtgaccggccacttcaccagcgccgaggacctgaacctgctgatcgccaagaacaccagactggagatctacgtggtgaccgccgagggcctgagacccgtgaaggaggtgggcatgtacggcaagatcgccgtgatggagctgttcagacccaaggccctgagcagcagcgtgagcagcagcaagctgttcagcagcagcaccgccccccacgagaccagcttcggcgaggaggtggaggtgcacaacctgctgatcatcgaccagcacaccttcgaggtgctgcacgcccaccagttcctgcagaacgagtacgccctgagcctggtgagctgcaagctgggcaaggaccccaacacctacttcatcgtgggcaccgccatggtgtaccccgaggaggccgagcccaagcagggcagaatcgtggtgttccagtacagcgacggcaagctgcagaccgtggccgagaaggaggtgaagggcgccgtgtacagcatggtggagttcaacggcaagctgctggccagcatcaacagcaccgtgagactgtacgagtggaccaccgagaaggagctgagaaccgagtgcaaccactacaacaacatcatggccctgtacctgaagaccaagggcgacttcatcctggtgggcgacctgatgagaagcgtgctgctgctggcctacaagcccatggagggcaacttcgaggagatcgccagagacttcaaccccaactggatgagcgccgtggagatcctggacgacgacaacttcctgggcgccgagaacgccttcaacctgttcgtgtgccagaaggacagcgccgccaccaccgacgaggagagacagcacctgcaggaggtgggcctgttccacctgggcgagttcgtgaacgtgttctgccacggcagcctggtgatgcagaacctgggcgagaccagcacccccacccagggcagcgtgctgttcggcaccgtgaacggcatgatcggcctggtgaccagcctgagcgagagctggtacaacctgctgctggacatgcagaacagactgaacaaggtgatcaagagcgtgggcaagatcgagcacagcttctggagaagcttccacaccgagagaaagaccgagcccgccaccggcttcatcgacggcgacctgatcgagagcttcctggacatcagcagacccaagatgcaggaggtggtggccaacctgcagtacgacgacggcagcggcatgaagagagaggccaccgccgacgacctgatcaaggtggtggaggagctgaccagaatccactag

SEQ ID NO: 10347 - DNA, 441 bp, Artificial Sequence
  Description of Artificial Sequence: Synthetic coding sequence
atgagctacaactacgtggtgaccgcccagaagcccaccgccgtgaacggctgcgtgaccggccacttcaccagcgccgaggacctgaacctgctgatcgccaagaacaccagactggagatctacgtggtgaccgccgagggcctgagacccgtgaaggaggtgggcatgtacggcaagatcgccgtgatggagctgttcagacccaagggcgagagcaaggacctgctgttcatcctgaccgccaagtacaacgcctgcatcctggagtacaagcagagcggcgagagcatcgacatcatcaccagagcccacggcaacgtgcaggacagaatcggcagacccagcgagaccggcatcatcggcatcatcgaccccgagtgcagaatgatcggcctgagactgtacgacggcctgttcaaggtgatccccctggactag

SEQ ID NO: 10348 - DNA, 330 bp, Artificial Sequence
  Description of Artificial Sequence: Synthetic coding sequence
atgagctacaactacgtggtgaccgcccagaagcccaccgccgtgaacggctgcgtgaccggccacttcaccagcgccgaggacctgaacctgctgatcgccaagaacaccagactggagatctacgtggtgaccgccgagggcctgagacccgtgaaggaggtgggcatgtacggcaagatcgccgtgatggagctgttcagacccaagggcgagagcaaggacctgctgttcatcctgaccgccaagtacaacgcctgcatcctggagtacaagcagagcggcgagagcatcgacatcatcaccagagcccacggcaacgtgcagtag

SEQ ID NO: 10349 - DNA, 1284 bp, Artificial Sequence
  Description of Artificial Sequence: Synthetic coding sequence
atggcccccaagaagagacccgagacccagaagaccagcgagatcgtgctgagacccagaaacaagagaagcagaagccccctggagctggagcccgaggccaagaagctgtgcgccaagggcagcggccccagcagaagatgcgacagcgactgcctgtgggtgggcctggccggcccccagatcctgcccccctgcagaagcatcgtgagaaccctgcaccagcacaagctgggcagagccagctggcccagcgtgcagcagggcctgcagcagagcttcctgcacaccctggacagctacagaatcctgcagaaggccgcccccttcgacagaagagccaccagcctggcctggcaccccacccaccccagcaccgtggccgtgggcagcaagggcggcgacatcatgctgtggaacttcggcatcaaggacaagcccaccttcatcaagggcatcggcgccggcggcagcatcaccggcctgaagttcaaccccctgaacaccaaccagttctacgccagcagcatggagggcaccaccagactgcaggacttcaagggcaacatcctgagagtgttcgccagcagcgacaccatcaacatctggttctgcagcctggacgtgagcgccagcagcagaatggtggtgaccggcgacaacgtgggcaacgtgatcctgctgaacatggacggcaaggagctgtggaacctgagaatgcacaagaagaaggtgacccacgtggccctgaacccctgctgcgactggttcctggccaccgccagcgtggaccagaccgtgaagatctgggacctgagacaggtgagaggcaaggccagcttcctgtacagcctgccccacagacaccccgtgaacgccgcctgcttcagccccgacggcgccagactgctgaccaccgaccagaagagcgagatcagagtgtacagcgccagccagtgggactgccccctgggcctgatcccccacccccacagacacttccagcacctgacccccatcaaggccgcctggcaccccagatacaacctgatcgtggtgggcagataccccgaccccaacttcaagagctgcaccccctacgagctgagaaccatcgacgtgttcgacggcaacagcggcaagatgatgtgccagctgtacgaccccgagagcagcggcatcagcagcctgaacgagttcaaccccatgggcgacaccctggccagcgccatgggctaccacatcctgatctggagccaggaggaggccagaaccagaaagtag

SEQ ID NO: 10350 - DNA, 717 bp, Artificial Sequence
  Description of Artificial Sequence: Synthetic coding sequence
atggcccccaagaagagacccgagacccagaagaccagcgagatcgtgctgagacccagaaacaagagaagcagaagccccctggagctggagcccgaggccaagaagctgtgcgccaagggcagcggccccagcagaagatgcgacagcgactgcctgtgggtgggcctggccggcccccagatcctgcccccctgcagaagcatcgtgagaaccctgcaccagcacaagctgggcagagccagctggcccagcgtgcagcagggcctgcagcagagcttcctgcacaccctggacagctacagaatcctgcagaaggccgcccccttcgacagaagagccaccagcctggcctggcaccccacccaccccagcaccgtggccgtgggcagcaagggcggcgacatcatgctgtggaacttcggcatcaaggacaagcccaccttcatcaagggcgccgcctggcaccccagatacaacctgatcgtggtgggcagataccccgaccccaacttcaagagctgcaccccctacgagctgagaaccatcgacgtgttcgacggcaacagcggcaagatgatgtgccagctgtacgaccccgagagcagcggcatcagcagcctgaacgagttcaaccccatgggcgacaccctggccagcgccatgggctaccacatcctgatctggagccaggaggaggccagaaccagaaagtag

SEQ ID NO: 10351 - DNA, 735 bp, Artificial Sequence
  Description of Artificial Sequence: Synthetic coding sequence
atggcccccaagaagagacccgagacccagaagaccagcgagatcgtgctgagacccagaaacaagagaagcagaagccccctggagctggagcccgaggccaagaagctgtgcgccaagggcagcggccccagcagaagatgcgacagcgactgcctgtgggtgggcctggccggcccccagatcctgcccccctgcagaagcatcgtgagaaccctgcaccagcacaagctgggcagagccagctggcccagcgtgcagcagggcctgcagcagagcttcctgcacaccctggacagctacagaatcctgcagaaggccgcccccttcgacagaagagccaccagcctggcctggcaccccacccaccccagcaccgtggccgtgggcagcaagggcggcgacatcatgctgtggaacttcggcatcaaggacaagcccaccttcatcaagggcatcggcgccggcggcagcatcaccggcctgaagttcaaccccctgaacaccaaccagttctacgccagcagcatggagggcaccaccagactgcaggacttcaagggcaacatcctgagagtgttcgccagcagcgacaccatcaacatctggttctgcagcctggacgtgagcgccagcagcagaatggtggtgaccggcgacaacgtgggcaacgtgatcctgctgaacatggacggcaaggagctggtgagcgtgcccatggagcccggcagctag

SEQ ID NO: 10352 - DNA, 1092 bp, Artificial Sequence
  Description of Artificial Sequence: Synthetic coding sequence
atggcccccaagaagagacccgagacccagaagaccagcgagatcgtgctgagacccagaaacaagagaagcagaagccccctggagctggagcccgaggccaagaagctgtgcgccaagggcagcggccccagcagaagatgcgacagcgactgcctgtgggtgggcctggccggcccccagatcctgcccccctgcagaagcatcgtgagaaccctgcaccagcacaagctgggcagagccagctggcccagcgtgcagcagatcggcgccggcggcagcatcaccggcctgaagttcaaccccctgaacaccaaccagttctacgccagcagcatggagggcaccaccagactgcaggacttcaagggcaacatcctgagagtgttcgccagcagcgacaccatcaacatctggttctgcagcctggacgtgagcgccagcagcagaatggtggtgaccggcgacaacgtgggcaacgtgatcctgctgaacatggacggcaaggagctgtggaacctgagaatgcacaagaagaaggtgacccacgtggccctgaacccctgctgcgactggttcctggccaccgccagcgtggaccagaccgtgaagatctgggacctgagacaggtgagaggcaaggccagcttcctgtacagcctgccccacagacaccccgtgaacgccgcctgcttcagccccgacggcgccagactgctgaccaccgaccagaagagcgagatcagagtgtacagcgccagccagtgggactgccccctgggcctgatcccccacccccacagacacttccagcacctgacccccatcaaggccgcctggcaccccagatacaacctgatcgtggtgggcagataccccgaccccaacttcaagagctgcaccccctacgagctgagaaccatcgacgtgttcgacggcaacagcggcaagatgatgtgccagctgtacgaccccgagagcagcggcatcagcagcctgaacgagttcaaccccatgggcgacaccctggccagcgccatgggctaccacatcctgatctggagccaggaggaggccagaaccagaaagtag

SEQ ID NO: 10353 - DNA, 1119 bp, Artificial Sequence
  Description of Artificial Sequence: Synthetic coding sequence
atgagcgaggccggcgaggccaccaccaccaccaccaccaccctgccccaggcccccaccgaggccgccgccgccgccccccaggaccccgcccccaagagccccgtgggcagcggcgccccccaggccgccgcccccgcccccgccgcccacgtggccggcaaccccggcggcgacgccgcccccgccgccaccggcaccgccgccgccgccagcctggccaccgccgccggcagcgaggacgccgagaagaaggtgctggccaccaaggtgctgggcaccgtgaagtggttcaacgtgagaaacggctacggcttcatcaacagaaacgacaccaaggaggacgtgttcgtgcaccagaccgccatcaagaagaacaaccccagaaagtacctgagaagcgtgggcgacggcgagaccgtggagttcgacgtggtggagggcgagaagggcgccgaggccgccaacgtgaccggccccgacggcgtgcccgtggagggcagcagatacgccgccgacagaagaagatacagaagaggctactacggcagaagaagaggcccccccagaaactacgccggcgaggaggaggaggagggcagcggcagcagcgagggcttcgacccccccgccaccgacagacagttcagcggcgccagaaaccagctgagaagaccccagtacagaccccagtacagacagagaagattccccccctaccacgtgggccagaccttcgacagaagaagcagagtgctgccccaccccaacagaatccaggccggcgagatcggcgagatgaaggacggcgtgcccgagggcgcccagctgcagggccccgtgcacagaaaccccacctacagacccagatacagaagcagaggcccccccagacccagacccgcccccgccgtgggcgaggccgaggacaaggagaaccagcaggccaccagcggccccaaccagcccagcgtgagaagaggctacagaagaccctacaactacagaagaagacccagaccccccaacgcccccagccaggacggcaaggaggccaaggccggcgaggcccccaccgagaaccccgccccccccacccagcagagcagcgccgagtag

SEQ ID NO: 10354 - DNA, 867 bp, Artificial Sequence
  Description of Artificial Sequence: Synthetic coding sequence
atggccaacgagacccagaaggtgggcgccatccacttccccttccccttcaccccctacagcatccaggaggacttcatggccgagctgtacagagtgctggaggccggcaagatcggcatcttcgagagccccaccggcaccggcaagagcctgagcctgatctgcggcgccctgagctggctgagagacttcgagcagaagaagagagaggaggaggccagactgctggagaccggcaccggccccctgcacgacgagaaggacgagagcctgtgcctgagcagcagctgcgagggcgccgccggcacccccagacccgccggcgagcccgcctgggtgacccagttcgtgcagaagaaggaggagagagacctggtggacagactgaaggccgagcaggccagaagaaagcagagagaggagagactgcagcagctgcagcacagagtgcagctgaagtacgccgccaagagactgagacaggaggaggaggagagagagaacctgctgagactgagcagagagatgctggagaccggccccgaggccgagagactggagcagctggagagcggcgaggaggagctggtgctggccgagtacgagagcgacgaggagaagaaggtggccagcagagcccccagcgacgccaccagcagcagacacccccccgacgccagcttccccgccgccctgaacttcctgcagagaaccagacccagcagcgtgctgagcgaggacctgctgatgcagagagccgtggccaagcaccccgccctgctgccctggcagatgagcagcagccccctgagacccggcagcgagtggatgagaatgagaatgacctggagaaagaacacctag

SEQ ID NO: 10355 - DNA, 2571 bp, Artificial Sequence
  Description of Artificial Sequence: Synthetic coding sequence
atggccaacgagacccagaaggtgggcgccatccacttccccttccccttcaccccctacagcatccaggaggacttcatggccgagctgtacagagtgctggaggccggcaagatcggcatcttcgagagccccaccggcaccggcaagagcctgagcctgatctgcggcgccctgagctggctgagagacttcgagcagaagaagagagaggaggaggccagactgctggagaccggcaccggccccctgcacgacgagaaggacgagagcctgtgcctgagcagcagctgcgagggcgccgccggcacccccagacccgccggcgagcccgcctgggtgacccagttcgtgcagaagaaggaggagagagacctggtggacagactgaaggccgagcaggccagaagaaagcagagagaggagagactgcagcagctgcagcacagagtgcagctgaagtacgccgccaagagactgagacaggaggaggaggagagagagaacctgctgagactgagcagagagatgctggagaccggccccgaggccgagagactggagcagctggagagcggcgaggaggagctggtgctggccgagtacgagagcgacgaggagaagaaggtggccagcagagtggacgaggacgaggacgacctggaggaggagcacatcaccaagatctactactgcagcagaacccacagccagctggcccagttcgtgcacgaggtgaagaagagccccttcggcaaggacgtgagactggtgagcctgggcagcagacagaacctgtgcgtgaacgaggacgtgaagagcctgggcagcgtgcagctgatcaacgacagatgcgtggacatgcagagaagcagacacgagaagaagaagggcgccgaggaggagaagcccaagagaagaagacaggagaagcaggccgcctgccccttctacaaccacgagcagatgggcctgctgagagacgaggccctggccgaggtgaaggacatggagcagctgctggccctgggcaaggaggccagagcctgcccctactacggcagcagactggccatccccgccgcccagctggtggtgctgccctaccagatgctgctgcacgccgccaccagacaggccgccggcatcagactgcaggaccaggtggtgatcatcgacgaggcccacaacctgatcgacaccatcaccggcatgcacagcgtggaggtgagcggcagccagctgtgccaggcccacagccagctgctgcagtacgtggagagatacggcaagagactgaaggccaagaacctgatgtacctgaagcagatcctgtacctgctggagaagttcgtggccgtgctgggcggcaacatcaagcagaaccccaacacccagagcctgagccagaccggcaccgagctgaagaccatcaacgacttcctgttccagagccagatcgacaacatcaacctgttcaaggtgcagagatactgcgagaagagcatgatcagcagaaagctgttcggcttcaccgagagatacggcgccgtgttcagcagcagagagcagcccaagctggccggcttccagcagttcctgcagagcctgcagcccagaaccaccgaggccctggccgcccccgccgacgagagccaggccagcaccctgagacccgccagccccctgatgcacatccagggcttcctggccgccctgaccaccgccaaccaggacggcagagtgatcctgagcagacagggcagcctgagccagagcaccctgaagttcctgctgctgaaccccgccgtgcacttcgcccaggtggtgaaggagtgcagagccgtggtgatcgccggcggcaccatgcagcccgtgagcgacttcagacagcagctgctggcctgcgccggcgtggaggccgagagagtggtggagttcagctgcggccacgtgatcccccccgacaacatcctgcccctggtgatctgcagcggcatcagcaaccagcccctggagttcaccttccagaagagagagctgccccagatgatcttccaggagcccaagagcgcccaccaggtggagcaggtgctgctggcctacagcagatgcatccaggcctgcggccaggagagaggccaggtgaccggcgccctgctgctgagcgtggtgggcggcaagatgagcgagggcatcaacttcagcgacaacctgggcagatgcgtggtgatggtgggcatgcccttccccaacatcagaagcgccgagctgcaggagaagatggcctacctggaccagaccctgcccagagcccccggccaggccccccccggcaaggccctggtggagaacctgtgcatgaaggccgtgaaccagagcatcggcagagccatcagacaccagaaggacttcgccagcgtggtgctgctggaccagagatacgccagaccccccgtgctggccaagctgcccgcctggatcagagccagagtggaggtgaaggccaccttcggccccgccatcgccgccgtgcagaagttccacagagagaagagcgccagcagctag

SEQ ID NO: 10356 - DNA, 1671 bp, Artificial Sequence
  Description of Artificial Sequence: Synthetic coding sequence
gaggaggagcccctgtggcagggctgcagcgccggcctgccctggctgcccgccgagaagaagaagggcgccgaggaggagaagcccaagagaagaagacaggagaagcaggccgcctgccccttctacaaccacgagcagatgggcctgctgagagacgaggccctggccgaggtgaaggacatggagcagctgctggccctgggcaaggaggccagagcctgcccctactacggcagcagactggccatccccgccgcccagctggtggtgctgccctaccagatgctgctgcacgccgccaccagacaggccgccggcatcagactgcaggaccaggtggtgatcatcgacgaggcccacaacctgatcgacaccatcaccggcatgcacagcgtggaggtgagcggcagccagctgtgccaggcccacagccagctgctgcagtacgtggagagatacggcaagagactgaaggccaagaacctgatgtacctgaagcagatcctgtacctgctggagaagttcgtggccgtgctgggcggcaacatcaagcagaaccccaacacccagagcctgagccagaccggcaccgagctgaagaccatcaacgacttcctgttccagagccagatcgacaacatcaacctgttcaaggtgcagagatactgcgagaagagcatgatcagcagaaagctgttcggcttcaccgagagatacggcgccgtgttcagcagcagagagcagcccaagctggccggcttccagcagttcctgcagagcctgcagcccagaaccaccgaggccctggccgcccccgccgacgagagccaggccagcaccctgagacccgccagccccctgatgcacatccagggcttcctggccgccctgaccaccgccaaccaggacggcagagtgatcctgagcagacagggcagcctgagccagagcaccctgaagttcctgctgctgaaccccgccgtgcacttcgcccaggtggtgaaggagtgcagagccgtggtgatcgccggcggcaccatgcagcccgtgagcgacttcagacagcagctgctggcctgcgccggcgtggaggccgagagagtggtggagttcagctgcggccacgtgatcccccccgacaacatcctgcccctggtgatctgcagcggcatcagcaaccagcccctggagttcaccttccagaagagagagctgccccagatgatggacgaggtgggcagaatcctgtgcaacctgtgcggcgtggtgcccggcggcgtggtgtgcttcttccccagctacgagtacctgagacaggtgcacgcccactgggagaagggcggcctgctgggcagactggccgccagaaagaagatcttccaggagcccaagagcgcccaccaggtggagcaggtgctgctggcctacagcagatgcatccaggcctgcggccaggagagaggccaggtgaccggcgccctgctgctgagcgtggtgggcggcaagatgagcgagggcatcaacttcagcgacaacctgggcagatgcgtggtgatggtgggcatgcccttccccaacatcagaagcgccgagctgcaggagaagatggcctacctggaccagaccctggccggccccagcggcaccagaagaatcctgcccgcctag

SEQ ID NO: 10357 - DNA, 2913 bp, Artificial Sequence
  Description of Artificial Sequence: Synthetic coding sequence
atggccaacgagacccagaaggtgggcgccatccacttccccttccccttcaccccctacagcatccaggaggacttcatggccgagctgtacagagtgctggaggccggcaagatcggcatcttcgagagccccaccggcaccggcaagagcctgagcctgatctgcggcgccctgagctggctgagagacttcgagcagaagaagagagaggaggaggccagactgctggagaccggcaccggccccctgcacgacgagaaggacgagagcctgtgcctgagcagcagctgcgagggcgccgccggcacccccagacccgccggcgagcccgcctgggtgacccagttcgtgcagaagaaggaggagagagacctggtggacagactgaaggccgagcaggccagaagaaagcagagagaggagagactgcagcagctgcagcacagagtgcagctgaagtacgccgccaagagactgagacaggaggaggaggagagagagaacctgctgagactgagcagagagatgctggagaccggccccgaggccgagagactggagcagctggagagcggcgaggaggagctggtgctggccgagtacgagagcgacgaggagaagaaggtggccagcagagtggacgaggacgaggacgacctggaggaggagcacatcaccaagatctactactgcagcagaacccacagccagctggcccagttcgtgcacgaggtgaagaagagccccttcggcaaggacgtgagactggtgagcctgggcagcagacagaacctgtgcgtgaacgaggacgtgaagagcctgggcagcgtgcagctgatcaacgacagatgcgtggacatgcagagaagcagacacgagaagaagaagggcgccgaggaggagaagcccaagagaagaagacaggagaagcaggccgcctgccccttctacaaccacgagcagatgggcctgctgagagacgaggccctggccgaggtgaaggacatggagcagctgctggccctgggcaaggaggccagagcctgcccctactacggcagcagactggccatccccgccgcccagctggtggtgctgccctaccagatgctgctgcacgccgccaccagacaggccgccggcatcagactgcaggaccaggtggtgatcatcgacgaggcccacaacctgatcgacaccatcaccggcatgcacagcgtggaggtgagcggcagccagctgtgccaggcccacagccagctgctgcagtacgtggagagatacggcaagagactgaaggccaagaacctgatgtacctgaagcagatcctgtacctgctggagaagttcgtggccgtgctgggcggcaacatcaagcagaaccccaacacccagagcctgagccagaccggcaccgagctgaagaccatcaacgacttcctgttccagagccagatcgacaacatcaacctgttcaaggtgcagagatactgcgagaagagcatgatcagcagaaagctgttcggcttcaccgagagatacggcgccgtgttcagcagcagagagcagcccaagctggccggcttccagcagttcctgcagagcctgcagcccagaaccaccgaggccctggccgcccccgccgacgagagccaggccagcaccctgagacccgccagccccctgatgcacatccagggcttcctggccgccctgaccaccgccaaccaggacggcagagtgatcctgagcagacagggcagcctgagccagagcaccctgaagttcctgctgctgaaccccgccgtgcacttcgcccaggtggtgaaggagtgcagagccgtggtgatcgccggcggcaccatgcagcccgtgagcgacttcagacagcagctgctggcctgcgccggcgtggaggccgagagagtggtggagttcagctgcggccacgtgatcccccccgacaacatcctgcccctggtgatctgcagcggcatcagcaaccagcccctggagttcaccttccagaagagagagctgccccagatgatggacgaggtgggcagaatcctgtgcaacctgtgcggcgtggtgcccggcggcgtggtgtgcttcttccccagctacgagtacctgagacaggtgcacgcccactgggagaagggcggcctgctgggcagactggccgccagaaagaagatcttccaggagcccaagagcgcccaccaggtggagcaggtgctgctggcctacagcagatgcatccaggcctgcggccaggagagaggccaggtgaccggcgccctgctgctgagcgtggtgggcggcaagatgagcgagggcatcaacttcagcgacaacctgggcagatgcgtggtgatggtgggcatgcccttccccaacatcagaagcgccgagctgcaggagaagatggcctacctggaccagaccctgagccccagacccggcacccccagagagggcagcggcggcgagcccgtgcacgagggcagacagcccgtgcacagacagggccaccaggcccccgagggcttctgccagagaagcgcccccggccccgccatctgccccgccccctgccccggccaggccgccggcctggaccccagcccctgcggcggccagagctacctgtggcccagacactgctgctgcgccgaggtgagccccggcgaggtgggcctgttcctgatgggcaaccacaccaccgcctggagaagagccctgcccctgagctgccccctggagaccgtgttcgtggtgggcgtggtgtgcggcgaccccgtgaccaaggtgaagcccagaagaagagtgtggagccccgagtgctgccaggaccccggcaccggcgtgagcagcagaagaagaaagtggggcaaccccgagtag

SEQ ID NO: 10358 - DNA, 675 bp, Artificial Sequence
  Description of Artificial Sequence: Synthetic coding sequence
atggccgagctgtacagagtgctggaggccggcaagatcggcatcttcgagagccccaccggcaccggcaagagcctgagcctgatctgcggcgccctgagctggctgagagacttcgagcagaagaagagagaggaggaggccagactgctggagaccggcaccggccccctgcacgacgagaaggacgagagcctgtgcctgagcagcagctgcgagggcgccgccggcacccccagacccgccggcgagcccgcctgggtgacccagttcgtgcagaagaaggaggagagagacctggtggacagactgaaggccgagcaggccagaagaaagcagagagaggagagactgcagcagctgcagcacagagtgcagctgaagtacgccgccaagagactgagacaggaggaggaggagagagagaacctgctgagactgagcagagagatgctggagaccggccccgaggccgagagactggagcagctggagagcggcgaggaggagctggtgctggccgagtacgagagcgacgaggagaagaaggtggccagcagagtggacgaggacgaggacgacctggaggaggagcacatcaccaagatctactactgcagcagaacccacagccagctggcccagttcgtgcacgaggtgaagaagagcccctag

SEQ ID NO: 10359 - DNA, 2721 bp, Artificial Sequence
  Description of Artificial Sequence: Synthetic coding sequence
atggccaacgagacccagaaggtgggcgccatccacttccccttccccttcaccccctacagcatccaggaggacttcatggccgagctgtacagagtgctggaggccggcaagatcggcatcttcgagagccccaccggcaccggcaagagcctgagcctgatctgcggcgccctgagctggctgagagacttcgagcagaagaagagagaggaggaggccagactgctggagaccggcaccggccccctgcacgacgagaaggacgagagcctgtgcctgagcagcagctgcgagggcgccgccggcacccccagacccgccggcgagcccgcctgggtgacccagttcgtgcagaagaaggaggagagagacctggtggacagactgaaggccgagcaggccagaagaaagcagagagaggagagactgcagcagctgcagcacagagtgcagctgaagtacgccgccaagagactgagacaggaggaggaggagagagagaacctgctgagactgagcagagagatgctggagaccggccccgaggccgagagactggagcagctggagagcggcgaggaggagctggtgctggccgagtacgagagcgacgaggagaagaaggtggccagcagagtggacgaggacgaggacgacctggaggaggagcacatcaccaagatctactactgcagcagaacccacagccagctggcccagttcgtgcacgaggtgaagaagagccccttcggcaaggacgtgagactggtgagcctgggcagcagacagaacctgtgcgtgaacgaggacgtgaagagcctgggcagcgtgcagctgatcaacgacagatgcgtggacatgcagagaagcagacacgagaagaagaagggcgccgaggaggagaagcccaagagaagaagacaggagaagcaggccgcctgccccttctacaaccacgagcagatgggcctgctgagagacgaggccctggccgaggtgaaggacatggagcagctgctggccctgggcaaggaggccagagcctgcccctactacggcagcagactggccatccccgccgcccagctggtggtgctgccctaccagatgctgctgcacgccgccaccagacaggccgccggcatcagactgcaggaccaggtggtgatcatcgacgaggcccacaacctgatcgacaccatcaccggcatgcacagcgtggaggtgagcggcagccagctgtgccaggcccacagccagctgctgcagtacgtggagagatacggcaagagactgaaggccaagaacctgatgtacctgaagcagatcctgtacctgctggagaagttcgtggccgtgctgggcggcaacatcaagcagaaccccaacacccagagcctgagccagaccggcaccgagctgaagaccatcaacgacttcctgttccagagccagatcgacaacatcaacctgttcaaggtgcagagatactgcgagaagagcatgatcagcagaaagctgttcggcttcaccgagagatacggcgccgtgttcagcagcagagagcagcccaagctggccggcttccagcagttcctgcagagcctgcagcccagaaccaccgaggccctggccgcccccgccgacgagagccaggccagcaccctgagacccgccagccccctgatgcacatccagggcttcctggccgccctgaccaccgccaaccaggacggcagagtgatcctgagcagacagggcagcctgagccagagcaccctgaagttcctgctgctgaaccccgccgtgcacttcgcccaggtggtgaaggagtgcagagccgtggtgatcgccggcggcaccatgcagcccgtgagcgacttcagacagcagctgctggcctgcgccggcgtggaggccgagagagtggtggagttcagctgcggccacgtgatcccccccgacaacatcctgcccctggtgatctgcagcggcatcagcaaccagcccctggagttcaccttccagaagagagagctgccccagatgatggacgaggtgggcagaatcctgtgcaacctgtgcggcgtggtgcccggcggcgtggtgtgcttcttccccagctacgagtacctgagacaggtgcacgcccactgggagaagggcggcctgctgggcagactggccgccagaaagaagatcttccaggagcccaagagcgcccaccaggtggagcaggtgctgctggcctacagcagatgcatccaggcctgcggccaggagagaggccaggtgaccggcgccctgctgctgagcgtggtgggcggcaagatgagcgagggcatcaacttcagcgacaacctgggcagatgcgtggtgatggtgggcatgcccttccccaacatcagaagcgccgagctgcaggagaagatggcctacctggaccagaccctgcccagagcccccggccaggccccccccggcaaggccctggtggagaacctgtgcatgaaggccgtgaaccagagcatcggcagagccatcagacaccagaaggacttcgccagcgtggtgctgctggaccagagatacgccagaccccccgtgctggccaagctgcccgcctggatcagagccagagtggaggtgaaggccaccttcggccccgccatcgccgccgtgcagaagttccacagagagaagagcgccagcagctag

SEQ ID NO: 10360 - DNA, 2913 bp, Artificial Sequence; identical to SEQ ID NO: 10357
  Description of Artificial Sequence: Synthetic coding sequence

SEQ ID NO: 10361 - DNA, 4293 bp, Artificial Sequence
  Description of Artificial Sequence: Synthetic coding sequence
atgaccgtgttcagacaggagaacgtggacgactactacgacaccggcgaggagctgggcagcggccagttcgccgtggtgaagaagtgcagagagaagagcaccggcctgcagtacgccgccaagttcatcaagaagagaagaaccaagagcagcagaagaggcgtgagcagagaggacatcgagagagaggtgagcatcctgaaggagatccagcaccccaacgtgatcaccctgcacgaggtgtacgagaacaagaccgacgtgatcctgatcctggagctggtggccggcggcgagctgttcgacttcctggccgagaaggagagcctgaccgaggaggaggccaccgagttcctgaagcagatcctgaacggcgtgtactacctgcacagcctgcagatcgcccacttcgacctgaagcccgagaacatcatgctgctggacagaaacgtgcccaagcccagaatcaagatcatcgacttcggcctggcccacaagatcgacttcggcaacgagttcaagaacatcttcggcacccccgagttcgtggcccccgagatcgtgaactacgagcccctgggcctggaggccgacatgtggagcatcggcgtgatcacctacatcctgctgagcggcgccagccccttcctgggcgacaccaagcaggagaccctggccaacgtgagcgccgtgaactacgagttcgaggacgagtacttcagcaacaccagcgccctggccaaggacttcatcagaagactgctggtgaaggaccccaagaagagaatgaccatccaggacagcctgcagcacccctggatcaagcccaaggacacccagcaggccctgagcagaaaggccagcgccgtgaacatggagaagttcaagaagttcgccgccagaaagaagtggaagcagagcgtgagactgatcagcctgtgccagagactgagcagaagcttcctgagcagaagcaacatgagcgtggccagaagcgacgacaccctggacgaggaggacagcttcgtgatgaaggccatcatccacgccatcaacgacgacaacgtgcccggcctgcagcacctgctgggcagcctgagcaactacgacgtgaaccagcccaacaagcacggcaccccccccctgctgatcgccgccggctgcggcaacatccagatcctgcagctgctgatcaagagaggcagcagaatcgacgtgcaggacaagggcggcagcaacgccgtgtactgggccgccagacacggccacgtggacaccctgaagttcctgagcgagaacaagtgccccctggacgtgaaggacaagagcggcgagatggccctgcacgtggccgccagatacggccacgccgacgtggcccagctgctgtgcagcttcggcagcaaccccaacatccaggacaaggaggaggagacccccctgcactgcgccgcctggcacggctactacagcgtggccaaggccctgtgcgaggccggctgcaacgtgaacatcaagaacagagagggcgagacccccctgctgaccgccagcgccagaggctaccacgacatcgtggagtgcctggccgagcacggcgccgacctgaacgcctgcgacaaggacggccacatcgccctgcacctggccgtgagaagatgccagatggaggtgatcaagaccctgctgagccagggctgcttcgtggactaccaggacagacacggcaacacccccctgcacgtggcctgcaaggacggcaacatgcccatcgtggtggccctgtgcgaggccaactgcaacctggacatcagcaacaagtacggcagaacccccctgcacctggccgccaacaacggcatcctggacgtggtgagatacctgtgcctgatgggcgccagcgtggaggccctgaccaccgacggcaagaccgccgaggacctggccagaagcgagcagcacgagcacgtggccggcctgctggccagactgagaaaggacacccacagaggcctgttcatccagcagctgagacccacccagaacctgcagcccagaatcaagctgaagctgttcggccacagcggcagcggcaagaccaccctggtggagagcctgaagtgcggcctgctgagaagcttcttcagaagaagaagacccagactgagcagcaccaacagcagcagattcccccccagccccctggccagcaagcccaccgtgagcgtgagcatcaacaacctgtaccccggctgcgagaacgtgagcgtgagaagcagaagcatgatgttcgagcccggcctgaccaagggcatgctggaggtgttcgtggcccccacccaccacccccactgcagcgccgacgaccagagcaccaaggccatcgacatccagaacgcctacctgaacggcgtgggcgacttcagcgtgtgggagttcagcggcaaccccgtgtacttctgctgctacgactacttcgccgccaacgaccccaccagcatccacgtggtggtgttcagcctggaggagccctacgagatccagctgaaccaggtgatcttctggctgagcttcctgaagagcctggtgcccgtggaggagcccatcgccttcggcggcaagctgaagaaccccctgcaggtggtgctggtggccacccacgccgacatcatgaacgtgcccagacccgccggcggcgagttcggctacgacaaggacaccagcctgctgaaggagatcagaaacagattcggcaacgacctgcacatcagcaacaagctgttcgtgctggacgccggcgccagcggcagcaaggacatgaaggtgctgagaaaccacctgcaggagatcagaagccagatcgtgagcgtgtgcccccccatgacccacctgtgcgagaagatcatcagcaccctgcccagctggagaaagctgaacggccccaaccagctgatgagcctgcagcagttcgtgtacgacgtgcaggaccagctgaaccccctggccagcgaggaggacctgagaagaatcgcccagcagctgcacagcaccggcgagatcaacatcatgcagagcgagaccgtgcaggacgtgctgctgctggaccccagatggctgtgcaccaacgtgctgggcaagctgctgagcgtggagacccccagagccctgcaccactacagaggcagatacaccgtggaggacatccagagactggtgcccgacagcgacgtggaggagctgctgcagatcctggacgccatggacatctgcgccagagacctgagcagcggcaccatggtggacgtgcccgccctgatcaagaccgacaacctgcacagaagctgggccgacgaggaggacgaggtgatggtgtacggcggcgtgagaatcgtgcccgtggagcacctgacccccttcccctgcggcatcttccacaaggtgcaggtgaacctgtgcagatggatccaccagcagagcaccgagggcgacgccgacatcagactgtgggtgaacggctgcaagctggccaacagaggcgccgagctgctggtgctgctggtgaaccacggccagggcatcgaggtgcaggtgagaggcctggagaccgagaagatcaagtgctgcctgctgctggacagcgtgtgcagcaccatcgagaacgtgatggccaccaccctgcccggcctgctgaccgtgaagcactacctgagcccccagcagctgagagagcaccacgagcccgtgatgatctaccagcccagagacttcttcagagcccagaccctgaaggagaccagcctgaccaacaccatgggcggctacaaggagagcttcagcagcatcatgtgcttcggctgccacgacgtgtacagccaggccagcctgggcatggacatccacgccagcgacctgaacctgctgaccagaagaaagctgagcagactgctggacccccccgaccccctgggcaaggactggtgcctgctggccatgaacctgggcctgcccgacctggtggccaagtacaacaccagcaacggcgcccccaaggacttcctgcccagccccctgcacgccctgctgagagagtggaccacctaccccgagagcaccgtgggcaccctgatgagcaagctgagagagctgggcagaagagacgccgccgacttcctgctgaaggccagcagcgtgttcaagatcaacctggacggcaacggccaggaggcctacgccagcagctgcaacagcggcaccagctacaacagcatcagcagcgtggtgagcagatag

SEQ ID NO: 10362 - DNA, 4293 bp, Artificial Sequence; identical to SEQ ID NO: 10361
  Description of Artificial Sequence: Synthetic coding sequence

SEQ ID NO: 10363 - DNA, 4368 bp, Artificial Sequence
  Description of Artificial Sequence: Synthetic coding sequence
atgaccgtgttcagacaggagaacgtggacgactactacgacaccggcgaggagctgggcagcggccagttcgccgtggtgaagaagtgcagagagaagagcaccggcctgcagtacgccgccaagttcatcaagaagagaagaaccaagagcagcagaagaggcgtgagcagagaggacatcgagagagaggtgagcatcctgaaggagatccagcaccccaacgtgatcaccctgcacgaggtgtacgagaacaagaccgacgtgatcctgatcctggagctggtggccggcggcgagctgttcgacttcctggccgagaaggagagcctgaccgaggaggaggccaccgagttcctgaagcagatcctgaacggcgtgtactacctgcacagcctgcagatcgcccacttcgacctgaagcccgagaacatcatgctgctggacagaaacgtgcccaagcccagaatcaagatcatcgacttcggcctggcccacaagatcgacttcggcaacgagttcaagaacatcttcggcacccccgagttcgtggcccccgagatcgtgaactacgagcccctgggcctggaggccgacatgtggagcatcggcgtgatcacctacatcctgctgagcggcgccagccccttcctgggcgacaccaagcaggagaccctggccaacgtgagcgccgtgaactacgagttcgaggacgagtacttcagcaacaccagcgccctggccaaggacttcatcagaagactgctggtgaaggaccccaagaagagaatgaccatccaggacagcctgcagcacccctggatcaagcccaaggacacccagcaggccctgagcagaaaggccagcgccgtgaacatggagaagttcaagaagttcgccgccagaaagaagtggaagcagagcgtgagactgatcagcctgtgccagagactgagcagaagcttcctgagcagaagcaacatgagcgtggccagaagcgacgacaccctggacgaggaggacagcttcgtgatgaaggccatcatccacgccatcaacgacgacaacgtgcccggcctgcagcacctgctgggcagcctgagcaactacgacgtgaaccagcccaacaagcacggcaccccccccctgctgatcgccgccggctgcggcaacatccagatcctgcagctgctgatcaagagaggcagcagaatcgacgtgcaggacaagggcggcagcaacgccgtgtactgggccgccagacacggccacgtggacaccctgaagttcctgagcgagaacaagtgccccctggacgtgaaggacaagagcggcgagatggccctgcacgtggccgccagatacggccacgccgacgtggcccagctgctgtgcagcttcggcagcaaccccaacatccaggacaaggaggaggagacccccctgcactgcgccgcctggcacggctactacagcgtggccaaggccctgtgcgaggccggctgcaacgtgaacatcaagaacagagagggcgagacccccctgctgaccgccagcgccagaggctaccacgacatcgtggagtgcctggccgagcacggcgccgacctgaacgcctgcgacaaggacggccacatcgccctgcacctggccgtgagaagatgccagatggaggtgatcaagaccctgctgagccagggctgcttcgtggactaccaggacagacacggcaacacccccctgcacgtggcctgcaaggacggcaacatgcccatcgtggtggccctgtgcgaggccaactgcaacctggacatcagcaacaagtacggcagaacccccctgcacctggccgccaacaacggcatcctggacgtggtgagatacctgtgcctgatgggcgccagcgtggaggccctgaccaccgacggcaagaccgccgaggacctggccagaagcgagcagcacgagcacgtggccggcctgctggccagactgagaaaggacacccacagaggcctgttcatccagcagctgagacccacccagaacctgcagcccagaatcaagctgaagctgttcggccacagcggcagcggcaagaccaccctggtggagagcctgaagtgcggcctgctgagaagcttcttcagaagaagaagacccagactgagcagcaccaacagcagcagattcccccccagccccctggccagcaagcccaccgtgagcgtgagcatcaacaacctgtaccccggctgcgagaacgtgagcgtgagaagcagaagcatgatgttcgagcccggcctgaccaagggcatgctggaggtgttcgtggcccccacccaccacccccactgcagcgccgacgaccagagcaccaaggccatcgacatccagaacgcctacctgaacggcgtgggcgacttcagcgtgtgggagttcagcggcaaccccgtgtacttctgctgctacgactacttcgccgccaacgaccccaccagcatccacgtggtggtgttcagcctggaggagccctacgagatccagctgaaccaggtgatcttctggctgagcttcctgaagagcctggtgcccgtggaggagcccatcgccttcggcggcaagctgaagaaccccctgcaggtggtgctggtggccacccacgccgacatcatgaacgtgcccagacccgccggcggcgagttcggctacgacaaggacaccagcctgctgaaggagatcagaaacagattcggcaacgacctgcacatcagcaacaagctgttcgtgctggacgccggcgccagcggcagcaaggacatgaaggtgctgagaaaccacctgcaggagatcagaagccagatcgtgagcaagaccctgcccttcacccccgacatcctggtgggcgtgcccctgtggcaccaccagaagatcggcggcagccccgtgtgcccccccatgacccacctgtgcgagaagatcatcagcaccctgcccagctggagaaagctgaacggccccaaccagctgatgagcctgcagcagttcgtgtacgacgtgcaggaccagctgaaccccctggccagcgaggaggacctgagaagaatcgcccagcagctgcacagcaccggcgagatcaacatcatgcagagcgagaccgtgcaggacgtgctgctgctggaccccagatggctgtgcaccaacgtgctgggcaagctgctgagcgtggagacccccagagccctgcaccactacagaggcagatacaccgtggaggacatccagagactggtgcccgacagcgacgtggaggagctgctgcagatcctggacgccatggacatctgcgccagagacctgagcagcggcaccatggtggacgtgcccgccctgatcaagaccgacaacctgcacagaagctgggccgacgaggaggacgaggtgatggtgtacggcggcgtgagaatcgtgcccgtggagcacctgacccccttcccctgcggcatcttccacaaggtgcaggtgaacctgtgcagatggatccaccagcagagcaccgagggcgacgccgacatcagactgtgggtgaacggctgcaagctggccaacagaggcgccgagctgctggtgctgctggtgaaccacggccagggcatcgaggtgcaggtgagaggcctggagaccgagaagatcaagtgctgcctgctgctggacagcgtgtgcagcaccatcgagaacgtgatggccaccaccctgcccggcctgctgaccgtgaagcactacctgagcccccagcagctgagagagcaccacgagcccgtgatgatctaccagcccagagacttcttcagagcccagaccctgaaggagaccagcctgaccaacaccatgggcggctacaaggagagcttcagcagcatcatgtgcttcggctgccacgacgtgtacagccaggccagcctgggcatggacatccacgccagcgacctgaacctgctgaccagaagaaagctgagcagactgctggacccccccgaccccctgggcaaggactggtgcctgctggccatgaacctgggcctgcccgacctggtggccaagtacaacaccagcaacggcgcccccaaggacttcctgcccagccccctgcacgccctgctgagagagtggaccacctaccccgagagcaccgtgggcaccctgatgagcaagctgagagagctgggcagaagagacgccgccgacttcctgctgaaggccagcagcgtgttcaagatcaacctggacggcaacggccaggaggcctacgccagcagctgcaacagcggcaccagctacaacagcatcagcagcgtggtgagcagatag

SEQ ID NO: 10364 - DNA, 4293 bp, Artificial Sequence; identical to SEQ ID NO: 10361
  Description of Artificial Sequence: Synthetic coding sequence

SEQ ID NO: 10365 - DNA, 4095 bp, Artificial Sequence
  Description of Artificial Sequence: Synthetic coding sequence
atgaccgtgttcagacaggagaacgtggacgactactacgacaccggcgaggagctgggcagcggccagttcgccgtggtgaagaagtgcagagagaagagcaccggcctgcagtacgccgccaagttcatcaagaagagaagaaccaagagcagcagaagaggcgtgagcagagaggacatcgagagagaggtgagcatcctgaaggagatccagcaccccaacgtgatcaccctgcacgaggtgtacgagaacaagaccgacgtgatcctgatcctggagctggtggccggcggcgagctgttcgacttcctggccgagaaggagagcctgaccgaggaggaggccaccgagttcctgaagcagatcctgaacggcgtgtactacctgcacagcctgcagatcgcccacttcgacctgaagcccgagaacatcatgctgctggacagaaacgtgcccaagcccagaatcaagatcatcgacttcggcctggcccacaagatcgacttcggcaacgagttcaagaacatcttcggcacccccgagttcgtggcccccgagatcgtgaactacgagcccctgggcctggaggccgacatgtggagcatcggcgtgatcacctacatcctgctgagcggcgccagccccttcctgggcgacaccaagcaggagaccctggccaacgtgagcgccgtgaactacgagttcgaggacgagtacttcagcaacaccagcgccctggccaaggacttcatcagaagactgctggtgaaggaccccaagaagagaatgaccatccaggacagcctgcagcacccctggatcaagcccaaggacacccagcaggccctgagcagaaaggccagcgccgtgaacatggagaagttcaagaagttcgccgccagaaagaagtggaagcagagcgtgagactgatcagcctgtgccagagactgagcagaagcttcctgagcagaagcaacatgagcgtggccagaagcgacgacaccctggacgaggaggacagcttcgtgatgaaggccatcatccacgccatcaacgacgacaacgtgcccggcctgcagcacctgctgggcagcctgagcaactacgacgtgaaccagcccaacaagcacggcaccccccccctgctgatcgccgccggctgcggcaacatccagatcctgcagctgctgatcaagagaggcagcagaatcgacgtgcaggacaagggcggcagcaacgccgtgtactgggccgccagacacggccacgtggacaccctgaagttcctgagcgagaacaagtgccccctggacgtgaaggacaagagcggcgagatggccctgcacgtggccgccagatacggccacgccgacgtggcccagctgctgtgcagcttcggcagcaaccccaacatccaggacaaggaggaggagacccccctgcactgcgccgcctggcacggctactacagcgtggccaaggccctgtgcgaggccggctgcaacgtgaacatcaagaacagagagggcgagacccccctgctgaccgccagcgccagaggctaccacgacatcgtggagtgcctggccgagcacggcgccgacctgaacgcctgcgacaaggacggccacatcgccctgcacctggccgtgagaagatgccagatggaggtgatcaagaccctgctgagccagggctgcttcgtggactaccaggacagacacggcaacacccccctgcacgtggcctgcaaggacggcaacatgcccatcgtggtggccctgtgcgaggccaactgcaacctggacatcagcaacaagtacggcagaacccccctgcacctggccgccaacaacggcatcctggacgtggtgagatacctgtgcctgatgggcgccagcgtggaggccctgaccaccgacggcaagaccgccgaggacctggccagaagcgagcagcacgagcacgtggccggcctgctggccagactgagaaaggacacccacagaggcctgttcatccagcagctgagacccacccagaacctgcagcccagaatcaagctgaagctgttcggccacagcggcagcggcaagaccaccctggtggagagcctgaagtgcggcctgctgagaagcttcttcagaagaagaagacccagactgagcagcaccaacagcagcagattcccccccagccccctggccagcaagcccaccgtgagcgtgagcatcaacaacctgtaccccggctgcgagaacgtgagcgtgagaagcagaagcatgatgttcgagcccggcctgaccaagggcatgctggaggtgttcgtggcccccacccaccacccccactgcagcgccgacgaccagagcaccaaggccatcgacatccagaacgcctacctgaacgccttcggcggcaagctgaagaaccccctgcaggtggtgctggtggccacccacgccgacatcatgaacgtgcccagacccgccggcggcgagttcggctacgacaaggacaccagcctgctgaaggagatcagaaacagattcggcaacgacctgcacatcagcaacaagctgttcgtgctggacgccggcgccagcggcagcaaggacatgaaggtgctgagaaaccacctgcaggagatcagaagccagatcgtgagcgtgtgcccccccatgacccacctgtgcgagaagatcatcagcaccctgcccagctggagaaagctgaacggccccaaccagctgatgagcctgcagcagttcgtgtacgacgtgcaggaccagctgaaccccctggccagcgaggaggacctgagaagaatcgcccagcagctgcacagcaccggcgagatcaacatcatgcagagcgagaccgtgcaggacgtgctgctgctggaccccagatggctgtgcaccaacgtgctgggcaagctgctgagcgtggagacccccagagccctgcaccactacagaggcagatacaccgtggaggacatccagagactggtgcccgacagcgacgtggaggagctgctgcagatcctggacgccatggacatctgcgccagagacctgagcagcggcaccatggtggacgtgcccgccctgatcaagaccgacaacctgcacagaagctgggccgacgaggaggacgaggtgatggtgtacggcggcgtgagaatcgtgcccgtggagcacctgacccccttcccctgcggcatcttccacaaggtgcaggtgaacctgtgcagatggatccaccagcagagcaccgagggcgacgccgacatcagactgtgggtgaacggctgcaagctggccaacagaggcgccgagctgctggtgctgctggtgaaccacggccagggcatcgaggtgcaggtgagaggcctggagaccgagaagatcaagtgctgcctgctgctggacagcgtgtgcagcaccatcgagaacgtgatggccaccaccctgcccggcctgctgaccgtgaagcactacctgagcccccagcagctgagagagcaccacgagcccgtgatgatctaccagcccagagacttcttcagagcccagaccctgaaggagaccagcctgaccaacaccatgggcggctacaaggagagcttcagcagcatcatgtgcttcggctgccacgacgtgtacagccaggccagcctgggcatggacatccacgccagcgacctgaacctgctgaccagaagaaagctgagcagactgctggacccccccgaccccctgggcaaggactggtgcctgctggccatgaacctgggcctgcccgacctggtggccaagtacaacaccagcaacggcgcccccaaggacttcctgcccagccccctgcacgccctgctgagagagtggaccacctaccccgagagcaccgtgggcaccctgatgagcaagctgagagagctgggcagaagagacgccgccgacttcctgctgaaggccagcagcgtgttcaagatcaacctggacggcaacggccaggaggcctacgccagcagctgcaacagcggcaccagctacaacagcatcagcagcgtggtgagcagatag

SEQ ID NO: 10366 - DNA, 2223 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagaggcagcagcagcagcggcggcaagaagtgctacaagctggagaacgagaagctgttcgaggagttcctggagctgtgcaagatgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtgcaccgtgctgaaggcccacagcgccaagaagaagctgaacctggcccccgccgccaccaccagcaacgagcccagcggcaacaacccccccacccacctgagcctggaccccaccaacgccgagaacaccgccagccagagccccagaaccagaggcagcagaagacagatccagagactggagcagctgctggccctgtacgtggccgagatcagaagactgcaggagaaggagctggacctgagcgagctggacgaccccgacagcgcctacctgcaggaggccagactgaagagaaagctgatcagactgttcggcagactgtgcgagctgaaggactgcagcagcctgaccggcagagtgatcgagcagagaatcccctacagaggcaccagataccccgaggtgaacagaagaatcgagagactgatcaacaagcccggccccgacaccttccccgactacggcgacgtgctgagagccgtggagaaggccgccgccagacacagcctgggcctgcccagacagcagctgcagctgatggcccaggacgccttcagagacgtgggcatcagactgcaggagagaagacacctggacctgatctacaacttcggctgccacctgaccgacgactacagacccggcgtggaccccgccctgagcgaccccgtgctggccagaagactgagagagaacagaagcctggccatgagcagactggacgaggtgatcagcaagtacgccatgctgcaggacaagagcgaggagggcgagagaaagaagagaagagccagactgcagggcaccagcagccacagcgccgacacccccgaggccagcctggacagcggcgagggccccagcggcatggccagccagggctgccccagcgccagcagagccgagaccgacgacgaggacgacgaggagagcgacgaggaggaggaggaggaggaggaggaggaggaggaggaggccaccgacagcgaggaggaggaggacctggagcagatgcaggagggccaggaggacgacgaggaggaggacgaggaggaggaggccgccgccggcaaggacggcgacaagagccccatgagcagcctgcagatcagcaacgagaagaacctggagcccggcaagcagatcagcagaagcagcggcgagcagcagaacaagggcagaatcgtgagccccagcctgctgagcgaggagcccctggcccccagcagcatcgacgccgagagcaacggcgagcagcccgaggagctgaccctggaggaggagagccccgtgagccagctgttcgagctggagatcgaggccctgcccctggacacccccagcagcgtggagaccgacatcagcagcagcagaaagcagagcgaggagcccttcaccaccgtgctggagaacggcgccggcatggtgagcagcaccagcttcaacggcggcgtgagcccccacaactggggcgacagcggccccccctgcaagaagagcagaaaggagaagaagcagaccggcagcggccccctgggcaacagctacgtggagagacagagaagcgtgcacgagaagaacggcaagaagatctgcaccctgcccagcccccccagccccctggccagcctggcccccgtggccgacagcagcaccagagtggacagccccagccacggcctggtgaccagcagcctgtgcatccccagccccgccagactgagccagaccccccacagccagccccccagacccggcacctgcaagaccagcgtggccacccagtgcgaccccgaggagatcatcgtgctgagcgacagcgactag

SEQ ID NO: 10367 - DNA, 2223 bp, Artificial Sequence; identical to SEQ ID NO: 10366
  Description of Artificial Sequence: Synthetic coding sequence

SEQ ID NO: 10368 - DNA, 1998 bp, Artificial Sequence
  Description of Artificial Sequence: Synthetic coding sequence
atgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtgcaccgtgctgaaggcccacagcgccaagaagaagctgaacctggcccccgccgccaccaccagcaacgagcccagcggcaacaacccccccacccacctgagcctggaccccaccaacgccgagaacaccgccagccagagccccagaaccagaggcagcagaagacagatccagagactggagcagctgctggccctgtacgtggccgagatcagaagactgcaggagaaggagctggacctgagcgagctggacgaccccgacagcgcctacctgcaggaggccagactgaagagaaagctgatcagactgttcggcagactgtgcgagctgaaggactgcagcagcctgaccggcagagtgatcgagcagagaatcccctacagaggcaccagataccccgaggtgaacagaagaatcgagagactgatcaacaagcccggccccgacaccttccccgactacggcgacgtgctgagagccgtggagaaggccgccgccagacacagcctgggcctgcccagacagcagctgcagctgatggcccaggacgccttcagagacgtgggcatcagactgcaggagagaagacacctggacctgatctacaacttcggctgccacctgaccgacgactacagacccggcgtggaccccgccctgagcgaccccgtgctggccagaagactgagagagaacagaagcctggccatgagcagactggacgaggtgatcagcaagtacgccatgctgcaggacaagagcgaggagggcgagagaaagaagagaagagccagactgcagggcaccagcagccacagcgccgacacccccgaggccagcctggacagcggcgagggccccagcggcatggccagccagggctgccccagcgccagcagagccgagaccgacgacgaggacgacgaggagagcgacgaggaggaggaggaggaggaggaggaggaggaggaggaggccaccgacagcgaggaggaggaggacctggagcagatgcaggagggccaggaggacgacgaggaggaggacgaggaggaggaggccgccgccggcaaggacggcgacaagagccccatgagcagcctgcagatcagcaacgagaagaacctggagcccggcaagcagatcagcagaagcagcggcgagcagcagaacaagggcagaatcgtgagccccagcctgctgagcgaggagcccctggcccccagcagcatcgacgccgagagcaacggcgagcagcccgaggagctgaccctggaggaggagagccccgtgagccagctgttcgagctggagatcgaggccctgcccctggacacccccagcagcgtggagaccgacatcagcagcagcagaaagcagagcgaggagcccttcaccaccgtgctggagaacggcgccggcatggtgagcagcaccagcttcaacggcggcgtgagcccccacaactggggcgacagcggccccccctgcaagaagagcagaaaggagaagaagcagaccggcagcggccccctgggcaacagctacgtggagagacagagaagcgtgcacgagaagaacggcaagaagatctgcaccctgcccagcccccccagccccctggccagcctggcccccgtggccgacagcagcaccagagtggacagccccagccacggcctggtgaccagcagcctgtgcatccccagccccgccagactgagccagaccccccacagccagccccccagacccggcacctgcaagaccagcgtggccacccagtgcgaccccgaggagatcatcgtgctgagcgacagcgactag

SEQ ID NO: 10369 - DNA, 537 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagaggcagcagcagcagcggcggcaagaagtgctacaagctggagaacgagaagctgttcgaggagttcctggagctgtgcaagatgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtgcaccgtgctgaaggcccacagcgccaagaagaagctgaacctggcccccgccgccaccaccagcaacgagcccagcggcaacaacccccccacccacctgagcctggaccccaccaacgccgagaacaccgccagccagagctag

SEQ ID NO: 10370 - DNA, 147 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagatag

SEQ ID NO: 10371 - DNA, 393 bp, Artificial Sequence
  Description of Artificial Sequence: Synthetic coding sequence
atggccaccgccaacagcatcatcgtgctggacgacgacgacgaggacgaggccgccgcccagcccggccccagccaccccctgcccaacgccgccagccccggcgccgaggcccccagcagcagcgagccccacggcgccagaggcagcagcagcagcggcggcaagaagtgctacaagctggagaacgagaagctgttcgaggagttcctggagctgtgcaagatgcagaccgccgaccaccccgaggtggtgcccttcctgtacaacagacagcagagagcccacagcctgttcctggccagcgccgagttctgcaacatcctgagcagagtgctgagcagagccagaagcagacccgccaagctgtacgtgtacatcaacgagctgtag

SEQ ID NO: 10372 - DNA, 2316 bp, Artificial Sequence
  Description of Artificial Sequence: Synthetic coding sequence
ggcgtgcccgtgatcaagtggaagaaggacggcatccacctggccctgggcatggacgagagaaagcagcagctgagcaacggcagcctgctgatccagaacatcctgcacagcagacaccacaagcccgacgagggcctgtaccagtgcgaggccagcctgggcgacagcggcagcatcatcagcagaaccgccaaggtggccgtggccggccccctgagattcctgagccagaccgagagcgtgaccgccttcatgggcgacaccgtgctgctgaagtgcgaggtgatcggcgagcccatgcccaccatccactggcagaagaaccagcaggacctgacccccatccccggcgacagcagagtggtggtgctgcccagcggcgccctgcagatcagcagactgcagcccggcgacatcggcatctacagatgcagcgccagaaaccccgccagcagcagaaccggcaacgaggccgaggtgagaatcctgagcgaccccggcctgcacagacagctgtacttcctgcagagacccagcaacgtggtggccatcgagggcaaggacgccgtgctggagtgctgcgtgagcggctaccccccccccagcttcacctggctgagaggcgaggaggtgatccagctgagaagcaagaagtacagcctgctgggcggcagcaacctgctgatcagcaacgtgaccgacgacgacagcggcatgtacacctgcgtggtgacctacaagaacgagaacatcagcgccagcgccgagctgaccgtgctggtgcccccctggttcctgaaccaccccagcaacctgtacgcctacgagagcatggacatcgagttcgagtgcaccgtgagcggcaagcccgtgcccaccgtgaactggatgaagaacggcgacgtggtgatccccagcgactacttccagatcgtgggcggcagcaacctgagaatcctgggcgtggtgaagagcgacgagggcttctaccagtgcgtggccgagaacgaggccggcaacgcccagaccagcgcccagctgatcgtgcccaagcccgccatccccagcagcagcgtgctgcccagcgcccccagagacgtggtgcccgtgctggtgagcagcagattcgtgagactgagctggagaccccccgccgaggccaagggcaacatccagaccttcaccgtgttcttcagcagagagggcgacaacagagagagagccctgaacaccacccagcccggcagcctgcagctgaccgtgggcaacctgaagcccgaggccatgtacaccttcagagtggtggcctacaacgagtggggccccggcgagagcagccagcccatcaaggtggccacccagcccgagctgcaggtgcccggccccgtggagaacctgcaggccgtgagcaccagccccaccagcatcctgatcacctgggagccccccgcctacgccaacggccccgtgcagggctacagactgttctgcaccgaggtgagcaccggcaaggagcagaacatcgaggtggacggcctgagctacaagctggagggcctgaagaagttcaccgagtacagcctgagattcctggcctacaacagatacggccccggcgtgagcaccgacgacatcaccgtggtgaccctgagcgacgtgcccagcgcccccccccagaacgtgagcctggaggtggtgaacagcagaagcatcaaggtgagctggctgcccccccccagcggcacccagaacggcttcatcaccggctacaagatcagacacagaaagaccaccagaagaggcgagatggagaccctggagcccaacaacctgtggtacctgttcaccggcctggagaagggcagccagtacagcttccaggtgagcgccatgaccgtgaacggcaccggcccccccagcaactggtacaccgccgagacccccgagaacgacctggacgagagccaggtgcccgaccagcccagcagcctgcacgtgagaccccagaccaactgcatcatcatgagctggaccccccccctgaaccccaacatcgtggtgagaggctacatcatcggctacggcgtgggcagcccctacgccgagaccgtgagagtggacagcaagcagagatactacagcatcgagagactggagagcagcagccactacgtgatcagcctgaaggccttcaacaacgccggcgagggcgtgcccctgtacgagagcgccaccaccagaagcatcaccgtgagaagacacaacatcagcaagctgcacagcaacagaccccagaccaagcacaacgtgtag

SEQ ID NO: 10373 - DNA, 2694 bp, Artificial Sequence
  Description of Artificial Sequence: Synthetic coding sequence
atgggcgacaccgtgctgctgaagtgcgaggtgatcggcgagcccatgcccaccatccactggcagaagaaccagcaggacctgacccccatccccggcgacagcagagtggtggtgctgcccagcggcgccctgcagatcagcagactgcagcccggcgacatcggcatctacagatgcagcgccagaaaccccgccagcagcagaaccggcaacgaggccgaggtgagaatcctgagcgaccccggcctgcacagacagctgtacttcctgcagagacccagcaacgtggtggccatcgagggcaaggacgccgtgctggagtgctgcgtgagcggctaccccccccccagcttcacctggctgagaggcgaggaggtgatccagctgagaagcaagaagtacagcctgctgggcggcagcaacctgctgatcagcaacgtgaccgacgacgacagcggcatgtacacctgcgtggtgacctacaagaacgagaacatcagcgccagcgccgagctgaccgtgctggtgcccccctggttcctgaaccaccccagcaacctgtacgcctacgagagcatggacatcgagttcgagtgcaccgtgagcggcaagcccgtgcccaccgtgaactggatgaagaacggcgacgtggtgatccccagcgactacttccagatcgtgggcggcagcaacctgagaatcctgggcgtggtgaagagcgacgagggcttctaccagtgcgtggccgagaacgaggccggcaacgcccagaccagcgcccagctgatcgtgcccaagcccgccatccccagcagcagcgtgctgcccagcgcccccagagacgtggtgcccgtgctggtgagcagcagattcgtgagactgagctggagaccccccgccgaggccaagggcaacatccagaccttcaccgtgttcttcagcagagagggcgacaacagagagagagccctgaacaccacccagcccggcagcctgcagctgaccgtgggcaacctgaagcccgaggccatgtacaccttcagagtggtggcctacaacgagtggggccccggcgagagcagccagcccatcaaggtggccacccagcccgagctgcaggtgcccggccccgtggagaacctgcaggccgtgagcaccagccccaccagcatcctgatcacctgggagccccccgcctacgccaacggccccgtgcagggctacagactgttctgcaccgaggtgagcaccggcaaggagcagaacatcgaggtggacggcctgagctacaagctggagggcctgaagaagttcaccgagtacagcctgagattcctggcctacaacagatacggccccggcgtgagcaccgacgacatcaccgtggtgaccctgagcgacgtgcccagcgcccccccccagaacgtgagcctggaggtggtgaacagcagaagcatcaaggtgagctggctgcccccccccagcggcacccagaacggcttcatcaccggctacaagatcagacacagaaagaccaccagaagaggcgagatggagaccctggagcccaacaacctgtggtacctgttcaccggcctggagaagggcagccagtacagcttccaggtgagcgccatgaccgtgaacggcaccggcccccccagcaactggtacaccgccgagacccccgagaacgacctggacgagagccaggtgcccgaccagcccagcagcctgcacgtgagaccccagaccaactgcatcatcatgagctggaccccccccctgaaccccaacatcgtggtgagaggctacatcatcggctacggcgtgggcagcccctacgccgagaccgtgagagtggacagcaagcagagatactacagcatcgagagactggagagcagcagccactacgtgatcagcctgaaggccttcaacaacgccggcgagggcgtgcccctgtacgagagcgccaccaccagaagcatcaccgacctgagcacccccatgctgccccccgtgggcgtgcaggccgtggccctgacccacgacgccgtgagagtgagctgggccgacaacagcgtgcccaagaaccagaagaccagcgaggtgagactgtacaccgtgagatggagaaccagcttcagcgccagcgccaagtacaagagcgaggacaccaccagcctgagctacaccgccaccggcctgaagcccaacaccatgtacgagttcagcgtgatggtgaccaagaacagaagaagcagcacctggagcatgaccgcccacgccaccacctacgaggccgcccccaccagcgcccccaaggacctgaccgtgatcaccagagagggcaagcccagagccgtgatcgtgagctggcagccccccctggaggccaacggcaagatcaccgcctacatcctgttctacaccctggacaagaacatccccatcgacgactggatcatggagaccatcagcggcgacagactgacccaccagatcatggacctgaacctggacaccatgtactacttcagaatccaggccagaaacagcaagggcgtgggccccctgagcgaccccatcctgttcagaaccctgaaggtggagcaccccgacaagatggccaacgaccaggacaccggcgtgaccatcaacctggtgaacgaggtgctgctgggctag

SEQ ID NO: 10374 - DNA, 4344 bp, Artificial Sequence
  Description of Artificial Sequence: Synthetic coding sequence
atggagaacagcctgagatgcgtgtgggtgcccaagctggccttcgtgctgttcggcgccagcctgttcagcgcccacctgcaggtgaccggcttccagatcaaggccttcaccgccctgagattcctgagcgagcccagcgacgccgtgaccatgagaggcggcaacgtgctgctggactgcagcgccgagagcgacagaggcgtgcccgtgatcaagtggaagaaggacggcatccacctggccctgggcatggacgagagaaagcagcagctgagcaacggcagcctgctgatccagaacatcctgcacagcagacaccacaagcccgacgagggcctgtaccagtgcgaggccagcctgggcgacagcggcagcatcatcagcagaaccgccaaggtggccgtggccggccccctgagattcctgagccagaccgagagcgtgaccgccttcatgggcgacaccgtgctgctgaagtgcgaggtgatcggcgagcccatgcccaccatccactggcagaagaaccagcaggacctgacccccatccccggcgacagcagagtggtggtgctgcccagcggcgccctgcagatcagcagactgcagcccggcgacatcggcatctacagatgcagcgccagaaaccccgccagcagcagaaccggcaacgaggccgaggtgagaatcctgagcgaccccggcctgcacagacagctgtacttcctgcagagacccagcaacgtggtggccatcgagggcaaggacgccgtgctggagtgctgcgtgagcggctaccccccccccagcttcacctggctgagaggcgaggaggtgatccagctgagaagcaagaagtacagcctgctgggcggcagcaacctgctgatcagcaacgtgaccgacgacgacagcggcatgtacacctgcgtggtgacctacaagaacgagaacatcagcgccagcgccgagctgaccgtgctggtgcccccctggttcctgaaccaccccagcaacctgtacgcctacgagagcatggacatcgagttcgagtgcaccgtgagcggcaagcccgtgcccaccgtgaactggatgaagaacggcgacgtggtgatccccagcgactacttccagatcgtgggcggcagcaacctgagaatcctgggcgtggtgaagagcgacgagggcttctaccagtgcgtggccgagaacgaggccggcaacgcccagaccagcgcccagctgatcgtgcccaagcccgccatccccagcagcagcgtgctgcccagcgcccccagagacgtggtgcccgtgctggtgagcagcagattcgtgagactgagctggagaccccccgccgaggccaagggcaacatccagaccttcaccgtgttcttcagcagagagggcgacaacagagagagagccctgaacaccacccagcccggcagcctgcagctgaccgtgggcaacctgaagcccgaggccatgtacaccttcagagtggtggcctacaacgagtggggccccggcgagagcagccagcccatcaaggtggccacccagcccgagctgcaggtgcccggccccgtggagaacctgcaggccgtgagcaccagccccaccagcatcctgatcacctgggagccccccgcctacgccaacggccccgtgcagggctacagactgttctgcaccgaggtgagcaccggcaaggagcagaacatcgaggtggacggcctgagctacaagctggagggcctgaagaagttcaccgagtacagcctgagattcctggcctacaacagatacggccccggcgtgagcaccgacgacatcaccgtggtgaccctgagcgacgtgcccagcgcccccccccagaacgtgagcctggaggtggtgaacagcagaagcatcaaggtgagctggctgcccccccccagcggcacccagaacggcttcatcaccggctacaagatcagacacagaaagaccaccagaagaggcgagatggagaccctggagcccaacaacctgtggtacctgttcaccggcctggagaagggcagccagtacagcttccaggtgagcgccatgaccgtgaacggcaccggcccccccagcaactggtacaccgccgagacccccgagaacgacctggacgagagccaggtgcccgaccagcccagcagcctgcacgtgagaccccagaccaactgcatcatcatgagctggaccccccccctgaaccccaacatcgtggtgagaggctacatcatcggctacggcgtgggcagcccctacgccgagaccgtgagagtggacagcaagcagagatactacagcatcgagagactggagagcagcagccactacgtgatcagcctgaaggccttcaacaacgccggcgagggcgtgcccctgtacgagagcgccaccaccagaagcatcaccgaccccaccgaccccgtggactactaccccctgctggacgacttccccaccagcgtgcccgacctgagcacccccatgctgccccccgtgggcgtgcaggccgtggccctgacccacgacgccgtgagagtgagctgggccgacaacagcgtgcccaagaaccagaagaccagcgaggtgagactgtacaccgtgagatggagaaccagcttcagcgccagcgccaagtacaagagcgaggacaccaccagcctgagctacaccgccaccggcctgaagcccaacaccatgtacgagttcagcgtgatggtgaccaagaacagaagaagcagcacctggagcatgaccgcccacgccaccacctacgaggccgcccccaccagcgcccccaaggacctgaccgtgatcaccagagagggcaagcccagagccgtgatcgtgagctggcagccccccctggaggccaacggcaagatcaccgcctacatcctgttctacaccctggacaagaacatccccatcgacgactggatcatggagaccatcagcggcgacagactgacccaccagatcatggacctgaacctggacaccatgtactacttcagaatccaggccagaaacagcaagggcgtgggccccctgagcgaccccatcctgttcagaaccctgaaggtggagcaccccgacaagatggccaacgaccagggcagacacggcgacggcggctactggcccgtggacaccaacctgatcgacagaagcaccctgaacgagccccccatcggccagatgcaccccccccacggcagcgtgaccccccagaagaacagcaacctgctggtgatcatcgtggtgaccgtgggcgtgatcaccgtgctggtggtggtgatcgtggccgtgatctgcaccagaagaagcagcgcccagcagagaaagaagagagccacccacagcgccggcaagagaaagggcagccagaaggacctgagaccccccgacctgtggatccaccacgaggagatggagatgaagaacatcgagaagcccagcggcaccgaccccgccggcagagacagccccatccagagctgccaggacctgacccccgtgagccacagccagagcgagacccagctgggcagcaagagcaccagccacagcggccaggacaccgaggaggccggcagcagcatgagcaccctggagagaagcctggccgccagaagagcccccagagccaagctgatgatccccatggacgcccagagcaacaaccccgccgtggtgagcgccatccccgtgcccaccctggagagcgcccagtaccccggcatcctgcccagccccacctgcggctacccccacccccagttcaccctgagacccgtgcccttccccaccctgagcgtggacagaggcttcggcgccggcagaagccagagcgtgagcgagggccccaccacccagcagccccccatgctgccccccagccagcccgagcacagcagcagcgaggaggcccccagcagaaccatccccaccgcctgcgtgagacccacccaccccctgagaagcttcgccaaccccctgctgcccccccccatgagcgccatcgagcccaaggtgccctacacccccctgctgagccagcccggccccaccctgcccaagacccacgtgaagaccgccagcctgggcctggccggcaaggccagaagccccctgctgcccgtgagcgtgcccaccgcccccgaggtgagcgaggagagccacaagcccaccgaggacagcgccaacgtgtacgagcaggacgacctgagcgagcagatggccagcctggagggcctgatgaagcagctgaacgccatcaccggcagcgccttctag

SEQ ID NO: 10375 - DNA, 213 bp, Artificial Sequence
  Description of Artificial Sequence: Synthetic coding sequence
atgaccatgaacgtgctggaggccggcaagtggaagagcatcgtgcccgcccccggcgagggcctgctggccgtgctgcacatgatggtgttcaccgacgccctgcacagagagagaagcgtgaagtggcaggccggcgtgtgctacaacggcggcaaggacttcgccgtgagcctggccagacccaaggccgccgagggcatcgccgactag

SEQ ID NO: 10376 - DNA, 1392 bp, Artificial Sequence
  Description of Artificial Sequence: Synthetic coding sequence
atgagcgtggccatcagaaagagaagctgggaggagcacgtgacccactggatgggccagcccttcaacagcgacgacagaaacaccgcctgccaccacggcctggtggccgacagcctgcaggccagcatggagaaggacgccaccctgaacgtggacagaaaggagaagtgcgtgagcctgcccgactgctgccacggcagcgagctgagagacttccccggcagacccatgggccacctgagcaaggacgtggacgagaacgacagccacgagggcgaggaccagttcctgagcctggaggccagcaccgagaccctggtgcacgtgagcgacgaggacaacaacgccgacctgtgcctgaccgacgacaagcaggtgctgaacacccagggccagaagaccagcggccagcacatgatccagggcgccggcagcctggagaaggccctgcccatcatccagagcaaccaggtgagcagcaacagctggggcatcgccggcgagaccgagctggccctggtgaaggagagcggcgagagaaaggtgaccgacagcatcagcaagagcctggagctgtgcaacgagatcagcctgagcgagatcaaggacgcccccaaggtgaacgccgtggacaccctgaacgtgaaggacatcgcccccgagaagcagctgctgaacagcgccgtgatcgcccagcagagaagaaagcccgacccccccaaggacgagaacgagagaagcacctgcaacgtggtgcagaacgagttcctggacaccccctgcaccaacagaggcctgcccctgctgaagaccgacttcggcagctgcctgctgcagccccccagctgccccaacggcatgagcgccgagaacggcctggagaagagcggcttcagccagcaccagaacaagagcccccccaaggtgaaggccgaggacggcatgcagtgcctgcagctgaaggagaccctggccacccaggagcccaccgacaaccaggtgagactgagaaagagaaaggagatcagagaggacagagacagagccagactggacagcatggtgctgctgatcatgaagctggaccagctggaccaggacatcgagaacgccctgagcaccagcagcagccccagcggcacccccaccaacctgagaagacacgtgcccgacctggagagcggcagcgagagcggcgccgacaccatcagcgtgaaccagaccagagtgaacctgagcagcgacaccgagagcaccgacctgcccagcagcacccccgtggccaacagcggcaccaagcccaagaccaccgccatccagggcatcagcgagaaggagaaggccggcaagctgaccttctggttctgcttcctggccaacctgttctag

SEQ ID NO: 10377 - DNA, 5268 bp, Artificial Sequence
  Description of Artificial Sequence: Synthetic coding sequence
atggagaccagaagcagcaagaccagaagaagcctggccagcagaaccaacgagtgccagggcaccatgtgggcccccaccagcccccccgccggcagcagcagccccagccagcccacctggaagagcagcctgtacagcagcctggcctacagcgaggccttccactacagcttcgccgccagacccagaagactgacccagctggccctggcccagagacccgagccccagctgctgagactgagacccagcagcctgagaacccaggacatcagccacctgctgaccggcgtgttcagaaacctgtacagcgccgaggtgatcggcgacgaggtgagcgccagcctgatcaaggccagaggcagcgagaacgagagacacgaggagttcgtggaccagctgcagcagatcagagagctgtacaagcagagactggacgagttcgagatgctggagagacacatcacccaggcccaggccagagccatcgccgagaacgagagagtgatgagccaggccggcgtgcaggacctggagagcctggtgagactgccccccgtgaagagcgtgagcagatggtgcatcgacagcgagctgctgagaaagcaccacctgatcagccccgaggactactacaccgacaccgtgcccttccacagcgcccccaagggcatcagcctgcccggctgcagcaagctgaccttcagctgcgagaagagaagcgtgcagaagaaggagctgaacaagaagctggaggacagctgcagaaagaagctggccgagttcgaggacgagctggaccacaccgtggacagcctgacctggaacctgacccccaaggccaaggagagaaccagagagcccctgaagaaggccagccagcccagaaacaagaactggatgaaccacctgagagtgccccagagagagctggacagactgctgctggccagaatggagagcagaaaccacttcctgaagaaccccagattcttcccccccaacaccagatacggcggcaagagcctggtgttcccccccaagaagcccgcccccatcggcgagttccagagcaccgagcccgagcagagctgcgccgacacccccgtgttcctggccaagccccccatcggcttcttcaccgactacgagatcggccccgtgtacgagatggtgatcgccctgcagaacaccaccaccaccagcagatacctgagagtgctgccccccagcaccccctacttcgccctgggcctgggcatgttccccggcaagggcggcatggtggcccccggcatgacctgccagtacatcgtgcagttcttccccgactgcctgggcgacttcgacgacttcatcctggtggagacccagagcgcccacaccctgctgatccccctgcaggccagaagacccccccccgtgctgaccctgagccccgtgctggactgcggctactgcctgatcggcggcgtgaagatgaccagattcatctgcaagaacgtgggcttcagcgtgggcagattctgcatcatgcccaagaccagctggccccccctgagcttcaaggccatcgccaccgtgggcttcgtggagcagccccccttcggcatcctgcccagcgtgttcgagctggcccccggccacgccatcctggtggaggtgctgttcagccccaagagcctgggcaaggccgagcagaccttcatcatcatgtgcgacaactgccagatcaaggagctggtgaccatcggcatcggccagctgatcgccctggacctgatctacatcagcggcgagaagagccagcccgaccccggcgagctgaccgacctgaccgcccagcacttcatcagattcgagcccgagaacctgagaagcaccgccagaaagcagctgatcatcagaaacgccacccacgtggagctggccttctactggcagatcatgaagcccaacctgcagcccctgatgcccggcgagaccttcagcatggacagcatcaagtgctaccccgacaaggagaccgccttcagcatcatgcccagaaagggcgtgctgagcccccacaccgaccacgagttcatcctgagcttcagcccccacgagctgagagacttccacagcgtgctgcagatggtgctggaggaggtgcccgagcccgtgagcagcgaggccgagagcctgggccacagcagctacagcgtggacgacgtgatcgtgctggagatcgaggtgaagggcagcgtggagcccttccaggtgctgctggagccctacgccctgatcatccccggcgagaactacatcggcatcaacgtgaagaaggccttcaagatgtggaacaacagcaagagccccatcagatacctgtggggcaagatcagcgactgccacatcatcgaggtggagcccggcaccggcgtgatcgagcccagcgaggtgggcgacttcgagctgaacttcaccggcggcgtgcccggccccaccagccaggacctgctgtgcgagatcgaggacagccccagccccgtggtgctgcacatcgaggccgtgttcaagggccccgccctgatcatcaacgtgagcgccctgcagttcggcctgctgagactgggccagaaggccaccaacagcatccagatcagaaacgtgagccagctgcccgccacctggagaatgaaggagagccccgtgagcctgcaggagagacccgaggacgtgagccccttcgacatcgagcccagcagcggccagctgcacagcctgggcgagtgcagagtggacatcaccctggaggccctgcactgccagcacctggagaccgtgctggagctggaggtggagaacggcgcctggagctacctgcccgtgtacgccgaggtgcagaagccccacgtgtacctgcagagcagccaggtggaggtgagaaacctgtacctgggcgtgcccaccaagaccaccatcaccctgatcaacggcaccctgctgcccacccagttccactggggcaagctgctgggccaccaggccgagttctgcatggtgaccgtgagccccaagcacggcctgctgggccccagcgaggagtgccagctgaagctggagctgaccgcccacacccaggaggagctgacccacctggccctgccctgccacgtgagcggcatgaagaagcccctggtgctgggcatcagcggcaagccccagggcctgcaggtggccatcaccatcagcaaggagagcagcgactgcagcaccgagcagtggcccggccaccccaaggagctgagactggacttcggcagcgccgtgcccctgagaaccagagtgaccagacagctgatcctgaccaacagaagccccatcagaaccagattcagcctgaagttcgagtacttcggcagcccccagaacagcctgagcaagaagaccagcctgcccaacatgccccccgccctgctgaagaccgtgagaatgcaggagcacctggccaagagagagcagctggacttcatggagagcatgctgagccacggcaagggcgccgccttcttcccccacttcagccagggcatgctgggcccctaccagcagctgtgcatcgacatcaccggctgcgccaacatgtggggcgagtactgggacaacctgatctgcaccgtgggcgacctgctgcccgaggtgatccccgtgcacatggccgccgtgggctgccccatcagcagcctgagaaccaccagctacaccatcgaccaggcccagaaggagcccgccatgagattcggcacccaggtgagcggcggcgacaccgtgaccagaaccctgagactgaacaacagcagcccctgcgacatcagactggactgggagacctacgtgcccgaggacaaggaggacagactggtggagctgctggtgttctacggcccccccttccccctgagagaccaggccggcaacgagctggtgtgccccgacacccccgagggcggctgcctgctgtggagccccggccccagcagcagcagcgagttcagccacgagaccgacagcagcgtggagggcagcagcagcgccagcaacagagtggcccagaagctgatcagcgtgatcctgcaggcccacgagggcgtgcccagcggccacctgtactgcatcagccccaagcaggtggtggtgcccgccggcggcagcagcaccatctacatcagcttcacccccatggtgctgagccccgagatcctgcacaaggtggagtgcaccggctacgccctgggcttcatgagcctggacagcaaggtggagagagagatccccggcaagagacacagactgcaggacttcgccgtgggccccctgaagctggacctgcacagctacgtgagacccgcccagctgagcgtggagctggactacggcggcagcatggagttccagtgccaggccagcgacctgatccccgagcagccctgcagcggcgtgctgagcgagctggtgaccacccaccacctgaagctgaccaacaccaccgagatcccccactacttcagactgatggtgagcagacccttcagcgtgagccaggacggcgccagccaggaccacagagcccccggccccggccagaagcaggagtgcgaggaggagaccgccagcgccgacaagcagctggtgctgcaggcccaggagaacatgctggtgaacgtgagcttcagcctgagcctggagctgctgagctaccagaagctgcccgccgaccagaccctgcccggcgtggacatccagcagagcgccagcggcgagagagagatggtgttcacccagaacctgctgctggagtacaccaaccagaccacccaggtggtgcccctgagagccgtggtggccgtgcccgagctgcagctgagcaccagctgggtggacttcggcacctgcttcgtgagccagcagagagtgagagaggtgtacctgatgaacctgagcggctgcagaagctactggaccatgctgatgggccagcaggagcccgccaaggccgccgtggccttcagagtgagccccaacagcggcctgctggaggccagaagcgccaacgccccccccaccagcatcgccctgcaggtgttcttcaccgccagaagcagcgagctgtacgagagcaccatggtggtggagggcgtgctgggcgagaagagctgcaccctgagactgagaggccagggcagctacgacgagagatacatgctgccccaccagccctag

SEQ ID NO: 10378 - DNA, 5337 bp, Artificial Sequence
  Description of Artificial Sequence: Synthetic coding sequence
atggagaccagaagcagcaagaccagaagaagcctggccagcagaaccaacgagtgccagggcaccatgtgggcccccaccagcccccccgccggcagcagcagccccagccagcccacctggaagagcagcctgtacagcagcctggcctacagcgaggccttccactacagcttcgccgccagacccagaagactgacccagctggccctggcccagagacccgagccccagctgctgagactgagacccagcagcctgagaacccaggacatcagccacctgctgaccggcgtgttcagaaacctgtacagcgccgaggtgatcggcgacgaggtgagcgccagcctgatcaaggccagaggcagcgagaacgagagacacgaggagttcgtggaccagctgcagcagatcagagagctgtacaagcagagactggacgagttcgagatgctggagagacacatcacccaggcccaggccagagccatcgccgagaacgagagagtgatgagccaggccggcgtgcaggacctggagagcctggtgagactgccccccgtgaagagcgtgagcagatggtgcatcgacagcgagctgctgagaaagcaccacctgatcagccccgaggactactacaccgacaccgtgcccttccacagcgcccccaagggcatcagcctgcccggctgcagcaagctgaccttcagctgcgagaagagaagcgtgcagaagaaggagctgaacaagaagctggaggacagctgcagaaagaagctggccgagttcgaggacgagctggaccacaccgtggacagcctgacctggaacctgacccccaaggccaaggagagaaccagagagcccctgaagaaggccagccagcccagaaacaagaactggatgaaccacctgagagtgccccagagagagctggacagactgctgctggccagaatggagagcagaaaccacttcctgaagaaccccagattcttcccccccaacaccagatacggcggcaagagcctggtgttcccccccaagaagcccgcccccatcggcgagttccagagcaccgagcccgagcagagctgcgccgacacccccgtgttcctggccaagccccccatcggcttcttcaccgactacgagatcggccccgtgtacgagatggtgatcgccctgcagaacaccaccaccaccagcagatacctgagagtgctgccccccagcaccccctacttcgccctgggcctgggcatgttccccggcaagggcggcatggtggcccccggcatgacctgccagtacatcgtgcagttcttccccgactgcctgggcgacttcgacgacttcatcctggtggagacccagagcgcccacaccctgctgatccccctgcaggccagaagacccccccccgtgctgaccctgagccccgtgctggactgcggctactgcctgatcggcggcgtgaagatgaccagattcatctgcaagaacgtgggcttcagcgtgggcagattctgcatcatgcccaagaccagctggccccccctgagcttcaaggccatcgccaccgtgggcttcgtggagcagccccccttcggcatcctgcccagcgtgttcgagctggcccccggccacgccatcctggtggaggtgctgttcagccccaagagcctgggcaaggccgagcagaccttcatcatcatgtgcgacaactgccagatcaaggagctggtgaccatcggcatcggccagctgatcgccctggacctgatctacatcagcggcgagaagagccagcccgaccccggcgagctgaccgacctgaccgcccagcacttcatcagattcgagcccgagaacctgagaagcaccgccagaaagcagctgatcatcagaaacgccacccacgtggagctggccttctactggcagatcatgaagcccaacctgcagcccctgatgcccggcgagaccttcagcatggacagcatcaagtgctaccccgacaaggagaccgccttcagcatcatgcccagaaagggcgtgctgagcccccacaccgaccacgagttcatcctgagcttcagcccccacgagctgagagacttccacagcgtgctgcagatggtgctggaggaggtgcccgagcccgtgagcagcgaggccgagagcctgggccacagcagctacagcgtggacgacgtgatcgtgctggagatcgaggtgaagggcagcgtggagcccttccaggtgctgctggagccctacgccctgatcatccccggcgagaactacatcggcatcaacgtgaagaaggccttcaagatgtggaacaacagcaagagccccatcagatacctgtggggcaagatcagcgactgccacatcatcgaggtggagcccggcaccggcgtgatcgagcccagcgaggtgggcgacttcgagctgaacttcaccggcggcgtgcccggccccaccagccaggacctgctgtgcgagatcgaggacagccccagccccgtggtgctgcacatcgaggccgtgttcaagggccccgccctgatcatcaacgtgagcgccctgcagttcggcctgctgagactgggccagaaggccaccaacagcatccagatcagaaacgtgagccagctgcccgccacctggagaatgaaggagagccccgtgagcctgcaggagagacccgaggacgtgagccccttcgacatcgagcccagcagcggccagctgcacagcctgggcgagtgcagagtggacatcaccctggaggccctgcactgccagcacctggagaccgtgctggagctggaggtggagaacggcgcctggagctacctgcccgtgtacgccgaggtgcagaagccccacgtgtacctgcagagcagccaggtggaggtgagaaacctgtacctgggcgtgcccaccaagaccaccatcaccctgatcaacggcaccctgctgcccacccagttccactggggcaagctgctgggccaccaggccgagttctgcatggtgaccgtgagccccaagcacggcctgctgggccccagcgaggagtgccagctgaagctggagctgaccgcccacacccaggaggagctgacccacctggccctgccctgccacgtgagcggcatgaagaagcccctggtgctgggcatcagcggcaagccccagggcctgcaggtggccatcaccatcagcaaggagagcagcgactgcagcaccgagcagtggcccggccaccccaaggagctgagactggacttcggcagcgccgtgcccctgagaaccagagtgaccagacagctgatcctgaccaacagaagccccatcagaaccagattcagcctgaagttcgagtacttcggcagcccccagaacagcctgagcaagaagaccagcctgcccaacatgccccccgccctgctgaagaccgtgagaatgcaggagcacctggccaagagagagcagctggacttcatggagagcatgctgagccacggcaagggcgccgccttcttcccccacttcagccagggcatgctgggcccctaccagcagctgtgcatcgacatcaccggctgcgccaacatgtggggcgagtactgggacaacctgatctgcaccgtgggcgacctgctgcccgaggtgatccccgtgcacatggccgccgtgggctgccccatcagcagcctgagaaccaccagctacaccatcgaccaggcccagaaggagcccgccatgagattcggcacccaggtgagcggcggcgacaccgtgaccagaaccctgagactgaacaacagcagcccctgcgacatcagactggactgggagacctacgtgcccgaggacaaggaggacagactggtggagctgctggtgttctacggcccccccttccccctgagagaccaggccggcaacgagctggtgtgccccgacacccccgagggcggctgcctgctgtggagccccggccccagcagcagcagcgagttcagccacgagaccgacagcagcgtggagggcagcagcagcgccagcaacagagtggcccagaagctgatcagcgtgatcctgcaggcccacgagggcgtgcccagcggccacctgtactgcatcagccccaagcaggtggtggtgcccgccggcggcagcagcaccatctacatcagcttcacccccatggtgctgagccccgagatcctgcacaaggtggagtgcaccggctacgccctgggcttcatgagcctggacagcaaggtggagagagagatccccggcaagagacacagactgcaggacttcgccgtgggccccctgaagctggacctgcacagctacgtgagacccgcccagctgagcgtggagctggactacggcggcagcatggagttccagtgccaggccagcgacctgatccccgagcagccctgcagcggcgtgctgagcgagctggtgaccacccaccacctgaagctgaccaacaccaccgagatcccccactacttcagactgatggtgagcagacccttcagcgtgagccaggacggcgccagccaggaccacagagcccccggccccggccagaagcaggagtgcgaggaggagaccgccagcgccgacaagcagctggtgctgcaggcccaggagaacatgctggtgaacgtgagcttcagcctgagcctggagctgctgagctaccagaagctgcccgccgaccagaccctgcccggcgtggacatccagcagagcgccagcggcgagagagagatggtgttcacccagaacctgctgctggagtacaccaaccagaccacccaggtggtgcccctgagagccgtggtggccgtgcccgagctgcagctgagcaccagctgggtggacttcggcacctgcttcgtgagccagcagagagtgagagaggtgtacctgatgaacctgagcggctgcagaagctactggaccatgctgatgggcgtggtgagctgcaccagccccagatggtggtggaaggtgtgcagcgtgagaagccccgccccctgcggcagcggcgccaaggcccccatgatgagagacacctgctgcctgaccagccccgaggcccccccccagcccagcgcccccggccccagctggagaaagaacatcgcccagggcctgggcgccgccctgcagcacaaggacaccgacctgggcacctggggccccctgggcagcagctggaacggcagaacccccttccacaacggcctgagcctgggcccccacgacatgagcagcgagctgacctag

SEQ ID NO: 10379 - DNA, 5277 bp, Artificial Sequence
  Description of Artificial Sequence: Synthetic coding sequence
atggagaccagaagcagcaagaccagaagaagcctggccagcagaaccaacgagtgccagggcaccatgtgggcccccaccagcccccccgccggcagcagcagccccagccagcccacctggaagagcagcctgtacagcagcctggcctacagcgaggccttccactacagcttcgccgccagacccagaagactgacccagctggccctggcccagagacccgagccccagctgctgagactgagacccagcagcctgagaacccaggacatcagccacctgctgaccggcgtgttcagaaacctgtacagcgccgaggtgatcggcgacgaggtgagcgccagcctgatcaaggccagaggcagcgagaacgagagacacgaggagttcgtggaccagctgcagcagatcagagagctgtacaagcagagactggacgagttcgagatgctggagagacacatcacccaggcccaggccagagccatcgccgagaacgagagagtgatgagccaggccggcgtgcaggacctggagagcctggtgagactgccccccgtgaagagcgtgagcagatggtgcatcgacagcgagctgctgagaaagcaccacctgatcagccccgaggactactacaccgacaccgtgcccttccacagcgcccccaagggcatcagcctgcccggctgcagcaagctgaccttcagctgcgagaagagaagcgtgcagaagaaggagctgaacaagaagctggaggacagctgcagaaagaagctggccgagttcgaggacgagctggaccacaccgtggacagcctgacctggaacctgacccccaaggccaaggagagaaccagagagcccctgaagaaggccagccagcccagaaacaagaactggatgaaccacctgagagtgccccagagagagctggacagactgctgctggccagaatggagagcagaaaccacttcctgaagaaccccagattcttcccccccaacaccagatacggcggcaagagcctggtgttcccccccaagaagcccgcccccatcggcgagttccagagcaccgagcccgagcagagctgcgccgacacccccgtgttcctggccaagccccccatcggcttcttcaccgactacgagatcggccccgtgtacgagatggtgatcgccctgcagaacaccaccaccaccagcagatacctgagagtgctgccccccagcaccccctacttcgccctgggcctgggcatgttccccggcaagggcggcatggtggcccccggcatgacctgccagtacatcgtgcagttcttccccgactgcctgggcgacttcgacgacttcatcctggtggagacccagagcgcccacaccctgctgatccccctgcaggccagaagacccccccccgtgctgaccctgagccccgtgctggactgcggctactgcctgatcggcggcgtgaagatgaccagattcatctgcaagaacgtgggcttcagcgtgggcagattctgcatcatgcccaagaccagctggccccccctgagcttcaaggccatcgccaccgtgggcttcgtggagcagccccccttcggcatcctgcccagcgtgttcgagctggcccccggccacgccatcctggtggaggtgctgttcagccccaagagcctgggcaaggccgagcagaccttcatcatcatgtgcgacaactgccagatcaaggagctggtgaccatcggcatcggccagctgatcgccctggacctgatctacatcagcggcgagaagagccagcccgaccccggcgagctgaccgacctgaccgcccagcacttcatcagattcgagcccgagaacctgagaagcaccgccagaaagcagctgatcatcagaaacgccacccacgtggagctggccttctactggcagatcatgaagcccaacctgcagcccctgatgcccggcgagaccttcagcatggacagcatcaagtgctaccccgacaaggagaccgccttcagcatcatgcccagaaagggcgtgctgagcccccacaccgaccacgagttcatcctgagcttcagcccccacgagctgagagacttccacagcgtgctgcagatggtgctggaggaggtgcccgagcccgtgagcagcgaggccgagagcctgggccacagcagctacagcgtggacgacgtgatcgtgctggagatcgaggtgaagggcagcgtggagcccttccaggtgctgctggagccctacgccctgatcatccccggcgagaactacatcggcatcaacgtgaagaaggccttcaagatgtggaacaacagcaagagccccatcagatacctgtggggcaagatcagcgactgccacatcatcgaggtggagcccggcaccggcgtgatcgagcccagcgaggtgggcgacttcgagctgaacttcaccggcggcgtgcccggccccaccagccaggacctgctgtgcgagatcgaggacagccccagccccgtggtgctgcacatcgaggccgtgttcaagggccccgccctgatcatcaacgtgagcgccctgcagttcggcctgctgagactgggccagaaggccaccaacagcatccagatcagaaacgtgagccagctgcccgccacctggagaatgaaggagagccccgtgagcctgcaggagagacccgaggacgtgagccccttcgacatcgagcccagcagcggccagctgcacagcctgggcgagtgcagagtggacatcaccctggaggccctgcactgccagcacctggagaccgtgctggagctggaggtggagaacggcgcctggagctacctgcccgtgtacgccgaggtgcagaagccccacgtgtacctgcagagcagccaggtggaggtgagaaacctgtacctgggcgtgcccaccaagaccaccatcaccctgatcaacggcaccctgctgcccacccagttccactggggcaagctgctgggccaccaggccgagttctgcatggtgaccgtgagccccaagcacggcctgctgggccccagcgaggagtgccagctgaagctggagctgaccgcccacacccaggaggagctgacccacctggccctgccctgccacgtgagcggcatgaagaagcccctggtgctgggcatcagcggcaagccccagggcctgcaggtggccatcaccatcagcaaggagagcagcgactgcagcgtgttcagcaccgagcagtggcccggccaccccaaggagctgagactggacttcggcagcgccgtgcccctgagaaccagagtgaccagacagctgatcctgaccaacagaagccccatcagaaccagattcagcctgaagttcgagtacttcggcagcccccagaacagcctgagcaagaagaccagcctgcccaacatgccccccgccctgctgaagaccgtgagaatgcaggagcacctggccaagagagagcagctggacttcatggagagcatgctgagccacggcaagggcgccgccttcttcccccacttcagccagggcatgctgggcccctaccagcagctgtgcatcgacatcaccggctgcgccaacatgtggggcgagtactgggacaacctgatctgcaccgtgggcgacctgctgcccgaggtgatccccgtgcacatggccgccgtgggctgccccatcagcagcctgagaaccaccagctacaccatcgaccaggcccagaaggagcccgccatgagattcggcacccaggtgagcggcggcgacaccgtgaccagaaccctgagactgaacaacagcagcccctgcgacatcagactggactgggagacctacgtgcccgaggacaaggaggacagactggtggagctgctggtgttctacggcccccccttccccctgagagaccaggccggcaacgagctggtgtgccccgacacccccgagggcggctgcctgctgtggagccccggccccagcagcagcagcgagttcagccacgagaccgacagcagcgtggagggcagcagcagcgccagcaacagagtggcccagaagctgatcagcgtgatcctgcaggcccacgagggcgtgcccagcggccacctgtactgcatcagccccaagcaggtggtggtgcccgccggcggcagcagcaccatctacatcagcttcacccccatggtgctgagccccgagatcctgcacaaggtggagtgcaccggctacgccctgggcttcatgagcctggacagcaaggtggagagagagatccccggcaagagacacagactgcaggacttcgccgtgggccccctgaagctggacctgcacagctacgtgagacccgcccagctgagcgtggagctggactacggcggcagcatggagttccagtgccaggccagcgacctgatccccgagcagccctgcagcggcgtgctgagcgagctggtgaccacccaccacctgaagctgaccaacaccaccgagatcccccactacttcagactgatggtgagcagacccttcagcgtgagccaggacggcgccagccaggaccacagagcccccggccccggccagaagcaggagtgcgaggaggagaccgccagcgccgacaagcagctggtgctgcaggcccaggagaacatgctggtgaacgtgagcttcagcctgagcctggagctgctgagctaccagaagctgcccgccgaccagaccctgcccggcgtggacatccagcagagcgccagcggcgagagagagatggtgttcacccagaacctgctgctggagtacaccaaccagaccacccaggtggtgcccctgagagccgtggtggccgtgcccgagctgcagctgagcaccagctgggtggacttcggcacctgcttcgtgagccagcagagagtgagagaggtgtacctgatgaacctgagcggctgcagaagctactggaccatgctgatgggccagcaggagcccgccaaggccgccgtggccttcagagtgagccccaacagcggcctgctggaggccagaagcgccaacgccccccccaccagcatcgccctgcaggtgttcttcaccgccagaagcagcgagctgtacgagagcaccatggtggtggagggcgtgctgggcgagaagagctgcaccctgagactgagaggccagggcagctacgacgagagatacatgctgccccaccagccctag

SEQ ID NO: 10380 - DNA, 237 bp, Artificial Sequence
  Description of Artificial Sequence: Synthetic coding sequence
atgagaccctgcatctggatccacgtgcacctgaagcccccctgcagactggtggagctgctgcccttcagcagcgccctgcagggcctgagccacctgagcctgggcaccaccctgcccgtgatcctgcccgagagaaacgaggagcagaacctgcaggagctgagccacaacgccgacaagtaccagatgggcgactgctgcaaggaggagatcgacgacagcatcttctactag

SEQ ID NO: 10381 - DNA, 2940 bp, Artificial Sequence
  Description of Artificial Sequence: Synthetic coding sequence
atgagaggctaccacggcgacagaggcagccaccccagacccgccagattcgccgaccagcagcacatggacgtgggccccgccgccagagccccctacctgctgggcagcagagaggccttcagcaccgagcccagattctgcgcccccagagccggcctgggccacatcagccccgagggccccctgagcctgagcgagggccccagcgtgggccccgagggcggccccgccggcgccggcgtgggcggcggcagcagcaccttccccagaatgtaccccggccagggccccttcgacacctgcgaggactgcgtgggccacccccagggcaagggcgcccccagactgccccccaccctgctggaccagttcgagaagcagctgcccgtgcagcaggacggcttccacaccctgccctaccagagaggccccgccggcgccggccccggccccgcccccggcaccggcaccgcccccgagcccagaagcgagagccccagcagaatcagacacctggtgcacagcgtgcagaagctgttcgccaagagccacagcctggaggcccccggcaagagagactacaacggccccaaggccgagggcagaggcggcagcggcggcgacagctaccccggccccggcagcggcggcccccacaccagccaccaccaccaccaccaccaccaccaccaccaccaccagagcagacacggcaagagaagcaagagcaaggacagaaagggcgacggcagacaccaggccaagagcaccggctggtggagcagcgacgacaacctggacagcgacagcggcttcctggccggcggcagaccccccggcgagcccggcggccccttctgcctggagggccccgacggcagctacagagacctgagcttcaagggcagaagcggcggcagcgagggcagatgcctggcctgcaccggcatgagcatgagcctggacggccagagcgtgaagagaagcgcctggcacaccatgatggtgagccagggcagagacggctaccccggcgccggccccggcaagggcctgctgggccccgagaccaaggccaaggccagaacctaccactacctgcaggtgccccaggacgactggggcggctaccccaccggcggcaaggacggcgagatcccctgcagaagaatgagaagcggcagctacatcaaggccatgggcgacgaggagagcggcgacagcgacggcagccccaagaccagccccaaggccgtggccagaagattcaccaccagaagaagcagcagcgtggaccaggccagaatcaactgctgcgtgccccccagaatccaccccagaagcagcatccccggctacagcagaagcctgaccaccggccagctgagcgacgagctgaaccagcagctggaggccgtgtgcggcagcgtgttcggcgagctggagagccaggccgtggacgccctggacctgcccggctgcttcagaatgagaagccacagctacctgagagccatccaggccggctgcagccaggacgacgactgcctgcccctgctggccacccccgccgccgtgagcggcagacccggcagcagcttcaacttcagaaaggcccccccccccatcccccccggcagccaggccccccccagaatcagcatcaccgcccagagcagcaccgacagcgcccacgagagcttcaccgccgccgagggccccgccagaagatgcagcagcgccgacggcctggacggccccgccatgggcgccagaaccctggagctggcccccgtgccccccagagccagccccaagccccccaccctgatcatcaagaccatccccggcagagaggagctgagaagcctggccagacagagaaagtggagacccagcatcggcgtgcaggtggagaccatcagcgacagcgacaccgagaacagaagcagaagagagttccacagcatcggcgtgcaggtggaggaggacaagagaagagccagattcaagagaagcaacagcgtgaccgccggcgtgcaggccgacctggagctggagggcctggccggcctggccaccgtggccaccgaggacaaggccctgcagttcggcagaagcttccagagacacgccagcgagccccagcccggccccagagcccccacctacagcgtgttcagaaccgtgcacacccagggccagtgggcctacagagagggctaccccctgccctacgagccccccgccaccgacggcagccccggccccgcccccgcccccacccccggccccggcgccggcagaagagacagctggatcgagagaggcagcagaagcctgcccgacagcggcagagccagcccctgccccagagacggcgagtggttcatcaagatgctgagagccgaggtggagaagctggagcactggtgccagcagatggagagagaggccgaggactacgagctgcccgaggagatcctggagaagatcagaagcgccgtgggcagcacccagctgctgctgagccagaaggtgcagcagttcttcagactgtgccagcagagcatggaccccaccgccttccccgtgcccaccttccaggacctggccggcttctgggacctgctgcagctgagcatcgaggacgtgaccctgaagttcctggagctgcagcagctgaaggccaacagctggaagctgctggagcccaaggaggagaagaaggtgcccccccccatccccaagaagcccctgagaggcagaggcgtgcccgtgaaggagagaagcctggacagcgtggacagacagagacaggaggccagaaagagactgctggccgccaagagagccgccagcttcagacacagcagcgccaccgagagcgccgacagcatcgagatctacatccccgaggcccagaccagactgtag

SEQ ID NO: 10382 - DNA, 5358 bp, Artificial Sequence
  Description of Artificial Sequence: Synthetic coding sequence
atgggcatcagcaccgtgatcctggagatgtgcctgctgtggggccaggtgctgagcaccggcggctggatccccagaaccaccgactacgccagcctgatccccagcgaggtgcccctggaccccaccgtggccgagggcagccccttccccagcgagagcaccctggagagcaccgtggccgagggcagccccatcagcctggagagcaccctggagagcaccgtggccgagggcagcctgatccccagcgagagcaccctggagagcaccgtggccgagggcagcgacagcggcctggccctgagactggtgaacggcgacggcagatgccagggcagagtggagatcctgtacagaggcagctggggcaccgtgtgcgacgacagctgggacaccaacgacgccaacgtggtgtgcagacagctgggctgcggctgggccatgagcgcccccggcaacgcctggttcggccagggcagcggccccatcgccctggacgacgtgagatgcagcggccacgagagctacctgtggagctgcccccacaacggctggctgagccacaactgcggccacggcgaggacgccggcgtgatctgcagcgccgcccagccccagagcaccctgagacccgagagctggcccgtgagaatcagcccccccgtgcccaccgagggcagcgagagcagcctggccctgagactggtgaacggcggcgacagatgcagaggcagagtggaggtgctgtacagaggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgacccacaactgcggccacagcgaggacgccggcgtgatctgcagcgccccccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtaccagggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccacagcgaggacgccggcgtgatctgcagcgccagccagagcagacccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagcagagccagcaccgccggcagcgagagcaccctggccctgagactggtgaacggcggcgacagatgcagaggcagagtggaggtgctgtaccagggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgagccacaactgcggccaccacgaggacgccggcgtgatctgcagcgccgcccagagccagagcacccccagacccgacacctggctgaccaccaacctgcccgccctgaccgtgggcagcgagagcagcctggccctgagactggtgaacggcggcgacagatgcagaggcagagtggaggtgctgtacagaggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggcaacgagagctacctgtggagctgcccccacaagggctggctgacccacaactgcggccaccacgaggacgccggcgtgatctgcagcgccacccagatcaacagcaccaccaccgactggtggcaccccaccaccaccaccaccgccagacccagcagcaactgcggcggcttcctgttctacgccagcggcaccttcagcagccccagctaccccgcctactaccccaacaacgccaagtgcgtgtgggagatcgaggtgaacagcggctacagaatcaacctgggcttcagcaacctgaagctggaggcccaccacaactgcagcttcgactacgtggagatcttcgacggcagcctgaacagcagcctgctgctgggcaagatctgcaacgacaccagacagatcttcaccagcagctacaacagaatgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaccgactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10383 - DNA, 5358 bp, Artificial Sequence; identical to SEQ ID NO: 10382
  Description of Artificial Sequence: Synthetic coding sequence

SEQ ID NO: 10384 - DNA, 7242 bp, Artificial Sequence
  Description of Artificial Sequence: Synthetic coding sequence
atgggcatcagcaccgtgatcctggagatgtgcctgctgtggggccaggtgctgagcaccggcggctggatccccagaaccaccgactacgccagcctgatccccagcgaggtgcccctggaccccaccgtggccgagggcagccccttccccagcgagagcaccctggagagcaccgtggccgagggcagccccatcagcctggagagcaccctggagagcaccgtggccgagggcagcctgatccccagcgagagcaccctggagagcaccgtggccgagggcagcgacagcggcctggccctgagactggtgaacggcgacggcagatgccagggcagagtggagatcctgtacagaggcagctggggcaccgtgtgcgacgacagctgggacaccaacgacgccaacgtggtgtgcagacagctgggctgcggctgggccatgagcgcccccggcaacgcctggttcggccagggcagcggccccatcgccctggacgacgtgagatgcagcggccacgagagctacctgtggagctgcccccacaacggctggctgagccacaactgcggccacggcgaggacgccggcgtgatctgcagcgccgcccagccccagagcaccctgagacccgagagctggcccgtgagaatcagcccccccgtgcccaccgagggcagcgagagcagcctggccctgagactggtgaacggcggcgacagatgcagaggcagagtggaggtgctgtacagaggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgacccacaactgcggccacagcgaggacgccggcgtgatctgcagcgccccccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccatgctggcccccggcaacgccagattcggccagggcagcggccccatcgtgctggacgacgtgagatgcagcggcaacgagagctacctgtggagctgcccccacaacggctggctgagccacaactgcggccacagcgaggacgccggcgtgatctgcagcggccccgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgccccaacaacggctggctgagccacaactgcggccaccacgaggacgccggcgtgatctgcagcgccgcccagagcagaagcacccccagacccgacaccctgagcaccatcaccctgccccccagcaccgtgggcagcgagagcagcctgaccctgagactggtgaacggcagcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgtgagccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtaccagggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccacagcgaggacgccggcgtgatctgcagcgccagccagagcagacccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagcagagccagcaccgccggcagcgagagcaccctggccctgagactggtgaacggcggcgacagatgcagaggcagagtggaggtgctgtaccagggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgagccacaactgcggccaccacgaggacgccggcgtgatctgcagcgccgcccagagccagagcacccccagacccgacacctggctgaccaccaacctgcccgccctgaccgtgggcagcgagagcagcctggccctgagactggtgaacggcggcgacagatgcagaggcagagtggaggtgctgtacagaggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggcaacgagagctacctgtggagctgcccccacaagggctggctgacccacaactgcggccaccacgaggacgccggcgtgatctgcagcgccacccagatcaacagcaccaccaccgactggtggcaccccaccaccaccaccaccgccagacccagcagcaactgcggcggcttcctgttctacgccagcggcaccttcagcagccccagctaccccgcctactaccccaacaacgccaagtgcgtgtgggagatcgaggtgaacagcggctacagaatcaacctgggcttcagcaacctgaagctggaggcccaccacaactgcagcttcgactacgtggagatcttcgacggcagcctgaacagcagcctgctgctgggcaagatctgcaacgacaccagacagatcttcaccagcagctacaacagaatgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaccgactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10385 - DNA, 5358 bp, Artificial Sequence; identical to SEQ ID NO: 10382
  Description of Artificial Sequence: Synthetic coding sequence

SEQ ID NO: 10386 - DNA, 7242 bp, Artificial Sequence; identical to SEQ ID NO: 10384
  Description of Artificial Sequence: Synthetic coding sequence

SEQ ID NO: 10387 - DNA, 7242 bp, Artificial Sequence; identical to SEQ ID NO: 10384
  Description of Artificial Sequence: Synthetic coding sequence

SEQ ID NO: 10388 - DNA, 7212 bp, Artificial Sequence
  Description of Artificial Sequence: Synthetic coding sequence
atgggcatcagcaccgtgatcctggagatgtgcctgctgtggggccaggtgctgagcaccggcggctggatccccagaaccaccgactacgccagcctgatccccagcgaggtgcccctggaccccaccgtggccgagggcagccccttccccagcgagagcaccctggagagcaccgtggccgagggcagccccatcagcctggagagcaccctggagagcaccgtggccgagggcagcctgatccccagcgagagcaccctggagagcaccgtggccgagggcagcgacagcggcctggccctgagactggtgaacggcgacggcagatgccagggcagagtggagatcctgtacagaggcagctggggcaccgtgtgcgacgacagctgggacaccaacgacgccaacgtggtgtgcagacagctgggctgcggctgggccatgagcgcccccggcaacgcctggttcggccagggcagcggccccatcgccctggacgacgtgagatgcagcggccacgagagctacctgtggagctgcccccacaacggctggctgagccacaactgcggccacggcgaggacgccggcgtgatctgcagcgccgcccagccccagagcaccctgagacccgagagctggcccgtgagaatcagcccccccgtgcccaccgagggcagcgagagcagcctggccctgagactggtgaacggcggcgacagatgcagaggcagagtggaggtgctgtacagaggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgacccacaactgcggccacagcgaggacgccggcgtgatctgcagcgccccccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgacaccctgcccaccatcaccctgcccgccagcaccgtgggcagcgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccatgctggcccccggcaacgccagattcggccagggcagcggccccatcgtgctggacgacgtgagatgcagcggcaacgagagctacctgtggagctgcccccacaacggctggctgagccacaactgcggccacagcgaggacgccggcgtgatctgcagcggccccgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgccccaacaacggctggctgagccacaactgcggccaccacgaggacgccggcgtgatctgcagcgccgcccagagcagaagcacccccagacccgacaccctgagcaccatcaccctgccccccagcaccgtgggcagcgagagcagcctgaccctgagactggtgaacggcagcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgtgagccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtaccagggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccacagcgaggacgccggcgtgatctgcagcgccagccagagcagacccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagcagagccagcaccgccggcagcgagagcaccctggccctgagactggtgaacggcggcgacagatgcagaggcagagtggaggtgctgtaccagggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgagccacaactgcggccaccacgaggacgccggcgtgatctgcagcgccgcccagagccagagcacccccagacccgacacctggctgaccaccaacctgcccgccctgaccgtgggcagcgagagcagcctggccctgagactggtgaacggcggcgacagatgcagaggcagagtggaggtgctgtacagaggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggcaacgagagctacctgtggagctgcccccacaagggctggctgacccacaactgcggccaccacgaggacgccggcgtgatctgcagcgccacccagatcaacagcaccaccaccgactggtggcaccccaccaccaccaccaccgccagacccagcagcaactgcggcggcttcctgttctacgccagcggcaccttcagcagccccagctaccccgcctactaccccaacaacgccaagtgcgtgtgggagatcgaggtgaacagcggctacagaatcaacctgggcttcagcaacctgaagctggaggcccaccacaactgcagcttcgactacgtggagatcttcgacggcagcctgaacagcagcctgctgctgggcaagatctgcaacgacaccagacagatcttcaccagcagctacaacagaatgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaccgactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10389 - DNA, 1680 bp, Artificial Sequence
  Description of Artificial Sequence: Synthetic coding sequence
atgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaccgactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10390 - DNA, 3402 bp, Artificial Sequence
  Description of Artificial Sequence: Synthetic coding sequence
atgggcatcagcaccgtgatcctggagatgtgcctgctgtggggccaggtgctgagcaccggcggctggatccccagaaccaccgactacgccagcctgatccccagcgaggtgcccctggaccccaccgtggccgagggcagccccttccccagcgagagcaccctggagagcaccgtggccgagggcagccccatcagcctggagagcaccctggagagcaccgtggccgagggcagcctgatccccagcgagagcaccctggagagcaccgtggccgagggcagcgacagcggcctggccctgagactggtgaacggcgacggcagatgccagggcagagtggagatcctgtacagaggcagctggggcaccgtgtgcgacgacagctgggacaccaacgacgccaacgtggtgtgcagacagctgggctgcggctgggccatgagcgcccccggcaacgcctggttcggccagggcagcggccccatcgccctggacgacgtgagatgcagcggccacgagagctacctgtggagctgcccccacaacggctggctgagccacaactgcggccacggcgaggacgccggcgtgatctgcagcgccccccagagcagacccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagcagagccagcaccgccggcagcgagagcaccctggccctgagactggtgaacggcggcgacagatgcagaggcagagtggaggtgctgtaccagggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgagccacaactgcggccaccacgaggacgccggcgtgatctgcagcgccacccagatcaacagcaccaccaccgactggtggcaccccaccaccaccaccaccgccagacccagcagcaactgcggcggcttcctgttctacgccagcggcaccttcagcagccccagctaccccgcctactaccccaacaacgccaagtgcgtgtgggagatcgaggtgaacagcggctacagaatcaacctgggcttcagcaacctgaagctggaggcccaccacaactgcagcttcgactacgtggagatcttcgacggcagcctgaacagcagcctgctgctgggcaagatctgcaacgacaccagacagatcttcaccagcagctacaacagaatgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaccgactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10391 - DNA, 7242 bp, Artificial Sequence; identical to SEQ ID NO: 10384
  Description of Artificial Sequence: Synthetic coding sequence

SEQ ID NO: 10392 - DNA, 7629 bp, Artificial Sequence
  Description of Artificial Sequence: Synthetic coding sequence
atgggcatcagcaccgtgatcctggagatgtgcctgctgtggggccaggtgctgagcaccggcggctggatccccagaaccaccgactacgccagcctgatccccagcgaggtgcccctggaccccaccgtggccgagggcagccccttccccagcgagagcaccctggagagcaccgtggccgagggcagccccatcagcctggagagcaccctggagagcaccgtggccgagggcagcctgatccccagcgagagcaccctggagagcaccgtggccgagggcagcgacagcggcctggccctgagactggtgaacggcgacggcagatgccagggcagagtggagatcctgtacagaggcagctggggcaccgtgtgcgacgacagctgggacaccaacgacgccaacgtggtgtgcagacagctgggctgcggctgggccatgagcgcccccggcaacgcctggttcggccagggcagcggccccatcgccctggacgacgtgagatgcagcggccacgagagctacctgtggagctgcccccacaacggctggctgagccacaactgcggccacggcgaggacgccggcgtgatctgcagcgccgcccagccccagagcaccctgagacccgagagctggcccgtgagaatcagcccccccgtgcccaccgagggcagcgagagcagcctggccctgagactggtgaacggcggcgacagatgcagaggcagagtggaggtgctgtacagaggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgacccacaactgcggccacagcgaggacgccggcgtgatctgcagcgccccccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccatgctggcccccggcaacgccagattcggccagggcagcggccccatcgtgctggacgacgtgagatgcagcggcaacgagagctacctgtggagctgcccccacaacggctggctgagccacaactgcggccacagcgaggacgccggcgtgatctgcagcggccccgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgccccaacaacggctggctgagccacaactgcggccaccacgaggacgccggcgtgatctgcagcgccgcccagagcagaagcacccccagacccgacaccctgagcaccatcaccctgccccccagcaccgtgggcagcgagagcagcctgaccctgagactggtgaacggcagcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgtgagccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtaccagggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccacagcgaggacgccggcgtgatctgcagcgccagccagagcagacccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagcagagccagcaccgccggcagcgagagcaccctggccctgagactggtgaacggcggcgacagatgcagaggcagagtggaggtgctgtaccagggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgagccacaactgcggccaccacgaggacgccggcgtgatctgcagcgccgcccagagccagagcacccccagacccgacacctggctgaccaccaacctgcccgccctgaccgtgggcagcgagagcagcctggccctgagactggtgaacggcggcgacagatgcagaggcagagtggaggtgctgtacagaggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggcaacgagagctacctgtggagctgcccccacaagggctggctgacccacaactgcggccaccacgaggacgccggcgtgatctgcagcgccacccagatcaacagcaccaccaccgactggtggcaccccaccaccaccaccaccgccagacccagcagcaactgcggcggcttcctgttctacgccagcggcaccttcagcagccccagctaccccgcctactaccccaacaacgccaagtgcgtgtgggagatcgaggtgaacagcggctacagaatcaacctgggcttcagcaacctgaagctggaggcccaccacaactgcagcttcgactacgtggagatcttcgacggcagcctgaacagcagcctgctgctgggcaagatctgcaacgacaccagacagatcttcaccagcagctacaacagaatgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaccgactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10393 - DNA, 7239 bp, Artificial Sequence
  Description of Artificial Sequence: Synthetic coding sequence
atgggcatcagcaccgtgatcctggagatgtgcctgctgtggggccaggtgctgagcaccggcggctggatccccagaaccaccgactacgccagcctgatccccagcgaggtgcccctggaccccaccgtggccgagggcagccccttccccagcgagagcaccctggagagcaccgtggccgagggcagccccatcagcctggagagcaccctggagagcaccgtggccgagggcagcctgatccccagcgagagcaccctggagagcaccgtggccgagggcagcgacagcggcctggccctgagactggtgaacggcgacggcagatgccagggcagagtggagatcctgtacagaggcagctggggcaccgtgtgcgacgacagctgggacaccaacgacgccaacgtggtgtgcagacagctgggctgcggctgggccatgagcgcccccggcaacgcctggttcggccagggcagcggccccatcgccctggacgacgtgagatgcagcggccacgagagctacctgtggagctgcccccacaacggctggctgagccacaactgcggccacggcgaggacgccggcgtgatctgcagcgccgcccagccccagagcaccctgagacccgagagctggcccgtgagaatcagcccccccgtgcccaccgagggcagcgagagcagcctggccctgagactggtgaacggcggcgacagatgcagaggcagagtggaggtgctgtacagaggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgacccacaactgcggccacagcgaggacgccggcgtgatctgcagcgccccccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccatgctggcccccggcaacgccagattcggccagggcagcggccccatcgtgctggacgacgtgagatgcagcggcaacgagagctacctgtggagctgcccccacaacggctggctgagccacaactgcggccacagcgaggacgccggcgtgatctgcagcggccccgagagcagcctggccctgagactggtgaacggcggcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgccccaacaacggctggctgagccacaactgcggccaccacgaggacgccggcgtgatctgcagcgccgcccagagcagaagcacccccagacccgacaccctgagcaccatcaccctgccccccagcaccgtgggcagcgagagcagcctgaccctgagactggtgaacggcagcgacagatgccagggcagagtggaggtgctgtacagaggcagctggggcaccgtgtgcgacgacagctgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgtgagccagagcagacccacccccagccccgacacctggcccaccagccacgccagcaccgccggccccgagagcagcctggccctgagactggtgaacggcggcgacagatgccagggcagagtggaggtgctgtacagaggcagctggggcaccgtgtgcgacgacagctgggacaccagcgacgccaacgtggtgtgcagacagctgggctgcggctgggccaccagcgcccccggcaacgccagattcggccagggcagcggccccatcgtgctggacgacgtgagatgcagcggctacgagagctacctgtggagctgcccccacaacggctggctgagccacaactgccagcacagcgaggacgccggcgtgatctgcagcgccgcccacagctggagcacccccagccccgacaccctgcccaccatcaccctgcccgccagcaccgtgggcagcgagagcagcctggccctgagactggtgaacggcggcgacagatgccagggcagagtggaggtgctgtaccagggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccacagcgaggacgccggcgtgatctgcagcgccagccagagcagacccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccatgagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagccacgccagcaccgccggcagcgagagcagcctggccctgagactggtgaacggcggcgacagatgccagggcagagtggaggtgctgtacagaggcagctggggcaccgtgtgcgacgactactgggacaccaacgacgccaacgtggtgtgcagacagctgggctgcggctgggccaccagcgcccccggcaacgccagattcggccagggcagcggccccatcgtgctggacgacgtgagatgcagcggccacgagagctacctgtggagctgcccccacaacggctggctgagccacaactgcggccaccacgaggacgccggcgtgatctgcagcgccagccagagccagcccacccccagccccgacacctggcccaccagcagagccagcaccgccggcagcgagagcaccctggccctgagactggtgaacggcggcgacagatgcagaggcagagtggaggtgctgtaccagggcagctggggcaccgtgtgcgacgactactgggacaccaacgacgccaacgtggtgtgcagacagctgggctgcggctgggccatgagcgcccccggcaacgcccagttcggccagggcagcggccccatcgtgctggacgacgtgagatgcagcggccacgagagctacctgtggagctgcccccacaacggctggctgagccacaactgcggccaccacgaggacgccggcgtgatctgcagcgccgcccagagccagagcacccccagacccgacacctggctgaccaccaacctgcccgccctgaccgtgggcagcgagagcagcctggccctgagactggtgaacggcggcgacagatgcagaggcagagtggaggtgctgtacagaggcagctggggcaccgtgtgcgacgacagctgggacaccaacgacgccaacgtggtgtgcagacagctgggctgcggctgggccatgagcgcccccggcaacgccagattcggccagggcagcggccccatcgtgctggacgacgtgagatgcagcggcaacgagagctacctgtggagctgcccccacaagggctggctgacccacaactgcggccaccacgaggacgccggcgtgatctgcagcgccacccagatcaacagcaccaccaccgactggtggcaccccaccaccaccaccaccgccagacccagcagcaactgcggcggcttcctgttctacgccagcggcaccttcagcagccccagctaccccgcctactaccccaacaacgccaagtgcgtgtgggagatcgaggtgaacagcggctacagaatcaacctgggcttcagcaacctgaagctggaggcccaccacaactgcagcttcgactacgtggagatcttcgacggcagcctgaacagcagcctgctgctgggcaagatctgcaacgacaccagacagatcttcaccagcagctacaacagaatgaccatccacttcagaagcgacatcagcttccagaacaccggcttcctggcctggtacaacagcttccccagcgacgccaccctgagactggtgaacctgaacagcagctacggcctgtgcgccggcagagtggagatctaccacggcggcacctggggcaccgtgtgcgacgacagctggaccatccaggaggccgaggtggtgtgcagacagctgggctgcggcagagccgtgagcgccctgggcaacgcctacttcggcagcggcagcggccccatcaccctggacgacgtggagtgcagcggcaccgagagcaccctgtggcagtgcagaaacagaggctggttcagccacaactgcaaccacagagaggacgccggcgtgatctgcagcggcaaccacctgagcacccccgcccccttcctgaacatcaccagacccaacaactacagctgcggcggcttcctgagccagcccagcggcgacttcagcagccccttctaccccggcaactaccccaacaacgccaagtgcgtgtgggacatcgaggtgcagaacaactacagagtgaccgtgatcttcagagacgtgcagctggagggcggctgcaactacgactacatcgaggtgttcgacggcccctacagaagcagccccctgatcgccagagtgtgcgacggcgccagaggcagcttcaccagcagcagcaacttcatgagcatcagattcatcagcgaccacagcatcaccagaagaggcttcagagccgagtactacagcagccccagcaacgacagcaccaacctgctgtgcctgcccaaccacatgcaggccagcgtgagcagaagctacctgcagagcctgggcttcagcgccagcgacctggtgatcagcacctggaacggctactacgagtgcagaccccagatcacccccaacctggtgatcttcaccatcccctacagcggctgcggcaccttcaagcaggccgacaacgacaccatcgactacagcaacttcctgaccgccgccgtgagcggcggcatcatcaagagaagaaccgacctgagaatccacgtgagctgcagaatgctgcagaacacctgggtggacaccatgtacatcgccaacgacaccatccacgtggccaacaacaccatccaggtggaggaggtgcagtacggcaacttcgacgtgaacatcagcttctacaccagcagcagcttcctgtaccccgtgaccagcagaccctactacgtggacctgaaccaggacctgtacgtgcaggccgagatcctgcacagcgacgccgtgctgaccctgttcgtggacacctgcgtggccagcccctacagcaacgacttcaccagcctgacctacgacctgatcagaagcggctgcgtgagagacgacacctacggcccctacagcagccccagcctgagaatcgccagattcagattcagagccttccacttcctgaacagattccccagcgtgtacctgagatgcaagatggtggtgtgcagagcctacgaccccagcagcagatgctacagaggctgcgtgctgagaagcaagagagacgtgggcagctaccaggagaaggtggacgtggtgctgggccccatccagctgcagaccccccccagaagagaggaggagcccagatag

SEQ ID NO: 10394 - DNA, 7242 bp, Artificial Sequence; identical to SEQ ID NO: 10384
  Description of Artificial Sequence: Synthetic coding sequence

SEQ ID NO: 10395 - DNA, 7212 bp, Artificial Sequence; identical to SEQ ID NO: 10388
  Description of Artificial Sequence: Synthetic coding sequence

SEQ ID NO: 10396 - DNA, 5358 bp, Artificial Sequence; identical to SEQ ID NO: 10382
  Description of Artificial Sequence: Synthetic coding sequence

SEQ ID NO: 10397 - DNA, 597 bp, Artificial Sequence
  Description of Artificial Sequence: Synthetic coding sequence
atggccgccgacatcagcgagagcagcggcgccgactgcaagggcgaccccagaaacagcgccaagctggacgccgactaccccctgagagtgctgtactgcggcgtgtgcagcctgcccaccgagtactgcgagtacatgcccgacgtggccaagtgcagacagtggctggagaagaacttccccaacgagttcgccaagctgaccgtggagaacagccccaagcaggaggccggcatcagcgagggccagggcaccgccggcgaggaggaggagaagaagaagcagaagagaggcggcagaggccagatcaagcagaagaagaagaccgtgccccagaaggtgaccatcgccaagatccccagagccaagaagaagtacgtgaccagagtgtgcggcctggccaccttcgagatcgacctgaaggaggcccagagattcttcgcccagaagttcagctgcggcgccagcgtgaccggcgaggacgagatcatcatccagggcgacttcaccgacgacatcatcgacgtgatccaggagaagtggcccgaggtggacgacgacagcatcgaggacctgggcgaggtgaagaagtag

SEQ ID NO: 10398 - DNA, 1530 bp, Artificial Sequence
  Description of Artificial Sequence: Synthetic coding sequence
atggacccccccagagccagccacctgagccccagaaagaagagacccagacagaccggcgccctgatggccagcagcccccaggacatcaagttccaggacctggtggtgttcatcctggagaagaagatgggcaccaccagaagagccttcctgatggagctggccagaagaaagggcttcagagtggagaacgagctgagcgacagcgtgacccacatcgtggccgagaacaacagcggcagcgacgtgctggagtggctgcaggcccagaaggtgcaggtgagcagccagcccgagctgctggacgtgagctggctgatcgagtgcatcagagccggcaagcccgtggagatgaccggcaagcaccagctggtggtgagaagagactacagcgacagcaccaaccccggcccccccaagaccccccccatcgccgtgcagaagatcagccagtacgcctgccagagaagaaccaccctgaacaactgcaaccagatcttcaccgacgccttcgacatcctggccgagaactgcgagttcagagagaacgaggacagctgcgtgaccttcatgagagccgccagcgtgctgaagagcctgcccttcaccatcatcagcatgaaggacaccgagggcatcccctgcctgggcagcaaggtgaagggcatcatcgaggagatcatcgaggacggcgagagcagcgaggtgaaggccgtgctgaacgacgagagataccagagcttcaagctgttcaccagcgtgttcggcgtgggcctgaagaccagcgagaagtggttcagaatgggcttcagaaccctgagcaaggtgagaagcgacaagagcctgaagttcaccagaatgcagaaggccggcttcctgtactacgaggacctggtgagctgcgtgaccagagccgaggccgaggccgtgagcgtgctggtgaaggaggccgtgtgggccttcctgcccgacgccttcgtgaccatgaccggcggcttcagaagaggcaagaagatgggccacgacgtggacttcctgatcaccagccccggcagcaccgaggacgaggagcagctgctgcagaaggtgatgaacctgtgggagaagaagggcctgctgctgtactacgacctggtggagagcaccttcgagaagctgagactgcccagcagaaaggtggacgccctggaccacttccagaagtgcttcctgatcttcaagctgcccagacagagagtggacagcgaccagagcagctggcaggagggcaagacctggaaggccatcagagtggacctggtgctgtgcccctacgagagaagagccttcgccctgctgggctggaccggcagcagacagttcgagagagacctgagaagatacgccacccacgagagaaagatgatcctggacaaccacgccctgtacgacaagaccaagagaatcttcctgaaggccgagagcgaggaggagatcttcgcccacctgggcctggactacatcgagccctgggagagaaacgcctag

SEQ ID NO: 10399 - DNA, 1527 bp, Artificial Sequence
  Description of Artificial Sequence: Synthetic coding sequence
atggacccccccagagccagccacctgagccccagaaagaagagacccagacagaccggcgccctgatggccagcagcccccaggacatcaagttccaggacctggtggtgttcatcctggagaagaagatgggcaccaccagaagagccttcctgatggagctggccagaagaaagggcttcagagtggagaacgagctgagcgacagcgtgacccacatcgtggccgagaacaacagcggcagcgacgtgctggagtggctgcaggcccagaaggtgcaggtgagcagccagcccgagctgctggacgtgagctggctgatcgagtgcatcagagccggcaagcccgtggagatgaccggcaagcaccagctggtggtgagaagagactacagcgacagcaccaaccccggcccccccaagaccccccccatcgccgtgcagaagatcagccagtacgcctgccagagaagaaccaccctgaacaactgcaaccagatcttcaccgacgccttcgacatcctggccgagaactgcgagttcagagagaacgaggacagctgcgtgaccttcatgagagccgccagcgtgctgaagagcctgcccttcaccatcatcagcatgaaggacaccgagggcatcccctgcctgggcagcaaggtgaagggcatcatcgaggagatcatcgaggacggcgagagcagcgaggtgaaggccgtgctgaacgacgagagataccagagcttcaagctgttcaccagcgtgttcggcgtgggcctgaagaccagcgagaagtggttcagaatgggcttcagaaccctgagcaaggtgagaagcgacaagagcctgaagttcaccagaatgcagaaggccggcttcctgtactacgaggacctggtgagctgcgtgaccagagccgaggccgaggccgtgagcgtgctggtgaaggaggccgtgtgggccttcctgcccgacgccttcgtgaccatgaccggcggcttcagaagaggcaagaagatgggccacgacgtggacttcctgatcaccagccccggcagcaccgaggacgaggagcagctgctgcagaaggtgatgaacctgtgggagaagaagggcctgctgctgtactacgacctggtggagagcaccttcgagaagctgagactgcccagcagaaaggtggacgccctggaccacttccagaagtgcttcctgatcttcaagctgcccagacagagagtggacagcgaccagagcagctggcaggagggcaagacctggaaggccatcagagtggacctggtgctgtgcccctacgagagaagagccttcgccctgctgggctggaccggcagcagattcgagagagacctgagaagatacgccacccacgagagaaagatgatcctggacaaccacgccctgtacgacaagaccaagagaatcttcctgaaggccgagagcgaggaggagatcttcgcccacctgggcctggactacatcgagccctgggagagaaacgcctag

SEQ ID NO: 10400 - DNA, 2544 bp, Artificial Sequence
  Description of Artificial Sequence: Synthetic coding sequence
atggaggccgccagacccagcggcagctggaacggcgccctgtgcagactgctgctgctgaccctggccatcctgatcttcgccagcgacgcctgcaagaacgtgaccctgcacgtgcccagcaagctggacgccgagaagctggtgggcagagtgaacctgaaggagtgcttcaccgccgccaacctgatccacagcagcgaccccgacttccagatcctggaggacggcagcgtgtacaccaccaacaccatcctgctgagcagcgagaagagaagcttcaccatcctgctgagcaacaccgagaaccaggagaagaagaagatcttcgtgttcctggagcaccagaccaaggtgctgaagaagagacacaccaaggagaaggtgctgagaagagccaagagaagatgggcccccatcccctgcagcatgctggagaacagcctgggccccttccccctgttcctgcagcaggtgcagagcgacaccgcccagaactacaccatctactacagcatcagaggccccggcgtggaccaggagcccagaaacctgttctacgtggagagagacaccggcaacctgtactgcaccagacccgtggacagagagcagtacgagagcttcgagatcatcgccttcgccaccacccccgacggctacacccccgagctgcccctgcccctgatcatcaagatcgaggacgagaacgacaactaccccatcttcaccgaggagacctacaccttcaccatcttcgagaactgcagagtgggcaccaccgtgggccaggtgtgcgccaccgacaaggacgagcccgacaccatgcacaccagactgaagtacagcatcatcggccaggtgccccccagccccaccctgttcagcatgcaccccaccaccggcgtgatcaccaccaccagcagccagctggacagagagctgatcgacaagtaccagctgaagatcaaggtgcaggacatggacggccagtacttcggcctgcagaccaccagcacctgcatcatcaacatcgacgacgtgaacgaccacctgcccaccttcaccagaaccagctacgtgaccagcgtggaggagaacaccgtggacgtggagatcctgagagtgaccgtggaggacaaggacctggtgaacaccgccaactggagagccaactacaccatcctgaagggcaacgagaacggcaacttcaagatcgtgaccgacgccaagaccaacgagggcgtgctgtgcgtggtgaagcccctgaactacgaggagaagcagcagatgatcctgcagatcggcgtggtgaacgaggcccccttcagcagagaggccagccccagaagcgccatgagcaccgccaccgtgaccgtgaacgtggaggaccaggacgagggccccgagtgcaacccccccatccagaccgtgagaatgaaggagaacgccgaggtgggcaccaccagcaacggctacaaggcctacgaccccgagaccagaagcagcagcggcatcagatacaagaagctgaccgaccccaccggctgggtgaccatcgacgagaacaccggcagcatcaaggtgttcagaagcctggacagagaggccgagaccatcaagaacggcatctacaacatcaccgtgctggccagcgaccagggcggcagaacctgcaccggcaccctgggcatcatcctgcaggacgtgaacgacaacagccccttcatccccaagaagaccgtgatcatctgcaagcccaccatgagcagcgccgagatcgtggccgtggaccccgacgagcccatccacggcccccccttcgacttcagcctggagagcagcaccagcgaggtgcagagaatgtggagactgaaggccatcaacgacaccgccgccagactgagctaccagaacgacccccccttcggcagctacgtggtgcccatcaccgtgagagacagactgggcatgagcagcgtgaccagcctggacgtgaccctgtgcgactgcatcaccgagaacgactgcacccacagagtggaccccagaatcggcggcggcggcgtgcagctgggcaagtgggccatcctggccatcctgctgggcatcgccctgctgttctgcatcctgttcaccctggtgtgcggcgccagcggcaccagcaagcagcccaaggtgatccccgacgacctggcccagcagaacctgatcgtgagcaacaccgaggcccccggcgacgacaaggtgtacagcgccaacggcttcaccacccagaccgtgggcgccagcgcccagggcgtgtgcggcaccgtgggcagcggcatcaagaacggcggccaggagaccatcgagatggtgaagggcggccaccagaccagcgagagctgcagaggcgccggccaccaccacaccctggacagctgcagaggcggccacaccgaggtggacaactgcagatacacctacagcgagtggcacagcttcacccagcccagactgggcgaggagagcatcagaggccacaccctgatcaagaactag

SEQ ID NO: 10401 - DNA, 2706 bp, Artificial Sequence
  Description of Artificial Sequence: Synthetic coding sequence
atggaggccgccagacccagcggcagctggaacggcgccctgtgcagactgctgctgctgaccctggccatcctgatcttcgccagcgacgcctgcaagaacgtgaccctgcacgtgcccagcaagctggacgccgagaagctggtgggcagagtgaacctgaaggagtgcttcaccgccgccaacctgatccacagcagcgaccccgacttccagatcctggaggacggcagcgtgtacaccaccaacaccatcctgctgagcagcgagaagagaagcttcaccatcctgctgagcaacaccgagaaccaggagaagaagaagatcttcgtgttcctggagcaccagaccaaggtgctgaagaagagacacaccaaggagaaggtgctgagaagagccaagagaagatgggcccccatcccctgcagcatgctggagaacagcctgggccccttccccctgttcctgcagcaggtgcagagcgacaccgcccagaactacaccatctactacagcatcagaggccccggcgtggaccaggagcccagaaacctgttctacgtggagagagacaccggcaacctgtactgcaccagacccgtggacagagagcagtacgagagcttcgagatcatcgccttcgccaccacccccgacggctacacccccgagctgcccctgcccctgatcatcaagatcgaggacgagaacgacaactaccccatcttcaccgaggagacctacaccttcaccatcttcgagaactgcagagtgggcaccaccgtgggccaggtgtgcgccaccgacaaggacgagcccgacaccatgcacaccagactgaagtacagcatcatcggccaggtgccccccagccccaccctgttcagcatgcaccccaccaccggcgtgatcaccaccaccagcagccagctggacagagagctgatcgacaagtaccagctgaagatcaaggtgcaggacatggacggccagtacttcggcctgcagaccaccagcacctgcatcatcaacatcgacgacgtgaacgaccacctgcccaccttcaccagaaccagctacgtgaccagcgtggaggagaacaccgtggacgtggagatcctgagagtgaccgtggaggacaaggacctggtgaacaccgccaactggagagccaactacaccatcctgaagggcaacgagaacggcaacttcaagatcgtgaccgacgccaagaccaacgagggcgtgctgtgcgtggtgaagcccctgaactacgaggagaagcagcagatgatcctgcagatcggcgtggtgaacgaggcccccttcagcagagaggccagccccagaagcgccatgagcaccgccaccgtgaccgtgaacgtggaggaccaggacgagggccccgagtgcaacccccccatccagaccgtgagaatgaaggagaacgccgaggtgggcaccaccagcaacggctacaaggcctacgaccccgagaccagaagcagcagcggcatcagatacaagaagctgaccgaccccaccggctgggtgaccatcgacgagaacaccggcagcatcaaggtgttcagaagcctggacagagaggccgagaccatcaagaacggcatctacaacatcaccgtgctggccagcgaccagggcggcagaacctgcaccggcaccctgggcatcatcctgcaggacgtgaacgacaacagccccttcatccccaagaagaccgtgatcatctgcaagcccaccatgagcagcgccgagatcgtggccgtggaccccgacgagcccatccacggcccccccttcgacttcagcctggagagcagcaccagcgaggtgcagagaatgtggagactgaaggccatcaacgacaccgccgccagactgagctaccagaacgacccccccttcggcagctacgtggtgcccatcaccgtgagagacagactgggcatgagcagcgtgaccagcctggacgtgaccctgtgcgactgcatcaccgagaacgactgcacccacagagtggaccccagaatcggcggcggcggcgtgcagctgggcaagtgggccatcctggccatcctgctgggcatcgccctgctgttctgcatcctgttcaccctggtgtgcggcgccagcggcaccagcaagcagcccaaggtgatccccgacgacctggcccagcagaacctgatcgtgagcaacaccgaggcccccggcgacgacaaggtgtacagcgccaacggcttcaccacccagaccgtgggcgccagcgcccagggcgtgtgcggcaccgtgggcagcggcatcaagaacggcggccaggagaccatcgagatggtgaagggcggccaccagaccagcgagagctgcagaggcgccggccaccaccacaccctggacagctgcagaggcggccacaccgaggtggacaactgcagatacacctacagcgagtggcacagcttcacccagcccagactgggcgagaaggtgtacctgtgcaaccaggacgagaaccacaagcacgcccaggactacgtgctgacctacaactacgagggcagaggcagcgtggccggcagcgtgggctgctgcagcgagagacaggaggaggacggcctggagttcctggacaacctggagcccaagttcagaaccctggccgaggcctgcatgaagagatag

SEQ ID NO: 10402 - DNA, 2745 bp, Artificial Sequence
  Description of Artificial Sequence: Synthetic coding sequence
atggaggccgccagacccagcggcagctggaacggcgccctgtgcagactgctgctgctgaccctggccatcctgatcttcgccagcgacgcctgcaagaacgtgaccctgcacgtgcccagcaagctggacgccgagaagctggtgggcagagtgaacctgaaggagtgcttcaccgccgccaacctgatccacagcagcgaccccgacttccagatcctggaggacggcagcgtgtacaccaccaacaccatcctgctgagcagcgagaagagaagcttcaccatcctgctgagcaacaccgagaaccaggagaagaagaagatcttcgtgttcctggagcaccagaccaagatcagcctgctggtgccctggctgtgcctggtggccgaggtgctgaagaagagacacaccaaggagaaggtgctgagaagagccaagagaagatgggcccccatcccctgcagcatgctggagaacagcctgggccccttccccctgttcctgcagcaggtgcagagcgacaccgcccagaactacaccatctactacagcatcagaggccccggcgtggaccaggagcccagaaacctgttctacgtggagagagacaccggcaacctgtactgcaccagacccgtggacagagagcagtacgagagcttcgagatcatcgccttcgccaccacccccgacggctacacccccgagctgcccctgcccctgatcatcaagatcgaggacgagaacgacaactaccccatcttcaccgaggagacctacaccttcaccatcttcgagaactgcagagtgggcaccaccgtgggccaggtgtgcgccaccgacaaggacgagcccgacaccatgcacaccagactgaagtacagcatcatcggccaggtgccccccagccccaccctgttcagcatgcaccccaccaccggcgtgatcaccaccaccagcagccagctggacagagagctgatcgacaagtaccagctgaagatcaaggtgcaggacatggacggccagtacttcggcctgcagaccaccagcacctgcatcatcaacatcgacgacgtgaacgaccacctgcccaccttcaccagaaccagctacgtgaccagcgtggaggagaacaccgtggacgtggagatcctgagagtgaccgtggaggacaaggacctggtgaacaccgccaactggagagccaactacaccatcctgaagggcaacgagaacggcaacttcaagatcgtgaccgacgccaagaccaacgagggcgtgctgtgcgtggtgaagcccctgaactacgaggagaagcagcagatgatcctgcagatcggcgtggtgaacgaggcccccttcagcagagaggccagccccagaagcgccatgagcaccgccaccgtgaccgtgaacgtggaggaccaggacgagggccccgagtgcaacccccccatccagaccgtgagaatgaaggagaacgccgaggtgggcaccaccagcaacggctacaaggcctacgaccccgagaccagaagcagcagcggcatcagatacaagaagctgaccgaccccaccggctgggtgaccatcgacgagaacaccggcagcatcaaggtgttcagaagcctggacagagaggccgagaccatcaagaacggcatctacaacatcaccgtgctggccagcgaccagggcggcagaacctgcaccggcaccctgggcatcatcctgcaggacgtgaacgacaacagccccttcatccccaagaagaccgtgatcatctgcaagcccaccatgagcagcgccgagatcgtggccgtggaccccgacgagcccatccacggcccccccttcgacttcagcctggagagcagcaccagcgaggtgcagagaatgtggagactgaaggccatcaacgacaccgccgccagactgagctaccagaacgacccccccttcggcagctacgtggtgcccatcaccgtgagagacagactgggcatgagcagcgtgaccagcctggacgtgaccctgtgcgactgcatcaccgagaacgactgcacccacagagtggaccccagaatcggcggcggcggcgtgcagctgggcaagtgggccatcctggccatcctgctgggcatcgccctgctgttctgcatcctgttcaccctggtgtgcggcgccagcggcaccagcaagcagcccaaggtgatccccgacgacctggcccagcagaacctgatcgtgagcaacaccgaggcccccggcgacgacaaggtgtacagcgccaacggcttcaccacccagaccgtgggcgccagcgcccagggcgtgtgcggcaccgtgggcagcggcatcaagaacggcggccaggagaccatcgagatggtgaagggcggccaccagaccagcgagagctgcagaggcgccggccaccaccacaccctggacagctgcagaggcggccacaccgaggtggacaactgcagatacacctacagcgagtggcacagcttcacccagcccagactgggcgagaaggtgtacctgtgcaaccaggacgagaaccacaagcacgcccaggactacgtgctgacctacaactacgagggcagaggcagcgtggccggcagcgtgggctgctgcagcgagagacaggaggaggacggcctggagttcctggacaacctggagcccaagttcagaaccctggccgaggcctgcatgaagagatag

SEQ ID NO: 10403 - DNA, 2004 bp, Artificial Sequence
  Description of Artificial Sequence: Synthetic coding sequence
atgaagatgatcaccacccagttcctgcagaagaagctgatcctgctgcagttcctgaagatcgccgagtggggcaccaccgtgggccaggtgtgcgccaccgacaaggacgagcccgacaccatgcacaccagactgaagtacagcatcatcggccaggtgccccccagccccaccctgttcagcatgcaccccaccaccggcgtgatcaccaccaccagcagccagctggacagagagctgatcgacaagtaccagctgaagatcaaggtgcaggacatggacggccagtacttcggcctgcagaccaccagcacctgcatcatcaacatcgacgacgtgaacgaccacctgcccaccttcaccagaaccagctacgtgaccagcgtggaggagaacaccgtggacgtggagatcctgagagtgaccgtggaggacaaggacctggtgaacaccgccaactggagagccaactacaccatcctgaagggcaacgagaacggcaacttcaagatcgtgaccgacgccaagaccaacgagggcgtgctgtgcgtggtgaagcccctgaactacgaggagaagcagcagatgatcctgcagatcggcgtggtgaacgaggcccccttcagcagagaggccagccccagaagcgccatgagcaccgccaccgtgaccgtgaacgtggaggaccaggacgagggccccgagtgcaacccccccatccagaccgtgagaatgaaggagaacgccgaggtgggcaccaccagcaacggctacaaggcctacgaccccgagaccagaagcagcagcggcatcagatacaagaagctgaccgaccccaccggctgggtgaccatcgacgagaacaccggcagcatcaaggtgttcagaagcctggacagagaggccgagaccatcaagaacggcatctacaacatcaccgtgctggccagcgaccagggcggcagaacctgcaccggcaccctgggcatcatcctgcaggacgtgaacgacaacagccccttcatccccaagaagaccgtgatcatctgcaagcccaccatgagcagcgccgagatcgtggccgtggaccccgacgagcccatccacggcccccccttcgacttcagcctggagagcagcaccagcgaggtgcagagaatgtggagactgaaggccatcaacgacaccgccgccagactgagctaccagaacgacccccccttcggcagctacgtggtgcccatcaccgtgagagacagactgggcatgagcagcgtgaccagcctggacgtgaccctgtgcgactgcatcaccgagaacgactgcacccacagagtggaccccagaatcggcggcggcggcgtgcagctgggcaagtgggccatcctggccatcctgctgggcatcgccctgctgttctgcatcctgttcaccctggtgtgcggcgccagcggcaccagcaagcagcccaaggtgatccccgacgacctggcccagcagaacctgatcgtgagcaacaccgaggcccccggcgacgacaaggtgtacagcgccaacggcttcaccacccagaccgtgggcgccagcgcccagggcgtgtgcggcaccgtgggcagcggcatcaagaacggcggccaggagaccatcgagatggtgaagggcggccaccagaccagcgagagctgcagaggcgccggccaccaccacaccctggacagctgcagaggcggccacaccgaggtggacaactgcagatacacctacagcgagtggcacagcttcacccagcccagactgggcgagaaggtgtacctgtgcaaccaggacgagaaccacaagcacgcccaggactacgtgctgacctacaactacgagggcagaggcagcgtggccggcagcgtgggctgctgcagcgagagacaggaggaggacggcctggagttcctggacaacctggagcccaagttcagaaccctggccgaggcctgcatgaagagatag

SEQ ID NO: 10404 - DNA, 3000 bp, Artificial Sequence
  Description of Artificial Sequence: Synthetic coding sequence
atgatgggcctgttccccagaaccaccggcgccctggccatcttcgtggtggtgatcctggtgcacggcgagctgagaatcgagaccaagggccagtacgacgaggaggagatgaccatgcagcaggccaagagaagacagaagagagagtgggtgaagttcgccaagccctgcagagagggcgaggacaacagcaagagaaaccccatcgccaagatcaccagcgactaccaggccacccagaagatcacctacagaatcagcggcgtgggcatcgaccagccccccttcggcatcttcgtggtggacaagaacaccggcgacatcaacatcaccgccatcgtggacagagaggagacccccagcttcctgatcacctgcagagccctgaacgcccagggcctggacgtggagaagcccctgatcctgaccgtgaagatcctggacatcaacgacaacccccccgtgttcagccagcagatcttcatgggcgagatcgaggagaacagcgccagcaacagcctggtgatgatcctgaacgccaccgacgccgacgagcccaaccacctgaacagcaagatcgccttcaagatcgtgagccaggagcccgccggcacccccatgttcctgctgagcagaaacaccggcgaggtgagaaccctgaccaacagcctggacagagagcaggccagcagctacagactggtggtgagcggcgccgacaaggacggcgagggcctgagcacccagtgcgagtgcaacatcaaggtgaaggacgtgaacgacaacttccccatgttcagagacagccagtacagcgccagaatcgaggagaacatcctgagcagcgagctgctgagattccaggtgaccgacctggacgaggagtacaccgacaactggctggccgtgtacttcttcaccagcggcaacgagggcaactggttcgagatccagaccgaccccagaaccaacgagggcatcctgaaggtggtgaaggccctggactacgagcagctgcagagcgtgaagctgagcatcgccgtgaagaacaaggccgagttccaccagagcgtgatcagcagatacagagtgcagagcacccccgtgaccatccaggtgatcaacgtgagagagggcatcgccttcagacccgccagcaagaccttcaccgtgcagaagggcatcagcagcaagaagctggtggactacatcctgggcacctaccaggccatcgacgaggacaccaacaaggccgccagcaacgtgaagtacgtgatgggcagaaacgacggcggctacctgatgatcgacagcaagaccgccgagatcaagttcgtgaagaacatgaacagagacagcaccttcatcgtgaacaagaccatcaccgccgaggtgctggccatcgacgagtacaccggcaagaccagcaccggcaccgtgtacgtgagagtgcccgacttcaacgacaactgccccaccgccgtgctggagaaggacgccgtgtgcagcagcagccccagcgtggtggtgagcgccagaaccctgaacaacagatacaccggcccctacaccttcgccctggaggaccagcccgtgaagctgcccgccgtgtggagcatcaccaccctgaacgccaccagcgccctgctgagagcccaggagcagatcccccccggcgtgtaccacatcagcctggtgctgaccgacagccagaacaacagatgcgagatgcccagaagcctgaccctggaggtgtgccagtgcgacaacagaggcatctgcggcaccagctaccccaccaccagccccggcaccagatacggcagaccccacagcggcagactgggccccgccgccatcggcctgctgctgctgggcctgctgctgctgctgctggcccccctgctgctgctgacctgcgactgcggcgccggcagcaccggcggcgtgaccggcggcttcatccccgtgcccgacggcagcgagggcaccatccaccagtggggcatcgagggcgcccaccccgaggacaaggagatcaccaacatctgcgtgccccccgtgaccgccaacggcgccgacttcatggagagcagcgaggtgtgcaccaacacctacgccagaggcaccgccgtggagggcaccagcggcatggagatgaccaccaagctgggcgccgccaccgagagcggcggcgccgccggcttcgccaccggcaccgtgagcggcgccgccagcggcttcggcgccgccaccggcgtgggcatctgcagcagcggccagagcggcaccatgagaaccagacacagcaccggcggcaccaacaaggactacgccgacggcgccatcagcatgaacttcctggacagctacttcagccagaaggccttcgcctgcgccgaggaggacgacggccaggaggccaacgactgcctgctgatctacgacaacgagggcgccgacgccaccggcagccccgtgggcagcgtgggctgctgcagcttcatcgccgacgacctggacgacagcttcctggacagcctgggccccaagttcaagaagctggccgagatcagcctgggcgtggacggcgagggcaaggaggtgcagccccccagcaaggacagcggctacggcatcgagagctgcggccaccccatcgaggtgcagcagaccggcttcgtgaagtgccagaccctgagcggcagccagggcgccagcgccctgagcaccagcggcagcgtgcagcccgccgtgagcatccccgaccccctgcagcacggcaactacctggtgaccgagacctacagcgccagcggcagcctggtgcagcccagcaccgccggcttcgaccccctgctgacccagaacgtgatcgtgaccgagagagtgatctgccccatcagcagcgtgcccggcaacctggccggccccacccagctgagaggcagccacaccatgctgtgcaccgaggacccctgcagcagactgatctag

SEQ ID NO: 10405 - DNA, 8616 bp, Artificial Sequence
  Description of Artificial Sequence: Synthetic coding sequence
atgagctgcaacggcggcagccaccccagaatcaacaccctgggcagaatgatcagagccgagagcggccccgacctgagatacgaggtgaccagcggcggcggcggcaccagcagaatgtactacagcagaagaggcgtgatcaccgaccagaacagcgacggctactgccagaccggcaccatgagcagacaccagaaccagaacaccatccaggagctgctgcagaactgcagcgactgcctgatgagagccgagctgatcgtgcagcccgagctgaagtacggcgacggcatccagctgaccagaagcagagagctggacgagtgcttcgcccaggccaacgaccagatggagatcctggacagcctgatcagagagatgagacagatgggccagccctgcgacgcctaccagaagagactgctgcagctgcaggagcagatgagagccctgtacaaggccatcagcgtgcccagagtgagaagagccagcagcaagggcggcggcggctacacctgccagagcggcagcggctgggacgagttcaccaagcacgtgaccagcgagtgcctgggctggatgagacagcagagagccgagatggacatggtggcctggggcgtggacctggccagcgtggagcagcacatcaacagccacagaggcatccacaacagcatcggcgactacagatggcagctggacaagatcaaggccgacctgagagagaagagcgccatctaccagctggaggaggagtacgagaacctgctgaaggccagcttcgagagaatggaccacctgagacagctgcagaacatcatccaggccaccagcagagagatcatgtggatcaacgactgcgaggaggaggagctgctgtacgactggagcgacaagaacaccaacatcgcccagaagcaggaggccttcagcatcagaatgagccagctggaggtgaaggagaaggagctgaacaagctgaagcaggagagcgaccagctggtgctgaaccagcaccccgccagcgacaagatcgaggcctacatggacaccctgcagacccagtggagctggatcctgcagatcaccaagtgcatcgacgtgcacctgaaggagaacgccgcctacttccagttcttcgaggaggcccagagcaccgaggcctacctgaagggcctgcaggacagcatcagaaagaagtacccctgcgacaagaacatgcccctgcagcacctgctggagcagatcaaggagctggagaaggagagagagaagatcctggagtacaagagacaggtgcagaacctggtgaacaagagcaagaagatcgtgcagctgaagcccagaaaccccgactacagaagcaacaagcccatcatcctgagagccctgtgcgactacaagcaggaccagaagatcgtgcacaagggcgacgagtgcatcctgaaggacaacaacgagagaagcaagtggtacgtgaccggccccggcggcgtggacatgctggtgcccagcgtgggcctgatcatccccccccccaaccccctggccgtggacctgagctgcaagatcgagcagtactacgaggccatcctggccctgtggaaccagctgtacatcaacatgaagagcctggtgagctggcactactgcatgatcgacatcgagaagatcagagccatgaccatcgccaagctgaagaccatgagacaggaggactacatgaagaccatcgccgacctggagctgcactaccaggagttcatcagaaacagccagggcagcgagatgttcggcgacgacgacaagagaaagatccagagccagttcaccgacgcccagaagcactaccagaccctggtgatccagctgcccggctacccccagcaccagaccgtgaccaccaccgagatcacccaccacggcacctgccaggacgtgaaccacaacaaggtgatcgagaccaacagagagaacgacaagcaggagacctggatgctgatggagctgcagaagatcagaagacagatcgagcactgcgagggcagaatgaccctgaagaacctgcccctggccgaccagggcagcagccaccacatcaccgtgaagatcaacgagctgaagagcgtgcagaacgacagccaggccatcgccgaggtgctgaaccagctgaaggacatgctggccaacttcagaggcagcgagaagtactgctacctgcagaacgaggtgttcggcctgttccagaagctggagaacatcaacggcgtgaccgacggctacctgaacagcctgtgcaccgtgagagccctgctgcaggccatcctgcagaccgaggacatgctgaaggtgtacgaggccagactgaccgaggaggagaccgtgtgcctggacctggacaaggtggaggcctacagatgcggcctgaagaagatcaagaacgacctgaacctgaagaagagcctgctggccaccatgaagaccgagctgcagaaggcccagcagatccacagccagaccagccagcagtaccccctgtacgacctggacctgggcaagttcggcgagaaggtgacccagctgaccgacagatggcagagaatcgacaagcagatcgacttcagactgtgggacctggagaagcagatcaagcagctgagaaactacagagacaactaccaggccttctgcaagtggctgtacgacgccaagagaagacaggacagcctggagagcatgaagttcggcgacagcaacaccgtgatgagattcctgaacgagcagaagaacctgcacagcgagatcagcggcaagagagacaagagcgaggaggtgcagaagatcgccgagctgtgcgccaacagcatcaaggactacgagctgcagctggccagctacaccagcggcctggagaccctgctgaacatccccatcaagagaaccatgatccagagccccagcggcgtgatcctgcaggaggccgccgacgtgcacgccagatacatcgagctgctgaccagaagcggcgactactacagattcctgagcgagatgctgaagagcctggaggacctgaagctgaagaacaccaagatcgaggtgctggaggaggagctgagactggccagagacgccaacagcgagaactgcaacaagaacaagttcctggaccagaacctgcagaagtaccaggccgagtgcagccagttcaaggccaagctggccagcctggaggagctgaagagacaggccgagctggacggcaagagcgccaagcagaacctggacaagtgctacggccagatcaaggagctgaacgagaagatcaccagactgacctacgagatcgaggacgagaagagaagaagaaagagcgtggaggacagattcgaccagcagaagaacgactacgaccagctgcagaaggccagacagtgcgagaaggagaacctgggctggcagaagctggagagcgagaaggccatcaaggagaaggagtacgagatcgagagactgagagtgctgctgcaggaggagggcaccagaaagagagagtacgagaacgagctggccaaggtgagaaaccactacaacgaggagatgagcaacctgagaaacaagtacgagaccgagatcaacatcaccaagaccaccatcaaggagatcagcatgcagaaggaggacgacagcaagaacctgagaaaccagctggacagactgagcagagagaacagagacctgaaggacgagatcgtgagactgaacgacagcatcctgcaggccaccgagcagagaagaagagccgaggagaacgccctgcagcagaaggcctgcggcagcgagatcatgcagaagaagcagcacctggagatcgagctgaagcaggtgatgcagcagagaagcgaggacaacgccagacacaagcagagcctggaggaggccgccaagaccatccaggacaagaacaaggagatcgagagactgaaggccgagttccaggaggaggccaagagaagatgggagtacgagaacgagctgagcaaggtgagaaacaactacgacgaggagatcatcagcctgaagaaccagttcgagaccgagatcaacatcaccaagaccaccatccaccagctgaccatgcagaaggaggaggacaccagcggctacagagcccagatcgacaacctgaccagagagaacagaagcctgagcgaggagatcaagagactgaagaacaccctgacccagaccaccgagaacctgagaagagtggaggaggacatccagcagcagaaggccaccggcagcgaggtgagccagagaaagcagcagctggaggtggagctgagacaggtgacccagatgagaaccgaggagagcgtgagatacaagcagagcctggacgacgccgccaagaccatccaggacaagaacaaggagatcgagagactgaagcagctgatcgacaaggagaccaacgacagaaagtgcctggaggacgagaacgccagactgcagagagtgcagtacgacctgcagaaggccaacagcagcgccaccgagaccatcaacaagctgaaggtgcaggagcaggagctgaccagactgagaatcgactacgagagagtgagccaggagagaaccgtgaaggaccaggacatcaccagattccagaacagcctgaaggagctgcagctgcagaagcagaaggtggaggaggagctgaacagactgaagagaaccgccagcgaggacagctgcaagagaaagaagctggaggaggagctggagggcatgagaagaagcctgaaggagcaggccatcaagatcaccaacctgacccagcagctggagcaggccagcatcgtgaagaagagaagcgaggacgacctgagacagcagagagacgtgctggacggccacctgagagagaagcagagaacccaggaggagctgagaagactgagcagcgaggtggaggccctgagaagacagctgctgcaggagcaggagagcgtgaagcaggcccacctgagaaacgagcacttccagaaggccatcgaggacaagagcagaagcctgaacgagagcaagatcgagatcgagagactgcagagcctgaccgagaacctgaccaaggagcacctgatgctggaggaggagctgagaaacctgagactggagtacgacgacctgagaagaggcagaagcgaggccgacagcgacaagaacgccaccatcctggagctgagaagccagctgcagatcagcaacaacagaaccctggagctgcagggcctgatcaacgacctgcagagagagagagagaacctgagacaggagatcgagaagttccagaagcaggccctggaggccagcaacagaatccaggagagcaagaaccagtgcacccaggtggtgcaggagagagagagcctgctggtgaagatcaaggtgctggagcaggacaaggccagactgcagagactggaggacgagctgaacagagccaagagcaccctggaggccgagaccagagtgaagcagagactggagtgcgagaagcagcagatccagaacgacctgaaccagtggaagacccagtacagcagaaaggaggaggccatcagaaagatcgagagcgagagagagaagagcgagagagagaagaacagcctgagaagcgagatcgagagactgcaggccgagatcaagagaatcgaggagagatgcagaagaaagctggaggacagcaccagagagacccagagccagctggagaccgagagaagcagataccagagagagatcgacaagctgagacagagaccctacggcagccacagagagacccagaccgagtgcgagtggaccgtggacaccagcaagctggtgttcgacggcctgagaaagaaggtgaccgccatgcagctgtacgagtgccagctgatcgacaagaccaccctggacaagctgctgaagggcaagaagagcgtggaggaggtggccagcgagatccagcccttcctgagaggcgccggcagcatcgccggcgccagcgccagccccaaggagaagtacagcctggtggaggccaagagaaagaagctgatcagccccgagagcaccgtgatgctgctggaggcccaggccgccaccggcggcatcatcgacccccacagaaacgagaagctgaccgtggacagcgccatcgccagagacctgatcgacttcgacgacagacagcagatctacgccgccgagaaggccatcaccggcttcgacgaccccttcagcggcaagaccgtgagcgtgagcgaggccatcaagaagaacctgatcgacagagagaccggcatgagactgctggaggcccagatcgccagcggcggcgtggtggaccccgtgaacagcgtgttcctgcccaaggacgtggccctggccagaggcctgatcgacagagacctgtacagaagcctgaacgaccccagagacagccagaagaacttcgtggaccccgtgaccaagaagaaggtgagctacgtgcagctgaaggagagatgcagaatcgagccccacaccggcctgctgctgctgagcgtgcagaagagaagcatgagcttccagggcatcagacagcccgtgaccgtgaccgagctggtggacagcggcatcctgagacccagcaccgtgaacgagctggagagcggccagatcagctacgacgaggtgggcgagagaatcaaggacttcctgcagggcagcagctgcatcgccggcatctacaacgagaccaccaagcagaagctgggcatctacgaggccatgaagatcggcctggtgagacccggcaccgccctggagctgctggaggcccaggccgccaccggcttcatcgtggaccccgtgagcaacctgagactgcccgtggaggaggcctacaagagaggcctggtgggcatcgagttcaaggagaagctgctgagcgccgagagagccgtgaccggctacaacgaccccgagaccggcaacatcatcagcctgttccaggccatgaacaaggagctgatcgagaagggccacggcatcagactgctggaggcccagatcgccaccggcggcatcatcgaccccaaggagagccacagactgcccgtggacatcgcctacaagagaggctacttcaacgaggagctgagcgagatcctgagcgaccccagcgacgacaccaagggcttcttcgaccccaacaccgaggagaacctgacctacctgcagctgaaggagagatgcatcaaggacgaggagaccggcctgtgcctgctgcccctgaaggagaagaagaagcaggtgcagaccagccagaagaacaccctgagaaagagaagagtggtgatcgtggaccccgagaccaacaaggagatgagcgtgcaggaggcctacaagaagggcctgatcgactacgagaccttcaaggagctgtgcgagcaggagtgcgagtgggaggagatcaccatcaccggcagcgacggcagcaccagagtggtgctggtggacagaaagaccggcagccagtacgacatccaggacgccatcgacaagggcctggtggacagaaagttcttcgaccagtacagaagcggcagcctgagcctgacccagttcgccgacatgatcagcctgaagaacggcgtgggcaccagcagcagcatgggcagcggcgtgagcgacgacgtgttcagcagcagcagacacgagagcgtgagcaagatcagcaccatcagcagcgtgagaaacctgaccatcagaagcagcagcttcagcgacaccctggaggagagcagccccatcgccgccatcttcgacaccgagaacctggagaagatcagcatcaccgagggcatcgagagaggcatcgtggacagcatcaccggccagagactgctggaggcccaggcctgcaccggcggcatcatccaccccaccaccggccagaagctgagcctgcaggacgccgtgagccagggcgtgatcgaccaggacatggccaccagactgaagcccgcccagaaggccttcatcggcttcgagggcgtgaagggcaagaagaagatgagcgccgccgaggccgtgaaggagaagtggctgccctacgaggccggccagagattcctggagttccagtacctgaccggcggcctggtggaccccgaggtgcacggcagaatcagcaccgaggaggccatcagaaagggcttcatcgacggcagagccgcccagagactgcaggacaccagcagctacgccaagatcctgacctgccccaagaccaagctgaagatcagctacaaggacgccatcaacagaagcatggtggaggacatcaccggcctgagactgctggaggccgccagcgtgagcagcaagggcctgcccagcccctacaacatgagcagcgcccccggcagcagaagcggcagcagaagcggcagcagaagcggcagcagaagcggcagcagaagcggcagcagaagaggcagcttcgacgccaccggcaacagcagctacagctacagctacagcttcagcagcagcagcatcggccactag

SEQ ID NO: 10406 - DNA, 2862 bp, Artificial Sequence
  Description of Artificial Sequence: Synthetic coding sequence
cagcagcagagagccgagatggacatggtggcctggggcgtggacctggccagcgtggagcagcacatcaacagccacagaggcatccacaacagcatcggcgactacagatggcagctggacaagatcaaggccgacctgagagagaagagcgccatctaccagctggaggaggagtacgagaacctgctgaaggccagcttcgagagaatggaccacctgagacagctgcagaacatcatccaggccaccagcagagagatcatgtggatcaacgactgcgaggaggaggagctgctgtacgactggagcgacaagaacaccaacatcgcccagaagcaggaggccttcagcatcagaatgagccagctggaggtgaaggagaaggagctgaacaagctgaagcaggagagcgaccagctggtgctgaaccagcaccccgccagcgacaagatcgaggcctacatggacaccctgcagacccagtggagctggatcctgcagatcaccaagtgcatcgacgtgcacctgaaggagaacgccgcctacttccagttcttcgaggaggcccagagcaccgaggcctacctgaagggcctgcaggacagcatcagaaagaagtacccctgcgacaagaacatgcccctgcagcacctgctggagcagatcaaggagctggagaaggagagagagaagatcctggagtacaagagacaggtgcagaacctggtgaacaagagcaagaagatcgtgcagctgaagcccagaaaccccgactacagaagcaacaagcccatcatcctgagagccctgtgcgactacaagcaggaccagaagatcgtgcacaagggcgacgagtgcatcctgaaggacaacaacgagagaagcaagtggtacgtgaccggccccggcggcgtggacatgctggtgcccagcgtgggcctgatcatccccccccccaaccccctggccgtggacctgagctgcaagatcgagcagtactacgaggccatcctggccctgtggaaccagctgtacatcaacatgaagagcctggtgagctggcactactgcatgatcgacatcgagaagatcagagccatgaccatcgccaagctgaagaccatgagacaggaggactacatgaagaccatcgccgacctggagctgcactaccaggagttcatcagaaacagccagggcagcgagatgttcggcgacgacgacaagagaaagatccagagccagttcaccgacgcccagaagcactaccagaccctggtgatccagctgcccggctacccccagcaccagaccgtgaccaccaccgagatcacccaccacggcacctgccaggacgtgaaccacaacaaggtgatcgagaccaacagagagaacgacaagcaggagacctggatgctgatggagctgcagaagatcagaagacagatcgagcactgcgagggcagaatgaccctgaagaacctgcccctggccgaccagggcagcagccaccacatcaccgtgaagatcaacgagctgaagagcgtgcagaacgacagccaggccatcgccgaggtgctgaaccagctgaaggacatgctggccaacttcagaggcagcgagaagtactgctacctgcagaacgaggtgttcggcctgttccagaagctggagaacatcaacggcgtgaccgacggctacctgaacagcctgtgcaccgtgagagccctgctgcaggccatcctgcagaccgaggacatgctgaaggtgtacgaggccagactgaccgaggaggagaccgtgtgcctggacctggacaaggtggaggcctacagatgcggcctgaagaagatcaagaacgacctgaacctgaagaagagcctgctggccaccatgaagaccgagctgcagaaggcccagcagatccacagccagaccagccagcagtaccccctgtacgacctggacctgggcaagttcggcgagaaggtgacccagctgaccgacagatggcagagaatcgacaagcagatcgacttcagactgtgggacctggagaagcagatcaagcagctgagaaactacagagacaactaccaggccttctgcaagtggctgtacgacgccaagagaagacaggacagcctggagagcatgaagttcggcgacagcaacaccgtgatgagattcctgaacgagcagaagaacctgcacagcgagatcagcggcaagagagacaagagcgaggaggtgcagaagatcgccgagctgtgcgccaacagcatcaaggactacgagctgcagctggccagctacaccagcggcctggagaccctgctgaacatccccatcaagagaaccatgatccagagccccagcggcgtgatcctgcaggaggccgccgacgtgcacgccagatacatcgagctgctgaccagaagcggcgactactacagattcctgagcgagatgctgaagagcctggaggacctgaagctgaagaacaccaagatcgaggtgctggaggaggagctgagactggccagagacgccaacagcgagaactgcaacaagaacaagttcctggaccagaacctgcagaagtaccaggccgagtgcagccagttcaaggccaagctggccagcctggaggagctgaagagacaggccgagctggacggcaagagcgccaagcagaacctggacaagtgctacggccagatcaaggagctgaacgagaagatcaccagactgacctacgagatcgaggacgagaagagaagaagaaagagcgtggaggacagattcgaccagcagaagaacgactacgaccagctgcagaaggccagacagtgctag

SEQ ID NO: 10407 - DNA, 6819 bp, Artificial Sequence
  Description of Artificial Sequence: Synthetic coding sequence
atgagctgcaacggcggcagccaccccagaatcaacaccctgggcagaatgatcagagccgagagcggccccgacctgagatacgaggtgaccagcggcggcggcggcaccagcagaatgtactacagcagaagaggcgtgatcaccgaccagaacagcgacggctactgccagaccggcaccatgagcagacaccagaaccagaacaccatccaggagctgctgcagaactgcagcgactgcctgatgagagccgagctgatcgtgcagcccgagctgaagtacggcgacggcatccagctgaccagaagcagagagctggacgagtgcttcgcccaggccaacgaccagatggagatcctggacagcctgatcagagagatgagacagatgggccagccctgcgacgcctaccagaagagactgctgcagctgcaggagcagatgagagccctgtacaaggccatcagcgtgcccagagtgagaagagccagcagcaagggcggcggcggctacacctgccagagcggcagcggctgggacgagttcaccaagcacgtgaccagcgagtgcctgggctggatgagacagcagagagccgagatggacatggtggcctggggcgtggacctggccagcgtggagcagcacatcaacagccacagaggcatccacaacagcatcggcgactacagatggcagctggacaagatcaaggccgacctgagagagaagagcgccatctaccagctggaggaggagtacgagaacctgctgaaggccagcttcgagagaatggaccacctgagacagctgcagaacatcatccaggccaccagcagagagatcatgtggatcaacgactgcgaggaggaggagctgctgtacgactggagcgacaagaacaccaacatcgcccagaagcaggaggccttcagcatcagaatgagccagctggaggtgaaggagaaggagctgaacaagctgaagcaggagagcgaccagctggtgctgaaccagcaccccgccagcgacaagatcgaggcctacatggacaccctgcagacccagtggagctggatcctgcagatcaccaagtgcatcgacgtgcacctgaaggagaacgccgcctacttccagttcttcgaggaggcccagagcaccgaggcctacctgaagggcctgcaggacagcatcagaaagaagtacccctgcgacaagaacatgcccctgcagcacctgctggagcagatcaaggagctggagaaggagagagagaagatcctggagtacaagagacaggtgcagaacctggtgaacaagagcaagaagatcgtgcagctgaagcccagaaaccccgactacagaagcaacaagcccatcatcctgagagccctgtgcgactacaagcaggaccagaagatcgtgcacaagggcgacgagtgcatcctgaaggacaacaacgagagaagcaagtggtacgtgaccggccccggcggcgtggacatgctggtgcccagcgtgggcctgatcatccccccccccaaccccctggccgtggacctgagctgcaagatcgagcagtactacgaggccatcctggccctgtggaaccagctgtacatcaacatgaagagcctggtgagctggcactactgcatgatcgacatcgagaagatcagagccatgaccatcgccaagctgaagaccatgagacaggaggactacatgaagaccatcgccgacctggagctgcactaccaggagttcatcagaaacagccagggcagcgagatgttcggcgacgacgacaagagaaagatccagagccagttcaccgacgcccagaagcactaccagaccctggtgatccagctgcccggctacccccagcaccagaccgtgaccaccaccgagatcacccaccacggcacctgccaggacgtgaaccacaacaaggtgatcgagaccaacagagagaacgacaagcaggagacctggatgctgatggagctgcagaagatcagaagacagatcgagcactgcgagggcagaatgaccctgaagaacctgcccctggccgaccagggcagcagccaccacatcaccgtgaagatcaacgagctgaagagcgtgcagaacgacagccaggccatcgccgaggtgctgaaccagctgaaggacatgctggccaacttcagaggcagcgagaagtactgctacctgcagaacgaggtgttcggcctgttccagaagctggagaacatcaacggcgtgaccgacggctacctgaacagcctgtgcaccgtgagagccctgctgcaggccatcctgcagaccgaggacatgctgaaggtgtacgaggccagactgaccgaggaggagaccgtgtgcctggacctggacaaggtggaggcctacagatgcggcctgaagaagatcaagaacgacctgaacctgaagaagagcctgctggccaccatgaagaccgagctgcagaaggcccagcagatccacagccagaccagccagcagtaccccctgtacgacctggacctgggcaagttcggcgagaaggtgacccagctgaccgacagatggcagagaatcgacaagcagatcgacttcagactgtgggacctggagaagcagatcaagcagctgagaaactacagagacaactaccaggccttctgcaagtggctgtacgacgccaagagaagacaggacagcctggagagcatgaagttcggcgacagcaacaccgtgatgagattcctgaacgagcagaagaacctgcacagcgagatcagcggcaagagagacaagagcgaggaggtgcagaagatcgccgagctgtgcgccaacagcatcaaggactacgagctgcagctggccagctacaccagcggcctggagaccctgctgaacatccccatcaagagaaccatgatccagagccccagcggcgtgatcctgcaggaggccgccgacgtgcacgccagatacatcgagctgctgaccagaagcggcgactactacagattcctgagcgagatgctgaagagcctggaggacctgaagctgaagaacaccaagatcgaggtgctggaggaggagctgagactggccagagacgccaacagcgagaactgcaacaagaacaagttcctggaccagaacctgcagaagtaccaggccgagtgcagccagttcaaggccaagctggccagcctggaggagctgaagagacaggccgagctggacggcaagagcgccaagcagaacctggacaagtgctacggccagatcaaggagctgaacgagaagatcaccagactgacctacgagatcgaggacgagaagagaagaagaaagagcgtggaggacagattcgaccagcagaagaacgactacgaccagctgcagaaggccagacagtgcgagaaggagaacctgggctggcagaagctggagagcgagaaggccatcaaggagaaggagtacgagatcgagagactgagagtgctgctgcaggaggagggcaccagaaagagagagtacgagaacgagctggccaaggccagcaacagaatccaggagagcaagaaccagtgcacccaggtggtgcaggagagagagagcctgctggtgaagatcaaggtgctggagcaggacaaggccagactgcagagactggaggacgagctgaacagagccaagagcaccctggaggccgagaccagagtgaagcagagactggagtgcgagaagcagcagatccagaacgacctgaaccagtggaagacccagtacagcagaaaggaggaggccatcagaaagatcgagagcgagagagagaagagcgagagagagaagaacagcctgagaagcgagatcgagagactgcaggccgagatcaagagaatcgaggagagatgcagaagaaagctggaggacagcaccagagagacccagagccagctggagaccgagagaagcagataccagagagagatcgacaagctgagacagagaccctacggcagccacagagagacccagaccgagtgcgagtggaccgtggacaccagcaagctggtgttcgacggcctgagaaagaaggtgaccgccatgcagctgtacgagtgccagctgatcgacaagaccaccctggacaagctgctgaagggcaagaagagcgtggaggaggtggccagcgagatccagcccttcctgagaggcgccggcagcatcgccggcgccagcgccagccccaaggagaagtacagcctggtggaggccaagagaaagaagctgatcagccccgagagcaccgtgatgctgctggaggcccaggccgccaccggcggcatcatcgacccccacagaaacgagaagctgaccgtggacagcgccatcgccagagacctgatcgacttcgacgacagacagcagatctacgccgccgagaaggccatcaccggcttcgacgaccccttcagcggcaagaccgtgagcgtgagcgaggccatcaagaagaacctgatcgacagagagaccggcatgagactgctggaggcccagatcgccagcggcggcgtggtggaccccgtgaacagcgtgttcctgcccaaggacgtggccctggccagaggcctgatcgacagagacctgtacagaagcctgaacgaccccagagacagccagaagaacttcgtggaccccgtgaccaagaagaaggtgagctacgtgcagctgaaggagagatgcagaatcgagccccacaccggcctgctgctgctgagcgtgcagaagagaagcatgagcttccagggcatcagacagcccgtgaccgtgaccgagctggtggacagcggcatcctgagacccagcaccgtgaacgagctggagagcggccagatcagctacgacgaggtgggcgagagaatcaaggacttcctgcagggcagcagctgcatcgccggcatctacaacgagaccaccaagcagaagctgggcatctacgaggccatgaagatcggcctggtgagacccggcaccgccctggagctgctggaggcccaggccgccaccggcttcatcgtggaccccgtgagcaacctgagactgcccgtggaggaggcctacaagagaggcctggtgggcatcgagttcaaggagaagctgctgagcgccgagagagccgtgaccggctacaacgaccccgagaccggcaacatcatcagcctgttccaggccatgaacaaggagctgatcgagaagggccacggcatcagactgctggaggcccagatcgccaccggcggcatcatcgaccccaaggagagccacagactgcccgtggacatcgcctacaagagaggctacttcaacgaggagctgagcgagatcctgagcgaccccagcgacgacaccaagggcttcttcgaccccaacaccgaggagaacctgacctacctgcagctgaaggagagatgcatcaaggacgaggagaccggcctgtgcctgctgcccctgaaggagaagaagaagcaggtgcagaccagccagaagaacaccctgagaaagagaagagtggtgatcgtggaccccgagaccaacaaggagatgagcgtgcaggaggcctacaagaagggcctgatcgactacgagaccttcaaggagctgtgcgagcaggagtgcgagtgggaggagatcaccatcaccggcagcgacggcagcaccagagtggtgctggtggacagaaagaccggcagccagtacgacatccaggacgccatcgacaagggcctggtggacagaaagttcttcgaccagtacagaagcggcagcctgagcctgacccagttcgccgacatgatcagcctgaagaacggcgtgggcaccagcagcagcatgggcagcggcgtgagcgacgacgtgttcagcagcagcagacacgagagcgtgagcaagatcagcaccatcagcagcgtgagaaacctgaccatcagaagcagcagcttcagcgacaccctggaggagagcagccccatcgccgccatcttcgacaccgagaacctggagaagatcagcatcaccgagggcatcgagagaggcatcgtggacagcatcaccggccagagactgctggaggcccaggcctgcaccggcggcatcatccaccccaccaccggccagaagctgagcctgcaggacgccgtgagccagggcgtgatcgaccaggacatggccaccagactgaagcccgcccagaaggccttcatcggcttcgagggcgtgaagggcaagaagaagatgagcgccgccgaggccgtgaaggagaagtggctgccctacgaggccggccagagattcctggagttccagtacctgaccggcggcctggtggaccccgaggtgcacggcagaatcagcaccgaggaggccatcagaaagggcttcatcgacggcagagccgcccagagactgcaggacaccagcagctacgccaagatcctgacctgccccaagaccaagctgaagatcagctacaaggacgccatcaacagaagcatggtggaggacatcaccggcctgagactgctggaggccgccagcgtgagcagcaagggcctgcccagcccctacaacatgagcagcgcccccggcagcagaagcggcagcagaagcggcagcagaagcggcagcagaagcggcagcagaagcggcagcagaagaggcagcttcgacgccaccggcaacagcagctacagctacagctacagcttcagcagcagcagcatcggccactag

SEQ ID NO: 10408 - DNA, 507 bp, Artificial Sequence
  Description of Artificial Sequence: Synthetic coding sequence
atggagccccccaacctgtaccccgtgaagctgtacgtgtacgacctgagcaagggcctggccagaagactgagccccatcatgctgggcaagcagctggagggcatctggcacaccagcatcgtggtgcacaaggacgagttcttcttcggcagcggcggcatcagcagctgcccccccggcggcaccctgctgggcccccccgacagcgtggtggacgtgggcagcaccgaggtgaccgaggagatcttcctggagtacctgagcagcctgggcgagagcctgttcagaggcgaggcctacaacctgttcgagcacaactgcaacaccttcagcaacgaggtggcccagttcctgaccggcagaaagatccccagctacatcaccgacctgcccagcgaggtgctgagcacccccttcggccaggccctgagacccctgctggacagcatccagatccagccccccggcggcagcagcgtgggcagacccaacggccagagctag

SEQ ID NO: 10409 - DNA, 561 bp, Artificial Sequence
  Description of Artificial Sequence: Synthetic coding sequence
atgaagagcgacttctacttccagaagagcgagccccacagcctgagcagcgaggccctgatgagaagagccgtgagcctggtgaccgacagcaccagcaccttcctgagccagaccacctacgccctgatcgaggccatcaccgagtacaccaaggccgtgtacaccctgaccagcctgtacagacagtacaccagcctgctgggcaagatgaacagcgaggaggaggacgaggtgtggcaggtgatcatcggcgccagagccgagatgaccagcaagcaccaggagtacctgaagctggagaccacctggatgaccgccgtgggcctgagcgagatggccgccgaggccgcctaccagaccggcgccgaccaggccagcatcaccgccagaaaccacatccagctggtgaagctgcaggtggaggaggtgcaccagctgagcagaaaggccgagaccaagctggccgaggcccagatcgaggagctgagacagaagacccaggaggagggcgaggagagagccgagagcgagcaggaggcctacctgagagaggactag

SEQ ID NO: 10410 - DNA, 588 bp, Artificial Sequence
  Description of Artificial Sequence: Synthetic coding sequence
atggccgccctgaagagctggctgagcagaagcgtgaccagcttcttcagatacagacagtgcctgtgcgtgcccgtggtggccaacttcaagaagagatgcttcagcgagctgatcagaccctggcacaagaccgtgaccatcggcttcggcgtgaccctgtgcgccgtgcccatcgcccaggccgtgtacaccctgaccagcctgtacagacagtacaccagcctgctgggcaagatgaacagcgaggaggaggacgaggtgtggcaggtgatcatcggcgccagagccgagatgaccagcaagcaccaggagtacctgaagctggagaccacctggatgaccgccgtgggcctgagcgagatggccgccgaggccgcctaccagaccggcgccgaccaggccagcatcaccgccagaaaccacatccagctggtgaagctgcaggtggaggaggtgcaccagctgagcagaaaggccgagaccaagctggccgaggcccagatcgaggagctgagacagaagacccaggaggagggcgaggagagagccgagagcgagcaggaggcctacctgagagaggactag

SEQ ID NO: 10411 - DNA, 588 bp, Artificial Sequence; identical to SEQ ID NO: 10410
  Description of Artificial Sequence: Synthetic coding sequence

SEQ ID NO: 10412 - DNA, 720 bp, Artificial Sequence
  Description of Artificial Sequence: Synthetic coding sequence
atggccgccctgaagagctggctgagcagaagcgtgaccagcttcttcagatacagacagtgcctgtgcgtgcccgtggtggccaacttcaagaagagatgcttcagcgagctgatcagaccctggcacaagaccgtgaccatcggcttcggcgtgaccctgtgcgccgtgcccatcgcccagaagagcgagccccacagcctgagcagcgaggccctgatgagaagagccgtgagcctggtgaccgacagcaccagcaccttcctgagccagaccacctacgccctgatcgaggccatcaccgagtacaccaaggccgtgtacaccctgaccagcctgtacagacagtacaccagcctgctgggcaagatgaacagcgaggaggaggacgaggtgtggcaggtgatcatcggcgccagagccgagatgaccagcaagcaccaggagtacctgaagctggagaccacctggatgaccgccgtgggcctgagcgagatggccgccgaggccgcctaccagaccggcgccgaccaggccagcatcaccgccagaaaccacatccagctggtgaagctgcaggtggaggaggtgcaccagctgagcagaaaggccgagaccaagctggccgaggcccagatcgaggagctgagacagaagacccaggaggagggcgaggagagagccgagagcgagcaggaggcctacctgagagaggactag

SEQ ID NO: 10413 - DNA, 561 bp, Artificial Sequence; identical to SEQ ID NO: 10409
  Description of Artificial Sequence: Synthetic coding sequence

SEQ ID NO: 10414 - DNA, 3822 bp, Artificial Sequence
  Description of Artificial Sequence: Synthetic coding sequence
atggagccccccggcggcagcctgggccccggcagaggcaccagagacaagaagaagggcagaagccccgacgagctgcccagcgccggcggcgacggcggcaagagcaagaagttcaccctgaagagactgatggccgacgagctggagagattcaccagcatgagaatcaagaaggagaaggagaagcccaacagcgcccacagaaacagcagcgccagctacggcgacgaccccaccgcccagagcctgcaggacgtgagcgacgagcaggtgctggtgctgttcgagcagatgctgctggacatgaacctgaacgaggagaagcagcagcccctgagagagaaggacatcatcatcaagagagagatggtgagccagtacctgtacaccagcaaggccggcatgagccagaaggagagcagcaagagcgccatgatgtacatccaggagctgagaagcggcctgagagacatgcccctgctgagctgcctggagagcctgagagtgagcctgaacaacaaccccgtgagctgggtgcagaccttcggcgccgagggcctggccagcctgctggacatcctgaagagactgcacgacgagaaggaggagaccgccggcagctacgacagcagaaacaagcacgagatcatcagatgcctgaaggccttcatgaacaacaagttcggcatcaagaccatgctggagaccgaggagggcatcctgctgctggtgagagccatggaccccgccgtgcccaacatgatgatcgacgccgccaagctgctgagcgccctgtgcatcctgccccagcccgaggacatgaacgagagagtgctggaggccatgaccgagagagccgagatggacgaggtggagagattccagcccctgctggacggcctgaagagcggcaccaccatcgccctgaaggtgggctgcctgcagctgatcaacgccctgatcacccccgccgaggagctggacttcagagtgcacatcagaagcgagctgatgagactgggcctgcaccaggtgctgcaggacctgagagagatcgagaacgaggacatgagagtgcagctgaacgtgttcgacgagcagggcgaggaggacagctacgacctgaagggcagactggacgacatcagaatggagatggacgacttcaacgaggtgttccagatcctgctgaacaccgtgaaggacagcaaggccgagccccacttcctgagcatcctgcagcacctgctgctggtgagaaacgactacgaggccagaccccagtactacaagctgatcgaggagtgcatcagccagatcgtgctgcacaagaacggcgccgaccccgacttcaagtgcagacacctgcagatcgagatcgagggcctgatcgaccagatgatcgacaagaccaaggtggagaagagcgaggccaaggccgccgagctggagaagaagctggacagcgagctgaccgccagacacgagctgcaggtggagatgaagaagatggagagcgacttcgagcagaagctgcaggacctgcagggcgagaaggacgccctgcacagcgagaagcagcagatcgccaccgagaagcaggacctggaggccgaggtgagccagctgaccggcgaggtggccaagctgaccaaggagctggaggacgccaagaaggagatggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcgtgtgcatcagcagcccccccagcctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagagaaccaagaaggccaagaaggaccaggagggcggcgaggagaagaagagcgtgcagaagaagaaggtgaaggagctgaaggtgctggacagcaagaccgcccagaacctgagcatcttcctgggcagcttcagaatgccctaccaggagatcaagaacgtgatcctggaggtgaacgaggccgtgctgaccgagagcatgatccagaacctgatcaagcagatgcccgagcccgagcagctgaagatgctgagcgagctgaaggacgagtacgacgacctggccgagagcgagcagttcggcgtggtgatgggcaccgtgcccagactgagacccagactgaacgccatcctgttcaagctgcagttcagcgagcaggtggagaacatcaagcccgagatcgtgagcgtgaccgccgcctgcgaggagctgagaaagagcgagagcttcagcaacctgctggagatcaccctgctggtgggcaactacatgaacgccggcagcagaaacgccggcgccttcggcttcaacatcagcttcctgtgcaagctgagagacaccaagagcaccgaccagaagatgaccctgctgcacttcctggccgagctgtgcgagaacgactaccccgacgtgctgaagttccccgacgagctggcccacgtggagaaggccagcagagtgagcgccgagaacctgcagaagaacctggaccagatgaagaagcagatcagcgacgtggagagagacgtgcagaacttccccgccgccaccgacgagaaggacaagttcgtggagaagatgaccatcttcgtgaaggacgcccaggagcagtacaacaagctgagaatgatgcacagcaacatggagaccctgtacaaggagctgggcgagtacttcctgttcgaccccaagaagctgagcgtggaggagttcttcatggacctgcacaacttcagaaacatgttcctgcaggccgtgaaggagaaccagaagagaagagagaccgaggagaagatgagaagagccaagctggccaaggagaaggccgagaaggagagactggagaagcagcagaagagagagcagctgatcgacatgaacgccgagggcgacgagaccggcgtgatggacagcctgctggaggccctgcagagcggcgccgccttcagaagaaagagaggccccagacaggccaacagaaaggccggctgcgccgtgaccagcctgctggccagcgagctgaccaaggacgacgccatggccgccgtgcccgccaaggtgagcaagaacagcgagaccttccccaccatcctggaggaggccaaggagctggtgggcagagccagctag

SEQ ID NO: 10415 - DNA, 3810 bp, Artificial Sequence
  Description of Artificial Sequence: Synthetic coding sequence
atggagccccccggcggcagcctgggccccggcagaggcaccagagacaagaagaagggcagaagccccgacgagctgcccagcgccggcggcgacggcggcaagagcaagaagttcaccctgaagagactgatggccgacgagctggagagattcaccagcatgagaatcaagaaggagaaggagaagcccaacagcgcccacagaaacagcagcgccagctacggcgacgaccccaccgcccagagcctgcaggacgtgagcgacgagcaggtgctggtgctgttcgagcagatgctgctggacatgaacctgaacgaggagaagcagcagcccctgagagagaaggacatcatcatcaagagagagatggtgagccagtacctgtacaccagcaaggccggcatgagccagaaggagagcagcaagagcgccatgatgtacatccaggagctgagaagcggcctgagagacatgcccctgctgagctgcctggagagcctgagagtgagcctgaacaacaaccccgtgagctgggtgcagaccttcggcgccgagggcctggccagcctgctggacatcctgaagagactgcacgacgagaaggaggagaccgccggcagctacgacagcagaaacaagcacgagatcatcagatgcctgaaggccttcatgaacaacaagttcggcatcaagaccatgctggagaccgaggagggcatcctgctgctggtgagagccatggaccccgccgtgcccaacatgatgatcgacgccgccaagctgctgagcgccctgtgcatcctgccccagcccgaggacatgaacgagagagtgctggaggccatgaccgagagagccgagatggacgaggtggagagattccagcccctgctggacggcctgaagagcggcaccaccatcgccctgaaggtgggctgcctgcagctgatcaacgccctgatcacccccgccgaggagctggacttcagagtgcacatcagaagcgagctgatgagactgggcctgcaccaggtgctgcaggacctgagagagatcgagaacgaggacatgagagtgcagctgaacgtgttcgacgagcagggcgaggaggacagctacgacctgaagggcagactggacgacatcagaatggagatggacgacttcaacgaggtgttccagatcctgctgaacaccgtgaaggacagcaaggccgagccccacttcctgagcatcctgcagcacctgctgctggtgagaaacgactacgaggccagaccccagtactacaagctgatcgaggagtgcatcagccagatcgtgctgcacaagaacggcgccgaccccgacttcaagtgcagacacctgcagatcgagatcgagggcctgatcgaccagatgatcgacaagaccaaggtggagaagagcgaggccaaggccgccgagctggagaagaagctggacagcgagctgaccgccagacacgagctgcaggtggagatgaagaagatggagagcgacttcgagcagaagctgcaggacctgcagggcgagaaggacgccctgcacagcgagaagcagcagatcgccaccgagaagcaggacctggaggccgaggtgagccagctgaccggcgaggtggccaagctgaccaaggagctggaggacgccaagaaggagatggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcgtgtgcatcagcagcccccccagcctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagaccaagaaggaccaggagggcggcgaggagaagaagagcgtgcagaagaagaaggtgaaggagctgaaggtgctggacagcaagaccgcccagaacctgagcatcttcctgggcagcttcagaatgccctaccaggagatcaagaacgtgatcctggaggtgaacgaggccgtgctgaccgagagcatgatccagaacctgatcaagcagatgcccgagcccgagcagctgaagatgctgagcgagctgaaggacgagtacgacgacctggccgagagcgagcagttcggcgtggtgatgggcaccgtgcccagactgagacccagactgaacgccatcctgttcaagctgcagttcagcgagcaggtggagaacatcaagcccgagatcgtgagcgtgaccgccgcctgcgaggagctgagaaagagcgagagcttcagcaacctgctggagatcaccctgctggtgggcaactacatgaacgccggcagcagaaacgccggcgccttcggcttcaacatcagcttcctgtgcaagctgagagacaccaagagcaccgaccagaagatgaccctgctgcacttcctggccgagctgtgcgagaacgactaccccgacgtgctgaagttccccgacgagctggcccacgtggagaaggccagcagagtgagcgccgagaacctgcagaagaacctggaccagatgaagaagcagatcagcgacgtggagagagacgtgcagaacttccccgccgccaccgacgagaaggacaagttcgtggagaagatgaccagcttcgtgaaggacgcccaggagcagtacaacaagctgagaatgatgcacagcaacatggagaccctgtacaaggagctgggcgagtacttcctgttcgaccccaagaagctgagcgtggaggagttcttcatggacctgcacaacttcagaaacatgttcctgcaggccgtgaaggagaaccagaagagaagagagaccgaggagaagatgagaagagccaagctggccaaggagaaggccgagaaggagagactggagaagcagcagaagagagagcagctgatcgacatgaacgccgagggcgacgagaccggcgtgatggacagcctgctggaggccctgcagagcggcgccgccttcagaagaaagagaggccccagacaggccaacagaaaggccggctgcgccgtgaccagcctgctggccagcgagctgaccaaggacgacgccatggccgccgtgcccgccaaggtgagcaagaacagcgagaccttccccaccatcctggaggaggccaaggagctggtgggcagagccagctag

SEQ ID NO: 10416 - DNA, 3792 bp, Artificial Sequence
  Description of Artificial Sequence: Synthetic coding sequence
atggagccccccggcggcagcctgggccccggcagaggcaccagagacaagaagaagggcagaagccccgacgagctgcccagcgccggcggcgacggcggcaagagcaagaagttcctggagagattcaccagcatgagaatcaagaaggagaaggagaagcccaacagcgcccacagaaacagcagcgccagctacggcgacgaccccaccgcccagagcctgcaggacgtgagcgacgagcaggtgctggtgctgttcgagcagatgctgctggacatgaacctgaacgaggagaagcagcagcccctgagagagaaggacatcatcatcaagagagagatggtgagccagtacctgtacaccagcaaggccggcatgagccagaaggagagcagcaagagcgccatgatgtacatccaggagctgagaagcggcctgagagacatgcccctgctgagctgcctggagagcctgagagtgagcctgaacaacaaccccgtgagctgggtgcagaccttcggcgccgagggcctggccagcctgctggacatcctgaagagactgcacgacgagaaggaggagaccgccggcagctacgacagcagaaacaagcacgagatcatcagatgcctgaaggccttcatgaacaacaagttcggcatcaagaccatgctggagaccgaggagggcatcctgctgctggtgagagccatggaccccgccgtgcccaacatgatgatcgacgccgccaagctgctgagcgccctgtgcatcctgccccagcccgaggacatgaacgagagagtgctggaggccatgaccgagagagccgagatggacgaggtggagagattccagcccctgctggacggcctgaagagcggcaccaccatcgccctgaaggtgggctgcctgcagctgatcaacgccctgatcacccccgccgaggagctggacttcagagtgcacatcagaagcgagctgatgagactgggcctgcaccaggtgctgcaggacctgagagagatcgagaacgaggacatgagagtgcagctgaacgtgttcgacgagcagggcgaggaggacagctacgacctgaagggcagactggacgacatcagaatggagatggacgacttcaacgaggtgttccagatcctgctgaacaccgtgaaggacagcaaggccgagccccacttcctgagcatcctgcagcacctgctgctggtgagaaacgactacgaggccagaccccagtactacaagctgatcgaggagtgcatcagccagatcgtgctgcacaagaacggcgccgaccccgacttcaagtgcagacacctgcagatcgagatcgagggcctgatcgaccagatgatcgacaagaccaaggtggagaagagcgaggccaaggccgccgagctggagaagaagctggacagcgagctgaccgccagacacgagctgcaggtggagatgaagaagatggagagcgacttcgagcagaagctgcaggacctgcagggcgagaaggacgccctgcacagcgagaagcagcagatcgccaccgagaagcaggacctggaggccgaggtgagccagctgaccggcgaggtggccaagctgaccaaggagctggaggacgccaagaaggagatggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcgtgtgcatcagcagcccccccagcctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagaccagcaaggccaagaaggaccaggagggcggcgaggagaagaagagcgtgcagaagaagaaggtgaaggagctgaaggtgctggacagcaagaccgcccagaacctgagcatcttcctgggcagcttcagaatgccctaccaggagatcaagaacgtgatcctggaggtgaacgaggccgtgctgaccgagagcatgatccagaacctgatcaagcagatgcccgagcccgagcagctgaagatgctgagcgagctgaaggacgagtacgacgacctggccgagagcgagcagttcggcgtggtgatgggcaccgtgcccagactgagacccagactgaacgccatcctgttcaagctgcagttcagcgagcaggtggagaacatcaagcccgagatcgtgagcgtgaccgccgcctgcgaggagctgagaaagagcgagagcttcagcaacctgctggagatcaccctgctggtgggcaactacatgaacgccggcagcagaaacgccggcgccttcggcttcaacatcagcttcctgtgcaagctgagagacaccaagagcaccgaccagaagatgaccctgctgcacttcctggccgagctgtgcgagaacgactaccccgacgtgctgaagttccccgacgagctggcccacgtggagaaggccagcagagtgagcgccgagaacctgcagaagaacctggaccagatgaagaagcagatcagcgacgtggagagagacgtgcagaacttccccgccgccaccgacgagaaggacaagttcgtggagaagatgaccagcttcgtgaaggacgcccaggagcagtacaacaagctgagaatgatgcacagcaacatggagaccctgtacaaggagctgggcgagtacttcctgttcgaccccaagaagctgagcgtggaggagttcttcatggacctgcacaacttcagaaacatgttcctgcaggccgtgaaggagaaccagaagagaagagagaccgaggagaagatgagaagagccaagctggccaaggagaaggccgagaaggagagactggagaagcagcagaagagagagcagctgatcgacatgaacgccgagggcgacgagaccggcgtgatggacagcctgctggaggccctgcagagcggcgccgccttcagaagaaagagaggccccagacaggccaacagaaaggccggctgcgccgtgaccagcctgctggccagcgagctgaccaaggacgacgccatggccgccgtgcccgccaaggtgagcaagaacagcgagaccttccccaccatcctggaggaggccaaggagctggtgggcagagccagctag

SEQ ID NO: 10417 - DNA, 3819 bp, Artificial Sequence
  Description of Artificial Sequence: Synthetic coding sequence
atggagccccccggcggcagcctgggccccggcagaggcaccagagacaagaagaagggcagaagccccgacgagctgcccagcgccggcggcgacggcggcaagagcaagaagttcaccctgaagagactgatggccgacgagctggagagattcaccagcatgagaatcaagaaggagaaggagaagcccaacagcgcccacagaaacagcagcgccagctacggcgacgaccccaccgcccagagcctgcaggacgtgagcgacgagcaggtgctggtgctgttcgagcagatgctgctggacatgaacctgaacgaggagaagcagcagcccctgagagagaaggacatcatcatcaagagagagatggtgagccagtacctgtacaccagcaaggccggcatgagccagaaggagagcagcaagagcgccatgatgtacatccaggagctgagaagcggcctgagagacatgcccctgctgagctgcctggagagcctgagagtgagcctgaacaacaaccccgtgagctgggtgcagaccttcggcgccgagggcctggccagcctgctggacatcctgaagagactgcacgacgagaaggaggagaccgccggcagctacgacagcagaaacaagcacgagatcatcagatgcctgaaggccttcatgaacaacaagttcggcatcaagaccatgctggagaccgaggagggcatcctgctgctggtgagagccatggaccccgccgtgcccaacatgatgatcgacgccgccaagctgctgagcgccctgtgcatcctgccccagcccgaggacatgaacgagagagtgctggaggccatgaccgagagagccgagatggacgaggtggagagattccagcccctgctggacggcctgaagagcggcaccaccatcgccctgaaggtgggctgcctgcagctgatcaacgccctgatcacccccgccgaggagctggacttcagagtgcacatcagaagcgagctgatgagactgggcctgcaccaggtgctgcaggacctgagagagatcgagaacgaggacatgagagtgcagctgaacgtgttcgacgagcagggcgaggaggacagctacgacctgaagggcagactggacgacatcagaatggagatggacgacttcaacgaggtgttccagatcctgctgaacaccgtgaaggacagcaaggccgagccccacttcctgagcatcctgcagcacctgctgctggtgagaaacgactacgaggccagaccccagtactacaagctgatcgaggagtgcatcagccagatcgtgctgcacaagaacggcgccgaccccgacttcaagtgcagacacctgcagatcgagatcgagggcctgatcgaccagatgatcgacaagaccaaggtggagaagagcgaggccaaggccgccgagctggagaagaagctggacagcgagctgaccgccagacacgagctgcaggtggagatgaagaagatggagagcgacttcgagcagaagctgcaggacctgcagggcgagaaggacgccctgcacagcgagaagcagcagatcgccaccgagaagcaggacctggaggccgaggtgagccagctgaccggcgaggtggccaagctgaccaaggagctggaggacgccaagaaggagatggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcgtgtgcatcagcagcccccccagcctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagaccagcaaggccaagaaggaccaggagggcggcgaggagaagaagagcgtgcagaagaagaaggtgaaggagctgaaggtgctggacagcaagaccgcccagaacctgagcatcttcctgggcagcttcagaatgccctaccaggagatcaagaacgtgatcctggaggtgaacgaggccgtgctgaccgagagcatgatccagaacctgatcaagcagatgcccgagcccgagcagctgaagatgctgagcgagctgaaggacgagtacgacgacctggccgagagcgagcagttcggcgtggtgatgggcaccgtgcccagactgagacccagactgaacgccatcctgttcaagctgcagttcagcgagcaggtggagaacatcaagcccgagatcgtgagcgtgaccgccgcctgcgaggagctgagaaagagcgagagcttcagcaacctgctggagatcaccctgctggtgggcaactacatgaacgccggcagcagaaacgccggcgccttcggcttcaacatcagcttcctgtgcaagctgagagacaccaagagcaccgaccagaagatgaccctgctgcacttcctggccgagctgtgcgagaacgactaccccgacgtgctgaagttccccgacgagctggcccacgtggagaaggccagcagagtgagcgccgagaacctgcagaagaacctggaccagatgaagaagcagatcagcgacgtggagagagacgtgcagaacttccccgccgccaccgacgagaaggacaagttcgtggagaagatgaccagcttcgtgaaggacgcccaggagcagtacaacaagctgagaatgatgcacagcaacatggagaccctgtacaaggagctgggcgagtacttcctgttcgaccccaagaagctgagcgtggaggagttcttcatggacctgcacaacttcagaaacatgttcctgcaggccgtgaaggagaaccagaagagaagagagaccgaggagaagatgagaagagccaagctggccaaggagaaggccgagaaggagagactggagaagcagcagaagagagagcagctgatcgacatgaacgccgagggcgacgagaccggcgtgatggacagcctgctggaggccctgcagagcggcgccgccttcagaagaaagagaggccccagacaggccaacagaaaggccggctgcgccgtgaccagcctgctggccagcgagctgaccaaggacgacgccatggccgccgtgcccgccaaggtgagcaagaacagcgagaccttccccaccatcctggaggaggccaaggagctggtgggcagagccagctag

SEQ ID NO: 10418 - DNA, 3747 bp, Artificial Sequence
  Description of Artificial Sequence: Synthetic coding sequence
atggagccccccggcggcagcctgggccccggcagaggcaccagagacaagaagaagggcagaagccccgacgagctgcccagcgccggcggcgacggcggcaagagcaagaagttcctggagagattcaccagcatgagaatcaagaaggagaaggagaagcccaacagcgcccacagaaacagcagcgccagctacggcgacgaccccaccgcccagagcctgcaggacgtgagcgacgagcaggtgctggtgctgttcgagcagatgctgctggacatgaacctgaacgaggagaagcagcagcccctgagagagaaggacatcatcatcaagagagagatggtgagccagtacctgtacaccagcaaggccggcatgagccagaaggagagcagcaagagcgccatgatgtacatccaggagctgagaagcggcctgagagacatgcccctgctgagctgcctggagagcctgagagtgagcctgaacaacaaccccgtgagctgggtgcagaccttcggcgccgagggcctggccagcctgctggacatcctgaagagactgcacgacgagaaggaggagaccgccggcagctacgacagcagaaacaagcacgagatcatcagatgcctgaaggccttcatgaacaacaagttcggcatcaagaccatgctggagaccgaggagggcatcctgctgctggtgagagccatggaccccgccgtgcccaacatgatgatcgacgccgccaagctgctgagcgccctgtgcatcctgccccagcccgaggacatgaacgagagagtgctggaggccatgaccgagagagccgagatggacgaggtggagagattccagcccctgctggacggcctgaagagcggcaccaccatcgccctgaaggtgggctgcctgcagctgatcaacgccctgatcacccccgccgaggagctggacttcagagtgcacatcagaagcgagctgatgagactgggcctgcaccaggtgctgcaggacctgagagagatcgagaacgaggacatgagagtgcagctgaacgtgttcgacgagcagggcgaggaggacagctacgacctgaagggcagactggacgacatcagaatggagatggacgacttcaacgaggtgttccagatcctgctgaacaccgtgaaggacagcaaggccgagccccacttcctgagcatcctgcagcacctgctgctggtgagaaacgactacgaggccagaccccagtactacaagctgatcgaggagtgcatcagccagatcgtgctgcacaagaacggcgccgaccccgacttcaagtgcagacacctgcagatcgagatcgagggcctgatcgaccagatgatcgacaagaccaaggtggagaagagcgaggccaaggccgccgagctggagaagaagctggacagcgagctgaccgccagacacgagctgcaggtggagatgaagaagatggagagcgacttcgagcagaagctgcaggacctgcagggcgagaaggacgccctgcacagcgagaagcagcagatcgccaccgagaagcaggacctggaggccgaggtgagccagctgaccggcgaggtggccaagctgaccaaggagctggaggacgccaagaaggagatggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagaccaagaaggaccaggagggcggcgaggagaagaagagcgtgcagaagaagaaggtgaaggagctgaaggtgctggacagcaagaccgcccagaacctgagcatcttcctgggcagcttcagaatgccctaccaggagatcaagaacgtgatcctggaggtgaacgaggccgtgctgaccgagagcatgatccagaacctgatcaagcagatgcccgagcccgagcagctgaagatgctgagcgagctgaaggacgagtacgacgacctggccgagagcgagcagttcggcgtggtgatgggcaccgtgcccagactgagacccagactgaacgccatcctgttcaagctgcagttcagcgagcaggtggagaacatcaagcccgagatcgtgagcgtgaccgccgcctgcgaggagctgagaaagagcgagagcttcagcaacctgctggagatcaccctgctggtgggcaactacatgaacgccggcagcagaaacgccggcgccttcggcttcaacatcagcttcctgtgcaagctgagagacaccaagagcaccgaccagaagatgaccctgctgcacttcctggccgagctgtgcgagaacgactaccccgacgtgctgaagttccccgacgagctggcccacgtggagaaggccagcagagtgagcgccgagaacctgcagaagaacctggaccagatgaagaagcagatcagcgacgtggagagagacgtgcagaacttccccgccgccaccgacgagaaggacaagttcgtggagaagatgaccatcttcgtgaaggacgcccaggagcagtacaacaagctgagaatgatgcacagcaacatggagaccctgtacaaggagctgggcgagtacttcctgttcgaccccaagaagctgagcgtggaggagttcttcatggacctgcacaacttcagaaacatgttcctgcaggccgtgaaggagaaccagaagagaagagagaccgaggagaagatgagaagagccaagctggccaaggagaaggccgagaaggagagactggagaagcagcagaagagagagcagctgatcgacatgaacgccgagggcgacgagaccggcgtgatggacagcctgctggaggccctgcagagcggcgccgccttcagaagaaagagaggccccagacaggccaacagaaaggccggctgcgccgtgaccagcctgctggccagcgagctgaccaaggacgacgccatggccgccgtgcccgccaaggtgagcaagaacagcgagaccttccccaccatcctggaggaggccaaggagctggtgggcagagccagctag

SEQ ID NO: 10419 - DNA, 3795 bp, Artificial Sequence
  Description of Artificial Sequence: Synthetic coding sequence
atggagccccccggcggcagcctgggccccggcagaggcaccagagacaagaagaagggcagaagccccgacgagctgcccagcgccggcggcgacggcggcaagagcaagaagttcctggagagattcaccagcatgagaatcaagaaggagaaggagaagcccaacagcgcccacagaaacagcagcgccagctacggcgacgaccccaccgcccagagcctgcaggacgtgagcgacgagcaggtgctggtgctgttcgagcagatgctgctggacatgaacctgaacgaggagaagcagcagcccctgagagagaaggacatcatcatcaagagagagatggtgagccagtacctgtacaccagcaaggccggcatgagccagaaggagagcagcaagagcgccatgatgtacatccaggagctgagaagcggcctgagagacatgcccctgctgagctgcctggagagcctgagagtgagcctgaacaacaaccccgtgagctgggtgcagaccttcggcgccgagggcctggccagcctgctggacatcctgaagagactgcacgacgagaaggaggagaccgccggcagctacgacagcagaaacaagcacgagatcatcagatgcctgaaggccttcatgaacaacaagttcggcatcaagaccatgctggagaccgaggagggcatcctgctgctggtgagagccatggaccccgccgtgcccaacatgatgatcgacgccgccaagctgctgagcgccctgtgcatcctgccccagcccgaggacatgaacgagagagtgctggaggccatgaccgagagagccgagatggacgaggtggagagattccagcccctgctggacggcctgaagagcggcaccaccatcgccctgaaggtgggctgcctgcagctgatcaacgccctgatcacccccgccgaggagctggacttcagagtgcacatcagaagcgagctgatgagactgggcctgcaccaggtgctgcaggacctgagagagatcgagaacgaggacatgagagtgcagctgaacgtgttcgacgagcagggcgaggaggacagctacgacctgaagggcagactggacgacatcagaatggagatggacgacttcaacgaggtgttccagatcctgctgaacaccgtgaaggacagcaaggccgagccccacttcctgagcatcctgcagcacctgctgctggtgagaaacgactacgaggccagaccccagtactacaagctgatcgaggagtgcatcagccagatcgtgctgcacaagaacggcgccgaccccgacttcaagtgcagacacctgcagatcgagatcgagggcctgatcgaccagatgatcgacaagaccaaggtggagaagagcgaggccaaggccgccgagctggagaagaagctggacagcgagctgaccgccagacacgagctgcaggtggagatgaagaagatggagagcgacttcgagcagaagctgcaggacctgcagggcgagaaggacgccctgcacagcgagaagcagcagatcgccaccgagaagcaggacctggaggccgaggtgagccagctgaccggcgaggtggccaagctgaccaaggagctggaggacgccaagaaggagatggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcgtgtgcatcagcagcccccccagcctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagagaaccaagaaggccaagaaggaccaggagggcggcgaggagaagaagagcgtgcagaagaagaaggtgaaggagctgaaggtgctggacagcaagaccgcccagaacctgagcatcttcctgggcagcttcagaatgccctaccaggagatcaagaacgtgatcctggaggtgaacgaggccgtgctgaccgagagcatgatccagaacctgatcaagcagatgcccgagcccgagcagctgaagatgctgagcgagctgaaggacgagtacgacgacctggccgagagcgagcagttcggcgtggtgatgggcaccgtgcccagactgagacccagactgaacgccatcctgttcaagctgcagttcagcgagcaggtggagaacatcaagcccgagatcgtgagcgtgaccgccgcctgcgaggagctgagaaagagcgagagcttcagcaacctgctggagatcaccctgctggtgggcaactacatgaacgccggcagcagaaacgccggcgccttcggcttcaacatcagcttcctgtgcaagctgagagacaccaagagcaccgaccagaagatgaccctgctgcacttcctggccgagctgtgcgagaacgactaccccgacgtgctgaagttccccgacgagctggcccacgtggagaaggccagcagagtgagcgccgagaacctgcagaagaacctggaccagatgaagaagcagatcagcgacgtggagagagacgtgcagaacttccccgccgccaccgacgagaaggacaagttcgtggagaagatgaccatcttcgtgaaggacgcccaggagcagtacaacaagctgagaatgatgcacagcaacatggagaccctgtacaaggagctgggcgagtacttcctgttcgaccccaagaagctgagcgtggaggagttcttcatggacctgcacaacttcagaaacatgttcctgcaggccgtgaaggagaaccagaagagaagagagaccgaggagaagatgagaagagccaagctggccaaggagaaggccgagaaggagagactggagaagcagcagaagagagagcagctgatcgacatgaacgccgagggcgacgagaccggcgtgatggacagcctgctggaggccctgcagagcggcgccgccttcagaagaaagagaggccccagacaggccaacagaaaggccggctgcgccgtgaccagcctgctggccagcgagctgaccaaggacgacgccatggccgccgtgcccgccaaggtgagcaagaacagcgagaccttccccaccatcctggaggaggccaaggagctggtgggcagagccagctag

SEQ ID NO: 10420 - DNA, 855 bp, Artificial Sequence
  Description of Artificial Sequence: Synthetic coding sequence
atggccagcctgagcgccgccgccatcaccgtgccccccagcgtgcccagcagagcccccgtgccccccgccccccccctgcccggcgacagcggcaccatcatcccccccccccccgcccccggcgacagcaccacccccccccccccccccccccccccccccccccccccccccctgcccggcggcgtgtgcatcagcagcccccccagcctgcccggcggcaccgccatcagcccccccccccccctgagcggcgacgccaccatccccccccccccccccctgcccgagggcgtgggcatccccagccccagcagcctgcccggcggcaccgccatccccccccccccccccctgcccggcagcgccagaatcccccccccccccccccccctgcccggcagcgccggcatcccccccccccccccccccctgcccggcgaggccggcatgccccccccccccccccccctgcccggcggccccggcatccccccccccccccccttccccggcggccccggcatccccccccccccccccggcatgggcatgcccccccccccccccttcggcttcggcgtgcccgccgcccccgtgctgcccttcggcctgacccccaagaagctgtacaagcccgaggtgcagctgagaagacccaactggagcaagctggtggccgaggacctgagccaggactgcttctggaccaaggtgaaggaggacagattcgagaacaacgagctgttcgccaagctgaccctgaccttcagcgcccagaccaagagcgagaaggccaagaaggaccaggagggcggcgaggagaagaagagcgtgcagaagaagaagtag

SEQ ID NO: 10421 - DNA, 513 bp, Artificial Sequence
  Description of Artificial Sequence: Synthetic coding sequence
atgtactgccagttcgccagcttccagtacacctgccagccctgcagaggccagagaatgctgtgcaccagagacagcgagtgctgcggcgaccagctgtgcgtgtggggccactgcaccaagatggccaccagaggcagcaacggcaccatctgcgacaaccagagagactgccagcccggcctgtgctgcgccttccagagaggcctgctgttccccgtgtgcacccccctgcccgtggagggcgagctgtgccacgaccccgccagcagactgctggacctgatcacctgggagctggagcccgacggcgccctggacagatgcccctgcgccagcggcctgctgtgccagccccacagccacagcctggtgtacgtgtgcaagcccaccttcgtgggcagcagagaccaggacggcgagatcctgctgcccagagaggtgcccgacgagtacctggccgccagctggagaagatgcgccagaagctggagaacctggagaggcgcctag

SEQ ID NO: 10422 - DNA, 1053 bp, Artificial Sequence
  Description of Artificial Sequence: Synthetic coding sequence
atgcagagactgggcgccaccctgctgtgcctgctgctggccgccgccgtgcccaccgcccccgcccccgcccccaccgccaccagcgcccccgtgaagcccggccccgccctgagctacccccaggaggaggccaccctgaacgagatgttcagagaggtggaggagctgatggaggacacccagcacaagctgagaagcgccgtggaggagatggaggccgaggaggccgccgccaaggccagcagcgaggtgaacctggccaacctgccccccagctaccacaacgagaccaacaccgacaccaaggtgggcaacaacaccatccacgtgcacagagagatccacaagatcaccaacaaccagaccggccagatggtgttcagcgagaccgtgatcaccagcgtgggcgacgaggagggcagaagaagccacgagtgcatcatcgacgaggactgcggccccagcatgtactgccagttcgccagcttccagtacacctgccagccctgcagaggccagagaatgctgtgcaccagagacagcgagtgctgcggcgaccagctgtgcgtgtggggccactgcaccaagatggccaccagaggcagcaacggcaccatctgcgacaaccagagagactgccagcccggcctgtgctgcgccttccagagaggcctgctgttccccgtgtgcacccccctgcccgtggagggcgagctgtgccacgaccccgccagcagactgctggacctgatcacctgggagctggagcccgacggcgccctggacagatgcccctgcgccagcggcctgctgtgccagccccacagccacagcctggtgtacgtgtgcaagcccaccttcgtgggcagcagagaccaggacggcgagatcctgctgcccagagaggtgcccgacgagtacgaggtgggcagcttcatggaggaggtgagacaggagctggaggacctggagagaagcctgaccgaggagatggccctgagagagcccgccgccgccgccgccgccctgctgggcggcgaggagatctag

SEQ ID NO: 10423 - DNA, 882 bp, Artificial Sequence
  Description of Artificial Sequence: Synthetic coding sequence
atggaggacacccagcacaagctgagaagcgccgtggaggagatggaggccgaggaggccgccgccaaggccagcagcgaggtgaacctggccaacctgccccccagctaccacaacgagaccaacaccgacaccaaggtgggcaacaacaccatccacgtgcacagagagatccacaagatcaccaacaaccagaccggccagatggtgttcagcgagaccgtgatcaccagcgtgggcgacgaggagggcagaagaagccacgagtgcatcatcgacgaggactgcggccccagcatgtactgccagttcgccagcttccagtacacctgccagccctgcagaggccagagaatgctgtgcaccagagacagcgagtgctgcggcgaccagctgtgcgtgtggggccactgcaccaagatggccaccagaggcagcaacggcaccatctgcgacaaccagagagactgccagcccggcctgtgctgcgccttccagagaggcctgctgttccccgtgtgcacccccctgcccgtggagggcgagctgtgccacgaccccgccagcagactgctggacctgatcacctgggagctggagcccgacggcgccctggacagatgcccctgcgccagcggcctgctgtgccagccccacagccacagcctggtgtacgtgtgcaagcccaccttcgtgggcagcagagaccaggacggcgagatcctgctgcccagagaggtgcccgacgagtacgaggtgggcagcttcatggaggaggtgagacaggagctggaggacctggagagaagcctgaccgaggagatggccctgagagagcccgccgccgccgccgccgccctgctgggcggcgaggagatctag

SEQ ID NO: 10424 - DNA, 1053 bp, Artificial Sequence; identical to SEQ ID NO: 10422
  Description of Artificial Sequence: Synthetic coding sequence

SEQ ID NO: 10425 - DNA, 969 bp, Artificial Sequence
  Description of Artificial Sequence: Synthetic coding sequence
atgcagagactgggcgccaccctgctgtgcctgctgctggccgccgccgtgcccaccgcccccgcccccgcccccaccgccaccagcgcccccgtgaagcccggccccgccctgagctacccccaggaggaggccaccctgaacgagatgttcagagaggtggaggagctgatggaggacacccagcacaagctgagaagcgccgtggaggagatggaggccgaggaggccgccgccaaggccagcagcgaggtgaacctggccaacctgccccccagctaccacaacgagaccaacaccgacaccaaggtgggcaacaacaccatccacgtgcacagagagatccacaaggagtgcatcatcgacgaggactgcggccccagcatgtactgccagttcgccagcttccagtacacctgccagccctgcagaggccagagaatgctgtgcaccagagacagcgagtgctgcggcgaccagctgtgcgtgtggggccactgcaccaagatggccaccagaggcagcaacggcaccatctgcgacaaccagagagactgccagcccggcctgtgctgcgccttccagagaggcctgctgttccccgtgtgcacccccctgcccgtggagggcgagctgtgccacgaccccgccagcagactgctggacctgatcacctgggagctggagcccgacggcgccctggacagatgcccctgcgccagcggcctgctgtgccagccccacagccacagcctggtgtacgtgtgcaagcccaccttcgtgggcagcagagaccaggacggcgagatcctgctgcccagagaggtgcccgacgagtacgaggtgggcagcttcatggaggaggtgagacaggagctggaggacctggagagaagcctgaccgaggagatggccctgagagagcccgccgccgccgccgccgccctgctgggcggcgaggagatctag

SEQ ID NO: 10426 - DNA, 708 bp, Artificial Sequence
  Description of Artificial Sequence: Synthetic coding sequence
atgcagagactgggcgccaccctgctgtgcctgctgctggccgccgccgtgcccaccgcccccgcccccgcccccaccgccaccagcgcccccgtgaagcccggccccgccctgagctacccccaggaggaggccaccctgaacgagatgttcagagaggtggaggagctgatggaggacacccagcacaagctgagaagcgccgtggaggagatggaggccgaggaggccgccgccaaggccagcagcgaggtgaacctggccaacctgccccccagctaccacaacgagaccaacaccgacaccaaggtgggcaacaacaccatccacgtgcacagagagatccacaagatcaccaacaaccagaccggccagatggtgttcagcgagaccgtgatcaccagcgtgggcgacgaggagggcagaagaagccacgagtgcatcatcgacgaggactgcggccccagcatgtactgccagttcgccagcttccagtacacctgccagccctgcagaggccagagaatgctgtgcaccagagacagcgagtgctgcggcgaccagctgtgcgtgtggggccactgcaccaagatggccaccagaggcagcaacggcaccatctgcgacaaccagagagactgccagcccggcctgtgctgcgccttccagagaggcctgctgttccccgtgtgcacccccctgccctag

SEQ ID NO: 10427 - DNA, 2301 bp, Artificial Sequence
  Description of Artificial Sequence: Synthetic coding sequence
atgaagaccccctggaaggtgctgctgggcctgctgggcgccgccgccctggtgaccatcatcaccgtgcccgtggtgctgctgaacaagggcaccgacgacgccaccgccgacagcagaaagacctacaccctgaccgactacctgaagaacacctacagactgaagctgtacagcctgagatggatcagcgaccacgagtacctgtacaagcaggagaacaacatcctggtgttcaacgccgagtacggcaacagcagcgtgttcctggagaacagcaccttcgacgagttcggccacagcatcaacgactacagcatcagccccgacggccagttcatcctgctggagtacaactacgtgaagcagtggagacacagctacaccgccagctacgacatctacgacctgaacaagagacagctgatcaccgaggagagaatccccaacaacacccagtgggtgacctggagccccgtgggccacaagctggcctacgtgtggaacaacgacatctacgtgaagatcgagcccaacctgcccagctacagaatcacctggaccggcaaggaggacatcatctacaacggcatcaccgactgggtgtacgaggaggaggtgttcagcgcctacagcgccctgtggtggagccccaacggcaccttcctggcctacgcccagttcaacgacaccgaggtgcccctgatcgagtacagcttctacagcgacgagagcctgcagtaccccaagaccgtgagagtgccctaccccaaggccggcgccgtgaaccccaccgtgaagttcttcgtggtgaacaccgacagcctgagcagcgtgaccaacgccaccagcatccagatcaccgcccccgccagcatgctgatcggcgaccactacctgtgcgacgtgacctgggccacccaggagagaatcagcctgcagtggctgagaagaatccagaactacagcgtgatggacatctgcgactacgacgagagcagcggcagatggaactgcctggtggccagacagcacatcgagatgagcaccaccggctgggtgggcagattcagacccagcgagccccacttcaccctggacggcaacagcttctacaagatcatcagcaacgaggagggctacagacacatctgctacttccagatcgacaagaaggactgcaccttcatcaccaagggcacctgggaggtgatcggcatcgaggccctgaccagcgactacctgtactacatcagcaacgagtacaagggcatgcccggcggcagaaacctgtacaagatccagctgagcgactacaccaaggtgacctgcctgagctgcgagctgaaccccgagagatgccagtactacagcgtgagcttcagcaaggaggccaagtactaccagctgagatgcagcggccccggcctgcccctgtacaccctgcacagcagcgtgaacgacaagggcctgagagtgctggaggacaacagcgccctggacaagatgctgcagaacgtgcagatgcccagcaagaagctggacttcatcatcctgaacgagaccaagttctggtaccagatgatcctgcccccccacttcgacaagagcaagaagtaccccctgctgctggacgtgtacgccggcccctgcagccagaaggccgacaccgtgttcagactgaactgggccacctacctggccagcaccgagaacatcatcgtggccagcttcgacggcagaggcagcggctaccagggcgacaagatcatgcacgccatcaacagaagactgggcaccttcgaggtggaggaccagatcgaggccgccagacagttcagcaagatgggcttcgtggacaacaagagaatcgccatctggggctggagctacggcggctacgtgaccagcatggtgctgggcagcggcagcggcgtgttcaagtgcggcatcgccgtggcccccgtgagcagatgggagtactacgacagcgtgtacaccgagagatacatgggcctgcccacccccgaggacaacctggaccactacagaaacagcaccgtgatgagcagagccgagaacttcaagcaggtggagtacctgctgatccacggcaccgccgacgacaacgtgcacttccagcagagcgcccagatcagcaaggccctggtggacgtgggcgtggacttccaggccatgtggtacaccgacgaggaccacggcatcgccagcagcaccgcccaccagcacatctacacccacatgagccacttcatcaagcagtgcttcagcctgccctag

SEQ ID NO: 10428 - DNA, 645 bp, Artificial Sequence
  Description of Artificial Sequence: Synthetic coding sequence
atgaacgtgttcagaatcctgggcgacctgagccacctgctggccatgatcctgctgctgggcaagatctggagaagcaagtgctgcaagggcatcagcggcaagagccagatcctgttcgccctggtgttcaccaccagatacctggacctgttcaccaacttcatcagcatctacaacaccgtgatgaaggtggtgttcctgctgtgcgcctacgtgaccgtgtacatgatctacggcaagttcagaaagaccttcgacagcgagaacgacaccttcagactggagttcctgctggtgcccgtgatcggcctgagcttcctggagaactacagcttcaccctgctggagatcctgtggaccttcagcatctacctggagagcgtggccatcctgccccagctgttcatgatcagcaagaccggcgaggccgagaccatcaccacccactacctgttcttcctgggcctgtacagagccctgtacctggccaactggatcagaagataccagaccgagaacttctacgaccagatcgccgtggtgagcggcgtggtgcagaccatcttctactgcgacttcttctacctgtacgtgaccaaggtgctgaagggcaagaagctgagcctgcccatgcccatctag

SEQ ID NO: 10429 - DNA, 498 bp, Artificial Sequence
  Description of Artificial Sequence: Synthetic coding sequence
atgaaggaggaccaggtggtggccgaggagcccggcttccaggacgaggaggagagcctgttccaggacatcgacctgctgcagaagcacggcatcaacgtggccgacatcaagaagctgaagagcgtgggcatctgcaccatcaagggcatccagatgaccaccagaagagccctgtgcaacgtgaagggcctgagcgaggccaaggtggacaagatcaaggaggccgccaacaagctgatcgagcccggcttcctgaccgccttcgagtacagcgagaagagaaagatggtgttccacatcaccaccggcagccaggagttcgacaagctgctgggcggcggcatcgagagcatggccatcaccgaggccttcggcgagttcagaaccggcaagacccagctgagccacaccctgtgcgtgaccgcccagctgcccggcgccggcggctaccccggcggcaagatcatcttcatcgacaccgagaacaccctgtag

SEQ ID NO: 10430 - DNA, 420 bp, Artificial Sequence
  Description of Artificial Sequence: Synthetic coding sequence
atgaaggaggaccaggtggtggccgaggagcccggcttccaggacgaggaggagagcctgttccaggacatcgacctgctgcagaagcacggcatcaacgtggccgacatcaagaagctgaagagcgtgggcatctgcaccatcaagggcatccagatgaccaccagaagagccctgtgcaacgtgaagggcctgagcgaggccaaggtggacaagatcaaggaggccgccaacaagctgatcgagcccggcttcctgaccgccttcgagtacagcgagaagagaaagatggtgttccacatcaccaccggcagccaggagttcgacaagctgctgggcggcggcatcgagagcatggccatcaccgaggccttcggcgagttcagaaccggcaagacccagctgagccacaccctgtag

SEQ ID NO: 10431 - DNA, 858 bp, Artificial Sequence
  Description of Artificial Sequence: Synthetic coding sequence
atgaaggaggaccaggtggtggccgaggagcccggcttccaggacgaggaggagagcctgttccaggacatcgacctgctgcagaagcacggcatcaacgtggccgacatcaagaagctgaagagcgtgggcatctgcaccatcaagggcatccagatgaccaccagaagagccctgtgcaacgtgaagggcctgagcgaggccaaggtggacaagatcaaggaggccgccaacaagctgatcgagcccggcttcctgaccgccttcgagtacagcgagaagagaaagatggtgttccacatcaccaccggcagccaggagttcgacaagctgctgggcggcggcatcgagagcatggccatcaccgaggccttcggcgagttcagaaccggcaagacccagctgagccacaccctgtgcggcgagcaccagatggagctgctggactacgtggccgccaagttccacgaggaggccggcatcttcaagctgctgatcatcgacagcatcatggccctgttcagagtggacttcagcggcagaggcgagctggccgagagacagcagaagctggcccagatgctgagcagactgcagaagatcagcgaggagtacaacgtggccgtgttcgtgaccaaccagatgaccgccgaccccggcgccaccatgaccttccaggccgaccccaagaagcccatcggcggccacatcctggcccacgccagcaccaccagaatcagcctgagaaagggcagaggcgagctgagaatcgccaagatctacgacagccccgagatgcccgagaacgaggccaccttcgccatcaccgccggcggcatcggcgacgccaaggagtag

SEQ ID NO: 10432 - DNA, 612 bp, Artificial Sequence
  Description of Artificial Sequence: Synthetic coding sequence
atgaaggaggaccaggtggtggccgaggagcccggcttccaggacgaggaggagagcctgttccaggacatcgacctgctgcagaagcacggcatcaacgtggccgacatcaagaagctgaagagcgtgggcatctgcaccatcaagggcatccagatgaccaccagaagagccctgtgcaacgtgaagggcctgagcgaggccaaggtggacaagatcaaggaggccgccaacaagctgatcgagcccggcttcctgaccgccttcgagtacagcgagaagagaaagatggtgttccacatcaccaccggcagccaggagttcgacaagctgctgggcggcggcatcgagagcatggccatcaccgaggccttcggcgagttcagaaccggcaagacccagctgagccacaccctgtgcggcgagcaccagatggagctgctggactacgtggccgccaagttccacgaggaggccggcatcttcaagctgctgatcatcgacagcatcatggccctgttcagagtggacttcagcggcagaggcgagctggccgagagacagcagaagctggcccagatgctgagcagactgcagaagatcagcgagtag

SEQ ID NO: 10433 - DNA, 1599 bp, Artificial Sequence
  Description of Artificial Sequence: Synthetic coding sequence
atgaacggcgtgctgatcccccacacccccatcgccgtggacttctggagcctgagaagagccggcaccgccagactgttcttcctgagccacatgcacagcgaccacaccgtgggcctgagcagcacctgggccagacccctgtactgcagccccatcaccgcccacctgctgcacagacacctgcaggtgagcaagcagtggatccaggccctggaggtgggcgagagccacgtgctgcccctggacgagatcggccaggagaccatgaccgtgaccctgctggacgccaaccactgccccggcagcgtgatgttcctgttcgagggctacttcggcaccatcctgtacaccggcgacttcagatacacccccagcatgctgaaggagcccgccctgaccctgggcaagcagatccacaccctgtacctggacaacaccaactgcaaccccgccctggtgctgcccagcagacaggaggccgcccaccagatcgtgcagctgatcagaaagcacccccagcacaacatcaagatcggcctgtacagcctgggcaaggagagcctgctggagcagctggccctggagttccagacctgggtggtgctgagccccagaagactggagctggtgcagctgctgggcctggccgacgtgttcaccgtggaggagaaggccggcagaatccacgccgtggaccacatggagatctgccacagcaacatgctgagatggaaccagacccaccccaccatcgccatcctgcccaccagcagaaagatccacagcagccaccccgacatccacgtgatcccctacagcgaccacagcagctacagcgagctgagagccttcgtggccgccctgaagccctgccaggtggtgcccatcgtgagcagaagaccctgcggcggcttccaggacagcctgagccccagaatcagcgtgcccctgatccccgacagcgtgcagcagtacatgagcagcagcagcagaaagcccagcctgctgtggctgctggagagaagactgaagagacccagaacccagggcgtggtgttcgagagccccgaggagagcgccgaccagagccaggccgacagagacagcaagaaggccaagaaggagaagctgagcccctggcccgccgacctggagaagcagcccagccaccaccccctgagaatcaagaagcagctgttccccgacctgtacagcaaggagtggaacaaggccgtgcccttctgcgagagccagaagagagtgaccatgctgaccgcccccctgggcttcagcgtgcacctgagaagcaccgacgaggagttcatcagccagaagaccagagaggagatcggcctgggcagccccctggtgcccatgggcgacgacgacggcggccccgaggccaccggcaaccagagcgcctggatgggccacggcagccccctgagccacagcagcaagggcacccccctgctggccaccgagttcagaggcctggccctgaagtacctgctgacccccgtgaacttcttccaggccggctacagcagcagaagattcgaccagcaggtggagaagtaccacaagccctgctag

SEQ ID NO: 10434 - DNA, 1734 bp, Artificial Sequence
  Description of Artificial Sequence: Synthetic coding sequence
atgaagcaccaggagagattcctgttccagggcaacaacggcaccgtgctgtacaccggcgacttcagactggcccagggcgaggccgccagaatggagctgctgcacagcggcggcagagtgaaggacatccagagcgtgtacctggacaccaccttctgcgaccccagattctaccagatccccagcagagaggagtgcctgagcggcgtgctggagctggtgagaagctggatcaccagaagcccctaccacgtggtgtggctgaactgcaaggccgcctacggctacgagtacctgttcaccaacctgagcgaggagctgggcgtgcaggtgcacgtgaacaagctggacatgttcagaaacatgcccgagatcctgcaccacctgaccaccgacagaaacacccagatccacgcctgcagacaccccaaggccgaggagtacttccagtggagcaagctgccctgcggcatcaccagcagaaacagaatccccctgcacatcatcagcatcaagcccagcaccatgtggttcggcgagagaagcagaaagaccaacgtgatcgtgagaaccggcgagagcagctacagagcctgcttcagcttccacagcagctacagcgagatcaaggacttcctgagctacctgtgccccgtgaacgcctaccccaacgtgatccccgtgggcaccaccatggacaaggtggtggagatcctgaagcccctgtgcagaagcagccagagcaccgagcccaagtacaagcccctgggcaagctgaagagagccagaaccgtgcacagagacagcgaggaggaggacgactacctgttcgacgaccccctgcccatccccctgagacacaaggtgccctaccccgagaccttccaccccgaggtgttcagcatgaccgccgtgagcgagaagcagcccgagaagctgagacagacccccggctgctgcagagccgagtgcatgcagagcagcagattcaccaacttcgtggactgcgaggagagcaacagcgagagcgaggaggaggtgggcatccccgccagcctgcagggcgacctgggcagcgtgctgcacctgcagaaggccgacggcgacgtgccccagtgggaggtgttcttcaagagaaacgacgagatcaccgacgagagcctggagaacttccccagcagcaccgtggccggcggcagccagagccccaagctgttcagcgacagcgacggcgagagcacccacatcagcagccagaacagcagccagagcacccacatcaccgagcagggcagccagggctgggacagccagagcgacaccgtgctgctgagcagccaggagagaaacagcggcgacatcaccagcctggacaaggccgactacagacccaccatcaaggagaacatccccgccagcctgatggagcagaacgtgatctgccccaaggacacctacagcgacctgaagagcagagacaaggacgtgaccatcgtgcccagcaccggcgagcccaccaccctgagcagcgagacccacatccccgaggagaagagcctgctgaacctgagcaccaacgccgacagccagagcagcagcgacttcgaggtgcccagcacccccgaggccgagctgcccaagagagagcacctgcagtacctgtacgagaagctggccaccggcgagagcatcgccgtgaagaagagaaagtgcagcctgctggacacctag

SEQ ID NO: 10435 - DNA, 255 bp, Artificial Sequence
  Description of Artificial Sequence: Synthetic coding sequence
atgttcctgttccagggcaacaacggcaccgtgctgtacaccggcgacttcagactggcccagggcgaggccgccagaatggagctgctgcacagcggcggcagagtgaaggacatccagagcgtgtacctggacaccaccttctgcgaccccagattctaccagatccccagcagagaggagtgcctgagcggcgtgctggagctggtgagaagctggatcaccagaagcccctaccacgtggtgtggctgtag

SEQ ID NO: 10436 - DNA, 1038 bp, Artificial Sequence
  Description of Artificial Sequence: Synthetic coding sequence
atggacaaggtggtggagatcctgaagcccctgtgcagaagcagccagagcaccgagcccaagtacaagcccctgggcaagctgaagagagccagaaccgtgcacagagacagcgaggaggaggacgactacctgttcgacgaccccctgcccatccccctgagacacaaggtgccctaccccgagaccttccaccccgaggtgttcagcatgaccgccgtgagcgagaagcagcccgagaagctgagacagacccccggctgctgcagagccgagtgcatgcagagcagcagattcaccaacttcgtggactgcgaggagagcaacagcgagagcgaggaggaggtgggcatccccgccagcctgcagggcgacctgggcagcgtgctgcacctgcagaaggccgacggcgacgtgccccagtgggaggtgttcttcaagagaaacgacgagatcaccgacgagagcctggagaacttccccagcagcaccgtggccggcggcagccagagccccaagctgttcagcgacagcgacggcgagagcacccacatcagcagccagaacagcagccagagcacccacatcaccgagcagggcagccagggctgggacagccagagcgacaccgtgctgctgagcagccaggagagaaacagcggcgacatcaccagcctggacaaggccgactacagacccaccatcaaggagaacatccccgccagcctgatggagcagaacgtgatctgccccaaggacacctacagcgacctgaagagcagagacaaggacgtgaccatcgtgcccagcaccggcgagcccaccaccctgagcagcgagacccacatccccgaggagaagagcctgctgaacctgagcaccaacgccgacagccagagcagcagcgacttcgaggtgcccagcacccccgaggccgagctgcccaagagagagcacctgcagtacctgtacgagaagctggccaccggcgagagcatcgccgtgaagaagagaaagtgcagcctgctggacacctag

SEQ ID NO: 10437 - DNA, 1734 bp, Artificial Sequence; identical to SEQ ID NO: 10434
  Description of Artificial Sequence: Synthetic coding sequence

SEQ ID NO: 10438 - DNA, 1734 bp, Artificial Sequence; identical to SEQ ID NO: 10434
  Description of Artificial Sequence: Synthetic coding sequence

SEQ ID NO: 10439 - DNA, 1719 bp, Artificial Sequence
  Description of Artificial Sequence: Synthetic coding sequence
atgttcctgttccagggcaacaacggcaccgtgctgtacaccggcgacttcagactggcccagggcgaggccgccagaatggagctgctgcacagcggcggcagagtgaaggacatccagagcgtgtacctggacaccaccttctgcgaccccagattctaccagatccccagcagagaggagtgcctgagcggcgtgctggagctggtgagaagctggatcaccagaagcccctaccacgtggtgtggctgaactgcaaggccgcctacggctacgagtacctgttcaccaacctgagcgaggagctgggcgtgcaggtgcacgtgaacaagctggacatgttcagaaacatgcccgagatcctgcaccacctgaccaccgacagaaacacccagatccacgcctgcagacaccccaaggccgaggagtacttccagtggagcaagctgccctgcggcatcaccagcagaaacagaatccccctgcacatcatcagcatcaagcccagcaccatgtggttcggcgagagaagcagaaagaccaacgtgatcgtgagaaccggcgagagcagctacagagcctgcttcagcttccacagcagctacagcgagatcaaggacttcctgagctacctgtgccccgtgaacgcctaccccaacgtgatccccgtgggcaccaccatggacaaggtggtggagatcctgaagcccctgtgcagaagcagccagagcaccgagcccaagtacaagcccctgggcaagctgaagagagccagaaccgtgcacagagacagcgaggaggaggacgactacctgttcgacgaccccctgcccatccccctgagacacaaggtgccctaccccgagaccttccaccccgaggtgttcagcatgaccgccgtgagcgagaagcagcccgagaagctgagacagacccccggctgctgcagagccgagtgcatgcagagcagcagattcaccaacttcgtggactgcgaggagagcaacagcgagagcgaggaggaggtgggcatccccgccagcctgcagggcgacctgggcagcgtgctgcacctgcagaaggccgacggcgacgtgccccagtgggaggtgttcttcaagagaaacgacgagatcaccgacgagagcctggagaacttccccagcagcaccgtggccggcggcagccagagccccaagctgttcagcgacagcgacggcgagagcacccacatcagcagccagaacagcagccagagcacccacatcaccgagcagggcagccagggctgggacagccagagcgacaccgtgctgctgagcagccaggagagaaacagcggcgacatcaccagcctggacaaggccgactacagacccaccatcaaggagaacatccccgccagcctgatggagcagaacgtgatctgccccaaggacacctacagcgacctgaagagcagagacaaggacgtgaccatcgtgcccagcaccggcgagcccaccaccctgagcagcgagacccacatccccgaggagaagagcctgctgaacctgagcaccaacgccgacagccagagcagcagcgacttcgaggtgcccagcacccccgaggccgagctgcccaagagagagcacctgcagtacctgtacgagaagctggccaccggcgagagcatcgccgtgaagaagagaaagtgcagcctgctggacacctag

SEQ ID NO: 10440 - DNA, 1719 bp, Artificial Sequence; identical to SEQ ID NO: 10439
  Description of Artificial Sequence: Synthetic coding sequence

SEQ ID NO: 10441 - DNA, 1719 bp, Artificial Sequence; identical to SEQ ID NO: 10439
  Description of Artificial Sequence: Synthetic coding sequence

SEQ ID NO: 10442 - DNA, 2079 bp, Artificial Sequence
  Description of Artificial Sequence: Synthetic coding sequence
atgagcagcttcgagggccagatggccgagtaccccaccatcagcatcgacagattcgacagagagaacctgagagccagagcctacttcctgagccactgccacaaggaccacatgaagggcctgagagcccccaccctgaagagaagactggagtgcagcctgaaggtgtacctgtactgcagccccgtgaccaaggagctgctgctgaccagccccaagtacagattctggaagaagagaatcatcagcatcgagatcgagacccccacccagatcagcctggtggacgaggccagcggcgagaaggaggagatcgtggtgaccctgctgcccgccggccactgccccggcagcgtgatgttcctgttccagggcaacaacggcaccgtgctgtacaccggcgacttcagactggcccagggcgaggccgccagaatggagctgctgcacagcggcggcagagtgaaggacatccagagcgtgtacctggacaccaccttctgcgaccccagattctaccagatccccagcagagaggagtgcctgagcggcgtgctggagctggtgagaagctggatcaccagaagcccctaccacgtggtgtggctgaactgcaaggccgcctacggctacgagtacctgttcaccaacctgagcgaggagctgggcgtgcaggtgcacgtgaacaagctggacatgttcagaaacatgcccgagatcctgcaccacctgaccaccgacagaaacacccagatccacgcctgcagacaccccaaggccgaggagtacttccagtggagcaagctgccctgcggcatcaccagcagaaacagaatccccctgcacatcatcagcatcaagcccagcaccatgtggttcggcgagagaagcagaaagaccaacgtgatcgtgagaaccggcgagagcagctacagagcctgcttcagcttccacagcagctacagcgagatcaaggacttcctgagctacctgtgccccgtgaacgcctaccccaacgtgatccccgtgggcaccaccatggacaaggtggtggagatcctgaagcccctgtgcagaagcagccagagcaccgagcccaagtacaagcccctgggcaagctgaagagagccagaaccgtgcacagagacagcgaggaggaggacgactacctgttcgacgaccccctgcccatccccctgagacacaaggtgccctaccccgagaccttccaccccgaggtgttcagcatgaccgccgtgagcgagaagcagcccgagaagctgagacagacccccggctgctgcagagccgagtgcatgcagagcagcagattcaccaacttcgtggactgcgaggagagcaacagcgagagcgaggaggaggtgggcatccccgccagcctgcagggcgacctgggcagcgtgctgcacctgcagaaggccgacggcgacgtgccccagtgggaggtgttcttcaagagaaacgacgagatcaccgacgagagcctggagaacttccccagcagcaccgtggccggcggcagccagagccccaagctgttcagcgacagcgacggcgagagcacccacatcagcagccagaacagcagccagagcacccacatcaccgagcagggcagccagggctgggacagccagagcgacaccgtgctgctgagcagccaggagagaaacagcggcgacatcaccagcctggacaaggccgactacagacccaccatcaaggagaacatccccgccagcctgatggagcagaacgtgatctgccccaaggacacctacagcgacctgaagagcagagacaaggacgtgaccatcgtgcccagcaccggcgagcccaccaccctgagcagcgagacccacatccccgaggagaagagcctgctgaacctgagcaccaacgccgacagccagagcagcagcgacttcgaggtgcccagcacccccgaggccgagctgcccaagagagagcacctgcagtacctgtacgagaagctggccaccggcgagagcatcgccgtgaagaagagaaagtgcagcctgctggacacctag

SEQ ID NO: 10443 - DNA, 1305 bp, Artificial Sequence
  Description of Artificial Sequence: Synthetic coding sequence
atgagcagcttcgagggccagatggccgagtaccccaccatcagcatcgacagattcgacagagagaacctgagagccagagcctacttcctgagccactgccacaaggaccacatgaagggcctgagagcccccaccctgaagagaagactggagtgcagcctgaaggtgtacctgtactgcagccccgtgaccaaggagctgctgctgaccagccccaagtacagattctggaagaagagaatcatcagcatcgagatcgagacccccacccagatcagcctggtggacgaggccagcggcgagaaggaggagatcgtggtgaccctgctgcccgccggccactgccccggcagcgtgatgttcctgttccagggcaacaacggcaccgtgctgtacaccggcgacttcagactggcccagggcgaggccgccagaatggagctgctgcacagcggcggcagagtgaaggacatccagagcgtgtacctggacaccaccttctgcgaccccagattctaccagatccccagcagagaggagtgcctgagcggcgtgctggagctggtgagaagctggatcaccagaagcccctaccacgtggtgtggctgaactgcaaggccgcctacggctacgagtacctgttcaccaacctgagcgaggagctgggcgtgcaggtgcacgtgaacaagctggacatgttcagaaacatgcccgagatcctgcaccacctgaccaccgacagaaacacccagatccacgcctgcagacaccccaaggccgaggagtacttccagtggagcaagctgccctgcggcatcaccagcagaaacagaatccccctgcacatcatcagcatcaagcccagcaccatgtggttcggcgagagaagcagaaagaccaacgtgatcgtgagaaccggcgagagcagctacagagcctgcttcagcttccacagcagctacagcgagatcaaggacttcctgagctacctgtgccccgtgaacgcctaccccaacgtgatccccgtgggcaccaccatggacaaggtggtggagatcctgaagcccctgtgcagaagcagccagagcaccgagcccaagtacaagcccctgggcaagctgaagagagccagaaccgtgcacagagacagcggcagccacagcgtgacccaggccagaatgagatggtgccaccacgacagcctgtaccccctgacccccggcatcaagagaagcagctgcctgagcctgctgaccagctggatcaccggcgcctacagacacgcccagctgatgatctag

SEQ ID NO: 10444 - DNA, 1719 bp, Artificial Sequence; identical to SEQ ID NO: 10439
  Description of Artificial Sequence: Synthetic coding sequence

SEQ ID NO: 10445 - DNA, 354 bp, Artificial Sequence
  Description of Artificial Sequence: Synthetic coding sequence
atggagctgctgcacagcggcggcagagtgaaggacatccagagcgtgtacctggacaccaccttctgcgaccccagattctaccagatccccagcagagaggagtgcctgagcggcgtgctggagctggtgagaagctggatcaccagaagcccctaccacgtggtgtggctgaactgcaaggccgcctacggctacgagtacctgttcaccaacctgagcgaggagctgggcgtgcaggtgcacgtgaacaagctggacatgttcagaaacatgcccgagatcctgcaccacctgaccaccgacagaaacacccagatccacgcctgcagacaccccaaggccgaggagtag

SEQ ID NO: 10446 - DNA, 1719 bp, Artificial Sequence; identical to SEQ ID NO: 10439
  Description of Artificial Sequence: Synthetic coding sequence

SEQ ID NO: 10447 - DNA, 174 bp, Artificial Sequence
  Description of Artificial Sequence: Synthetic coding sequence
atgaagcaccaggagagattcctgttccagggcaacaacggcaccgtgctgtacaccggcgacttcagactggcccagggcgaggccgccagaatggagctgctgcacagcggcggcagagtgaaggacatccagagcgtgtacctggacaccaccttctgcgaccccagatag

SEQ ID NO: 10448 - DNA, 807 bp, Artificial Sequence
  Description of Artificial Sequence: Synthetic coding sequence
atggaggtgaccggcgacgccggcgtgcccgagagcggcgagatcagaaccctgaagccctgcctgctgagaagaaactacagcagagagcagcacggcgtggccgccagctgcctggaggacctgagaagcaaggcctgcgacatcctggccatcgacaagagcctgacccccgtgaccctggtgctggccgaggacggcaccatcgtggacgacgacgactacttcctgtgcctgcccagcaacaccaagttcgtggccctggccagcaacgagaagtgggcctacaacaacagcgacggcggcaccgcctggatcagccaggagagcttcgacgtggacgagaccgacagcggcgccggcctgaagtggaagaacgtggccagacagctgaaggaggacctgagcagcatcatcctgctgagcgaggaggacctgcagatgctggtggacgccccctgcagcgacctggcccaggagctgagacagagctgcgccaccgtgcagagactgcagcacaccctgcagcaggtgctggaccagagagaggaggtgagacagagcaagcagctgctgcagctgtacctgcaggccctggagaaggagggcagcctgctgagcaagcaggaggagagcaaggccgccttcggcgaggaggtggacgccgtggacaccggcatcagcagagagaccagcagcgacgtggccctggccagccacatcctgaccgccctgagagagaagcaggcccccgagctgagcctgagcagccaggacctggaggtgggcggcaaccagggccactag

SEQ ID NO: 10449 - DNA, 996 bp, Artificial Sequence
  Description of Artificial Sequence: Synthetic coding sequence
atggaggtgaccggcgacgccggcgtgcccgagagcggcgagatcagaaccctgaagccctgcctgctgagaagaaactacagcagagagcagcacggcgtggccgccagctgcctggaggacctgagaagcaaggcctgcgacatcctggccatcgacaagagcctgacccccgtgaccctggtgctggccgaggacggcaccatcgtggacgacgacgactacttcctgtgcctgcccagcaacaccaagttcgtggccctggccagcaacgagaagtgggcctacaacaacagcgacggcggcaccgcctggatcagccaggagagcttcgacgtggacgagaccgacagcggcgccggcctgaagtggaagaacgtggccagacagctgaaggaggacctgagcagcatcatcctgctgagcgaggaggacctgcagatgctggtggacgccccctgcagcgacctggcccaggagctgagacagagctgcgccaccgtgcagagactgcagcacaccctgcagcaggtgctggaccagagagaggaggtgagacagagcaagcagctgctgcagctgtacctgcaggccctggagaaggagggcagcctgctgagcaagcaggaggagagcaaggccgccttcggcgaggaggtggacgccgtggacaccggcatcagcagagagaccagcagcgacgtggccctggccagccacatcctgaccgccctgagagagaagcaggcccccgagctgagcctgagcagccaggacctggagctggtgaccaaggaggaccccaaggccctggccgtggccctgaactgggacatcaagaagaccgagaccgtgcaggaggcctgcgagagagagctggccctgagactgcagcagacccagagcctgcacagcctgagaagcatcagcgccagcaaggccagcccccccggcgacctgcagaaccccaagagagccagacaggaccccacctag

SEQ ID NO: 10450 - DNA, 510 bp, Artificial Sequence
  Description of Artificial Sequence: Synthetic coding sequence
atggccgccgagagcctgcccttcagcttcggcaccctgagcagctgggagctggaggcctggtacgaggacctgcaggaggtgctgagcagcgacgagaacggcggcacctacgtgagcccccccggcaacgaggaggaggagagcaagatcttcaccaccctggaccccgccagcctggcctggctgaccgaggaggagcccgagcccgccgaggtgaccagcaccagccagagcccccacagccccgacagcagccagagcagcctggcccaggaggaggaggaggaggaccagggcagaaccagaaagagaaagcagagcggccacagccccgccagagccggcaagcagagaatgaaggagaaggagcaggagaacgagagaaaggtggcccagctggccgaggagaacgagagactgaagcaggagatcgagagactgaccagagaggtggaggccaccagaagagccctgatcgacagaatggtgaacctgcaccaggcctag

SEQ ID NO: 10451 - DNA, 510 bp, Artificial Sequence; identical to SEQ ID NO: 10450
  Description of Artificial Sequence: Synthetic coding sequence

SEQ ID NO: 10452 - DNA, 438 bp, Artificial Sequence
  Description of Artificial Sequence: Synthetic coding sequence
atggagctggtgcccgccaccccccactaccccgccgacgtgctgttccagaccgaccccaccgccgagatggccgccgagagcctgcccttcagcttcggcaccctgagcagctgggagctggaggcctggtacgaggacctgcaggaggtgctgagcagcgacgagaacggcggcacctacgtgagcccccccggcaacgaggaggaggagagcaagatcttcaccaccctggaccccgccagcctggcctggctgaccgaggaggagcccgagcccgccgaggtgaccagcaccagccagagcccccacagccccgacagcagccagagcagcctggcccaggaggaggaggaggaggaccagggcagaaccagaaagagaaagcagagcggccacagccccgccagagccggcaagcagagaatgaaggagtag

SEQ ID NO: 10453 - DNA, 579 bp, Artificial Sequence
  Description of Artificial Sequence: Synthetic coding sequence
atggagctggtgcccgccaccccccactaccccgccgacgtgctgttccagaccgaccccaccgccgagatggccgccgagagcctgcccttcagcttcggcaccctgagcagctgggagctggaggcctggtacgaggacctgcaggaggtgctgagcagcgacgagaacggcggcacctacgtgagcccccccggcaacgaggaggaggagagcaagatcttcaccaccctggaccccgccagcctggcctggctgaccgaggaggagcccgagcccgccgaggtgaccagcaccagccagagcccccacagccccgacagcagccagagcagcctggcccaggaggaggaggaggaggaccagggcagaaccagaaagagaaagcagagcggccacagccccgccagagccggcaagcagagaatgaaggagaaggagcaggagaacgagagaaaggtggcccagctggccgaggagaacgagagactgaagcaggagatcgagagactgaccagagaggtggaggccaccagaagagccctgatcgacagaatggtgaacctgcaccaggcctag

SEQ ID NO: 10454 - DNA, 579 bp, Artificial Sequence; identical to SEQ ID NO: 10453
  Description of Artificial Sequence: Synthetic coding sequence

SEQ ID NO: 10455 - DNA, 864 bp, Artificial Sequence
  Description of Artificial Sequence: Synthetic coding sequence
atggccagcctggaggtgagcagaagccccagaagaagcagaagagagctggaggtgagaagccccagacagaacaagtacagcgtgctgctgcccacctacaacgagagagagaacctgcccctgatcgtgtggctgctggtgaagagcttcagcgagagcggcatcaactacgagatcatcatcatcgacgacggcagccccgacggcaccagagacgtggccgagcagctggagaagatctacggcagcgacagaatcctgctgagacccagagagaagaagctgggcctgggcaccgcctacatccacggcatgaagcacgccaccggcaactacatcatcatcatggacgccgacctgagccaccaccccaagttcatccccgagttcatcagaaagcagaaggagggcaacttcgacatcgtgagcggcaccagatacaagggcaacggcggcgtgtacggctgggacctgaagagaaagatcatcagcgacggcgtgctgccctgctgccccggctggagcctgctgggcagcagcgaccccgccatcctggccagctgggactacagcagaggcgccaacttcctgacccagatcctgctgagacccggcgccagcgacctgaccggcagcttcagactgtacagaaaggaggtgctggagaagctgatcgagaagtgcgtgagcaagggctacgtgttccagatggagatgatcgtgagagccagacagctgaactacaccatcggcgaggtgcccatcagcttcgtggacagagtgtacggcgagagcaagctgggcggcaacgagatcgtgagcttcctgaagggcctgctgaccctgttcgccaccacctag

SEQ ID NO: 10456 - DNA, 768 bp, Artificial Sequence
  Description of Artificial Sequence: Synthetic coding sequence
atggccagcctggaggtgagcagaagccccagaagaagcagaagagagctggaggtgagaagccccagacagaacaagtacagcgtgctgctgcccacctacaacgagagagagaacctgcccctgatcgtgtggctgctggtgaagagcttcagcgagagcggcatcaactacgagatcatcatcatcgacgacggcagccccgacggcaccagagacgtggccgagcagctggagaagatctacggcagcgacagaatcctgctgagacccagagagaagaagctgggcctgggcaccgcctacatccacggcatgaagcacgccaccggcaactacatcatcatcatggacgccgacctgagccaccaccccaagttcatccccgagttcatcagcgacggcgtgctgccctgctgccccggctggagcctgctgggcagcagcgaccccgccatcctggccagctgggactacagcagaggcgccaacttcctgacccagatcctgctgagacccggcgccagcgacctgaccggcagcttcagactgtacagaaaggaggtgctggagaagctgatcgagaagtgcgtgagcaagggctacgtgttccagatggagatgatcgtgagagccagacagctgaactacaccatcggcgaggtgcccatcagcttcgtggacagagtgtacggcgagagcaagctgggcggcaacgagatcgtgagcttcctgaagggcctgctgaccctgttcgccaccacctag

SEQ ID NO: 10457 - DNA, 888 bp, Artificial Sequence
  Description of Artificial Sequence: Synthetic coding sequence
tgagccagcctggaggtgagcagaagccccagaagaagcagaagagagctggaggtgagaagccccagacagaacaagtacagcgtgctgctgcccacctacaacgagagagagaacctgcccctgatcgtgtggctgctggtgaagagcttcagcgagagcggcatcaactacgagatcatcatcatcgacgacggcagccccgacggcaccagagacgtggccgagcagctggagaagatctacggcagcgacagaatcctgctgagacccagagagaagaagctgggcctgggcaccgcctacatccacggcatgaagcacgccaccggcaactacatcatcatcatggacgccgacctgagccaccaccccaagttcatccccgagttcatcagaaagcagaaggagggcaacttcgacatcgtgagcggcaccagatacaagggcaacggcggcgtgtacggctgggacctgaagagaaagatcatcagcgacggcgtgctgccctgctgccccggctggagcctgctgggcagcagcgaccccgccatcctggccagctgggactacagatgcgagccccccagactggccagcagaggcgccaacttcctgacccagatcctgctgagacccggcgccagcgacctgaccggcagcttcagactgtacagaaaggaggtgctggagaagctgatcgagaagtgcgtgagcaagggctacgtgttccagatggagatgatcgtgagagccagacagctgaactacaccatcggcgaggtgcccatcagcttcgtggacagagtgtacggcgagagcaagctgggcggcaacgagatcgtgagcttcctgaagggcctgctgaccctgttcgccaccacctag

SEQ ID NO: 10458 - DNA, 783 bp, Artificial Sequence
  Description of Artificial Sequence: Synthetic coding sequence
atggccagcctggaggtgagcagaagccccagaagaagcagaagagagctggaggtgagaagccccagacagaacaagtacagcgtgctgctgcccacctacaacgagagagagaacctgcccctgatcgtgtggctgctggtgaagagcttcagcgagagcggcatcaactacgagatcatcatcatcgacgacggcagccccgacggcaccagagacgtggccgagcagctggagaagatctacggcagcgacagaatcctgctgagacccagagagaagaagctgggcctgggcaccgcctacatccacggcatgaagcacgccaccggcaactacatcatcatcatggacgccgacctgagccaccaccccaagttcatccccgagttcatcagaaagcagaaggagggcaacttcgacatcgtgagcggcaccagatacaagggcaacggcggcgtgtacggctgggacctgaagagaaagatcatcagcagaggcgccaacttcctgacccagatcctgctgagacccggcgccagcgacctgaccggcagcttcagactgtacagaaaggaggtgctggagaagctgatcgagaagtgcgtgagcaagggctacgtgttccagatggagatgatcgtgagagccagacagctgaactacaccatcggcgaggtgcccatcagcttcgtggacagagtgtacggcgagagcaagctgggcggcaacgagatcgtgagcttcctgaagggcctgctgaccctgttcgccaccacctag

SEQ ID NO: 10459 - DNA, 666 bp, Artificial Sequence
  Description of Artificial Sequence: Synthetic coding sequence
atggccagcctggaggtgagcagaagccccagaagaagcagaagagagctggaggtgagaagccccagacagaacaagtacagcgtgctgctgcccacctacaacgagagagagaacctgcccctgatcgtgtggctgctggtgaagagcttcagcgagagcggcatcaactacgagatcatcatcatcgacgacggcagccccgacggcaccagagacgtggccgagcagctggagaagatctacggcagcgacagaatcctgctgagacccagagagaagaagctgggcctgggcaccgcctacatccacggcatgaagcacgccaccggcaactacatcatcatcatggacgccgacctgagccaccaccccaagttcatccccgagttcatcagcgacggcgtgctgccctgctgccccggctggagcctgctgggcagcagcgaccccgccatcctggccagctgggactacagcagaggcgccaacttcctgacccagatcctgctgagacccggcgccagcgacctgaccggcagcttcagactgtacagaaaggaggtgctggagaagctgatcgagaagtgcgtgagcaagggctacgtgttccagatggagatgatcgtgagagccagacagctgaactacaccatcggcgagtag

SEQ ID NO: 10460 - DNA, 888 bp, Artificial Sequence
  Description of Artificial Sequence: Synthetic coding sequence
atggccagcctggaggtgagcagaagccccagaagaagcagaagagagctggaggtgagaagccccagacagaacaagtacagcgtgctgctgcccacctacaacgagagagagaacctgcccctgatcgtgtggctgctggtgaagagcttcagcgagagcggcatcaactacgagatcatcatcatcgacgacggcagccccgacggcaccagagacgtggccgagcagctggagaagatctacggcagcgacagaatcctgctgagacccagagagaagaagctgggcctgggcaccgcctacatccacggcatgaagcacgccaccggcaactacatcatcatcatggacgccgacctgagccaccaccccaagttcatccccgagttcatcagaaagcagaaggagggcaacttcgacatcgtgagcggcaccagatacaagggcaacggcggcgtgtacggctgggacctgaagagaaagatcatcagcgacggcgtgctgccctgctgccccggctggagcctgctgggcagcagcgaccccgccatcctggccagctgggactacagatgcgagccccccagactggccagcagaggcgccaacttcctgacccagatcctgctgagacccggcgccagcgacctgaccggcagcttcagactgtacagaaaggaggtgctggagaagctgatcgagaagtgcgtgagcaagggctacgtgttccagatggagatgatcgtgagagccagacagctgaactacaccatcggcgaggtgcccatcagcttcgtggacagagtgtacggcgagagcaagctgggcggcaacgagatcgtgagcttcctgaagggcctgctgaccctgttcgccaccacctag

SEQ ID NO: 10461 - DNA, 1332 bp, Artificial Sequence
  Description of Artificial Sequence: Synthetic coding sequence
atgagaagacaggtgatggccgccctggtggtgagcggcgccgccgagcagggcggcagagacggccccggcagaggcagagcccccagaggcagagtggccaaccagatcccccccgagatcctgaagaacccccagctgcaggccgccatcagagtgctgcccagcaactacaacttcgagatccccaagaccatctggagaatccagcaggcccaggccaagaaggtggccctgcagatgcccgagggcctgctgctgttcgcctgcaccatcgtggacatcctggagagattcaccgaggccgaggtgatggtgatgggcgacgtgacctacggcgcctgctgcgtggacgacttcaccgccagagccctgggcgccgacttcctggtgcactacggccacagctgcctgatccccatggacaccagcgcccaggacttcagagtgctgtacgtgttcgtggacatcagaatcgacaccacccacctgctggacagcctgagactgaccttcccccccgccaccgccctggccctggtgagcaccatccagttcgtgagcaccctgcaggccgccgcccaggagctgaaggccgagtacagagtgagcgtgccccagtgcaagcccctgagccccggcgagatcctgggctgcaccagccccagactgagcaaggaggtggaggccgtggtgtacctgggcgacggcagattccacctggagagcgtgatgatcgccaaccccaacgtgcccgcctacagatacgacccctacagcaaggtgctgagcagagagcactacgaccaccagagaatgcaggccgccagacaggaggccatcgccaccgccagaagcgccaagagctggggcctgatcctgggcaccctgggcagacagggcagccccaagatcctggagcacctggagagcagactgagagccctgggcctgagcttcgtgagactgctgctgagcgagatcttccccagcaagctgagcctgctgcccgaggtggacgtgtgggtgcaggtggcctgccccagactgagcatcgactggggcaccgccttccccaagcccctgctgaccccctacgaggccgccgtggccctgagagacatcagctggcagcagccctaccccatggacttctacgccggcagcagcctgggcccctggaccgtgaaccacggccaggacagaagaccccacgcccccggcagacccgccagaggcaaggtgcaggagggcagcgccagaccccccagcgccgtggcctgcgaggactgcagctgcagagacgagaaggtggcccccctggccccctag

SEQ ID NO: 10462 - DNA, 1146 bp, Artificial Sequence
  Description of Artificial Sequence: Synthetic coding sequence
atgatcgacaccctgagacccgtgcccttcgccagcgagatggccatcagcaagaccgtggcctggctgaacgagcagctggagctgggcaacgagagactgctgctgatggactgcagaccccaggagctgtacgagagcagccacatcgagagcgccatcaacgtggccatccccggcatcatgctgagaagactgcagaagggcaacctgcccgtgagagccctgttcaccagaggcgaggacagagacagattcaccagaagatgcggcaccgacaccgtggtgctgtacgacgagagcagcagcgactggaacgagaacaccggcggcgagagcgtgctgggcctgctgctgaagaagctgaaggacgagggctgcagagccttctacctggagggcggcttcagcaagttccaggccgagttcagcctgcactgcgagaccaacctggacggcagctgcagcagcagcagcccccccctgcccgtgctgggcctgggcggcctgagaatcagcagcgacagcagcagcgacatcgagagcgacctggacagagaccccaacagcgccaccgacagcgacggcagccccctgagcaacagccagcccagcttccccgtggagatcctgcccttcctgtacctgggctgcgccaaggacagcaccaacctggacgtgctggaggagttcggcatcaagtacatcctgaacgtgacccccaacctgcccaacctgttcgagaacgccggcgagttcaagtacaagcagatccccatcagcgaccactggagccagaacctgagccagttcttccccgaggccatcagcttcatcgacgaggccagaggcaagaactgcggcgtgctggtgcactgcctggccggcatcagcagaagcgtgaccgtgaccgtggcctacctgatgcagaagctgaacctgagcatgaacgacgcctacgacatcgtgaagatgaagaagagcaacatcagccccaacttcaacttcatgggccagctgctggacttcgagagaaccctgggcctgagcagcccctgcgacaacagagtgcccgcccagcagctgtacttcaccacccccagcaaccagaacgtgtaccaggtggacagcctgcagagcacctag

SEQ ID NO: 10463 - DNA, 708 bp, Artificial Sequence
  Description of Artificial Sequence: Synthetic coding sequence
atgatcgacaccctgagacccgtgcccttcgccagcgagatggccatcagcaagaccgtggcctggctgaacgagcagctggagctgggcaacgagagactgctgctgatggactgcagaccccaggagctgtacgagagcagccacatcgagagcgccatcaacgtggccatccccggcatcatgctgagaagactgcagaagggcaacctgcccgtgagagccctgttcaccagaggcgaggacagagacagattcaccagaagatgcggcaccgacaccgtggtgctgtacgacgagagcagcagcgactggaacgagaacaccggcggcgagagcgtgctgggcctgctgctgaagaagctgaaggacgagggctgcagagccttctacctggaggacgaggccagaggcaagaactgcggcgtgctggtgcactgcctggccggcatcagcagaagcgtgaccgtgaccgtggcctacctgatgcagaagctgaacctgagcatgaacgacgcctacgacatcgtgaagatgaagaagagcaacatcagccccaacttcaacttcatgggccagctgctggacttcgagagaaccctgggcctgagcagcccctgcgacaacagagtgcccgcccagcagctgtacttcaccacccccagcaaccagaacgtgtaccaggtggacagcctgcagagcacctag

SEQ ID NO: 10464 - DNA, 354 bp, Artificial Sequence
  Description of Artificial Sequence: Synthetic coding sequence
atgatcgacaccctgagacccgtgcccttcgccagcgagatggccatcagcaagaccgtggcctggctgaacgagcagctggagctgggcaacgagagactgctgctgatggactgcagaccccaggagctgtacgagagcagccacatcgagagcgccatcaacgtggccatccccggcatcatgctgagaagactgcagaagggcaacctgcccgtgagagccctgttcaccagaggcgaggacagagacagattcaccagaagatgcggcaccgacaccgtggtgctgtacgacgagagcagcagcgactggaacgagaacaccggcggcgagagcgtgctgggcctgtag

SEQ ID NO: 10465 - DNA, 1545 bp, Artificial Sequence
  Description of Artificial Sequence: Synthetic coding sequence
atggccgacgccgaggtgatcatcctgcccaagaagcacaagaagaagaaggagagaaagagcctgcccgaggaggacgtggccgagatccagcacgccgaggagttcctgatcaagcccgagagcaaggtggccaagctggacaccagccagtggcccctgctgctgaagaacttcgacaagctgaacgtgagaaccacccactacacccccctggcctgcggcagcaaccccctgaagagagagatcggcgactacatcagaaccggcttcatcaacctggacaagcccagcaaccccagcagccacgaggtggtggcctggatcagaagaatcctgagagtggagaagaccggccacagcggcaccctggaccccaaggtgaccggctgcctgatcgtgtgcatcgagagagccaccagactggtgaagagccagcagagcgccggcaaggagtacgtgggcatcgtgagactgcacaacgccatcgagggcggcacccagctgagcagagccctggagaccctgaccggcgccctgttccagagaccccccctgatcgccgccgtgaagagacagctgagagtgagaaccatctacgagagcaagatgatcgagtacgaccccgagagaagactgggcatcttctgggtgagctgcgaggccggcacctacatcagaaccctgtgcgtgcacctgggcctgctgctgggcgtgggcggccagatgcaggagctgagaagagtgagaagcggcgtgatgagcgagaaggaccacatggtgaccatgcacgacgtgctggacgcccagtggctgtacgacaaccacaaggacgagagctacctgagaagagtggtgtaccccctggagaagctgctgaccagccacaagagactggtgatgaaggacagcgccgtgaacgccatctgctacggcgccaagatcatgctgcccggcgtgctgagatacgaggacggcatcgaggtgaaccaggagatcgtggtgatcaccaccaagggcgaggccatctgcatggccatcgccctgatgaccaccgccgtgatcagcacctgcgaccacggcatcgtggccaagatcaagagagtgatcatggagagagacacctaccccagaaagtggggcctgggccccaaggccagccagaagaagctgatgatcaagcagggcctgctggacaagcacggcaagcccaccgacagcacccccgccacctggaagcaggagtacgtggactacagcgagagcgccaagaaggaggtggtggccgaggtggtgaaggccccccaggtggtggccgaggccgccaagaccgccaagagaaagagagagagcgagagcgagagcgacgagaccccccccgccgccccccagctgatcaagaaggagaagaagaagagcaagaaggacaagaaggccaaggccggcctggagagcggcgccgagcccggcgacggcgacagcgacaccaccaagaagaagaagaagaagaagaaggccaaggaggtggagctggtgagcgagtag

SEQ ID NO: 10466 - DNA, 7245 bp, Artificial Sequence
  Description of Artificial Sequence: Synthetic coding sequence
atggccgagaacgtggtggagcccggcccccccagcgccaagagacccaagctgagcagccccgccctgagcgccagcgccagcgacggcaccgacttcggcagcctgttcgacctggagcacgacctgcccgacgagctgatcaacagcaccgagctgggcctgaccaacggcggcgacatcaaccagctgcagaccagcctgggcatggtgcaggacgccgccagcaagcacaagcagctgagcgagctgctgagaagcggcagcagccccaacctgaacatgggcgtgggcggccccggccaggtgatggccagccaggcccagcagagcagccccggcctgggcctgatcaacagcatggtgaagagccccatgacccaggccggcctgaccagccccaacatgggcatgggcaccagcggccccaaccagggccccacccagagcaccggcatgatgaacagccccgtgaaccagcccgccatgggcatgaacaccggcatgaacgccggcatgaaccccggcatgctggccgccggcaacggccagggcatcatgcccaaccaggtgatgaacggcagcatcggcgccggcagaggcagacagaacatgcagtaccccaaccccggcatgggcagcgccggcaacctgctgaccgagcccctgcagcagggcagcccccagatgggcggccagaccggcctgagaggcccccagcccctgaagatgggcatgatgaacaaccccaacccctacggcagcccctacacccagaaccccggccagcagatcggcgccagcggcctgggcctgcagatccagaccaagaccgtgctgagcaacaacctgagccccttcgccatggacaagaaggccgtgcccggcggcggcatgcccaacatgggccagcagcccgccccccaggtgcagcagcccggcctggtgacccccgtggcccagggcatgggcagcggcgcccacaccgccgaccccgagaagagaaagctgatccagcagcagctggtgctgctgctgcacgcccacaagtgccagagaagagagcaggccaacggcgaggtgagacagtgcaacctgccccactgcagaaccatgaagaacgtgctgaaccacatgacccactgccagagcggcaagagctgccaggtggcccactgcgccagcagcagacagatcatcagccactggaagaactgcaccagacacgactgccccgtgtgcctgcccctgaagaacgccggcgacaagagaaaccagcagcccatcctgaccggcgcccccgtgggcctgggcaaccccagcagcctgggcgtgggccagcagagcgcccccaacctgagcaccgtgagccagatcgaccccagcagcatcgagagagcctacgccgccctgggcctgccctaccaggtgaaccagatgcccacccagccccaggtgcaggccaagaaccagcagaaccagcagcccggccagagcccccagggcatgagacccatgagcaacatgagcgccagccccatgggcgtgaacggcggcgtgggcgtgcagacccccagcctgctgagcgacagcatgctgcacagcgccatcaacagccagaaccccatgatgagcgagaacgccagcgtgcccagcctgggccccatgcccaccgccgcccagcccagcaccaccggcatcagaaagcagtggcacgaggacatcacccaggacctgagaaaccacctggtgcacaagctggtgcaggccatcttccccacccccgaccccgccgccctgaaggacagaagaatggagaacctggtggcctacgccagaaaggtggagggcgacatgtacgagagcgccaacaacagagccgagtactaccacctgctggccgagaagatctacaagatccagaaggagctggaggagaagagaagaaccagactgcagaagcagaacatgctgcccaacgccgccggcatggtgcccgtgagcatgaaccccggccccaacatgggccagccccagcccggcatgaccagcaacggccccctgcccgaccccagcatgatcagaggcagcgtgcccaaccagatgatgcccagaatcaccccccagagcggcctgaaccagttcggccagatgagcatggcccagccccccatcgtgcccagacagaccccccccctgcagcaccacggccagctggcccagcccggcgccctgaacccccccatgggctacggccccagaatgcagcagcccagcaaccagggccagttcctgccccagacccagttccccagccagggcatgaacgtgaccaacatccccctggcccccagcagcggccaggcccccgtgagccaggcccagatgagcagcagcagctgccccgtgaacagccccatcatgccccccggcagccagggcagccacatccactgcccccagctgccccagcccgccctgcaccagaacagccccagccccgtgcccagcagaacccccaccccccaccacaccccccccagcatcggcgcccagcagccccccgccaccaccatccccgcccccgtgcccaccccccccgccatgccccccggcccccagagccaggccctgcaccccccccccagacagacccccaccccccccaccacccagctgccccagcaggtgcagcccagcctgcccgccgcccccagcgccgaccagccccagcagcagcccagaagccagcagagcaccgccgccagcgtgcccacccccaccgcccccctgctgcccccccagcccgccacccccctgagccagcccgccgtgagcatcgagggccaggtgagcaacccccccagcaccagcagcaccgaggtgaacagccaggccatcgccgagaagcagcccagccaggaggtgaagatggaggccaagatggaggtggaccagcccgagcccgccgacacccagcccgaggacatcagcgagagcaaggtggaggactgcaagatggagagcaccgagaccgaggagagaagcaccgagctgaagaccgagatcaaggaggaggaggaccagcccagcaccagcgccacccagagcagccccgcccccggccagagcaagaagaagatcttcaagcccgaggagctgagacaggccctgatgcccaccctggaggccctgtacagacaggaccccgagagcctgcccttcagacagcccgtggacccccagctgctgggcatccccgactacttcgacatcgtgaagagccccatggacctgagcaccatcaagagaaagctggacaccggccagtaccaggagccctggcagtacgtggacgacatctggctgatgttcaacaacgcctggctgtacaacagaaagaccagcagagtgtacaagtactgcagcaagctgagcgaggtgttcgagcaggagatcgaccccgtgatgcagagcctgggctactgctgcggcagaaagctggagttcagcccccagaccctgtgctgctacggcaagcagctgtgcaccatccccagagacgccacctactacagctaccagaacagataccacttctgcgagaagtgcttcaacgagatccagggcgagagcgtgagcctgggcgacgaccccagccagccccagaccaccatcaacaaggagcagttcagcaagagaaagaacgacaccctggaccccgagctgttcgtggagtgcaccgagtgcggcagaaagatgcaccagatctgcgtgctgcaccacgagatcatctggcccgccggcttcgtgtgcgacggctgcctgaagaagagcgccagaaccagaaaggagaacaagttcagcgccaagagactgcccagcaccagactgggcaccttcctggagaacagagtgaacgacttcctgagaagacagaaccaccccgagagcggcgaggtgaccgtgagagtggtgcacgccagcgacaagaccgtggaggtgaagcccggcatgaaggccagattcgtggacagcggcgagatggccgagagcttcccctacagaaccaaggccctgttcgccttcgaggagatcgacggcgtggacctgtgcttcttcggcatgcacgtgcaggagtacggcagcgactgccccccccccaaccagagaagagtgtacatcagctacctggacagcgtgcacttcttcagacccaagtgcctgagaaccgccgtgtaccacgagatcctgatcggctacctggagtacgtgaagaagctgggctacaccaccggccacatctgggcctgcccccccagcgagggcgacgactacatcttccactgccacccccccgaccagaagatccccaagcccaagagactgcaggagtggtacaagaagatgctggacaaggccgtgagcgagagaatcgtgcacgactacaaggacatcttcaagcaggccaccgaggacagactgaccagcgccaaggagctgccctacttcgagggcgacttctggcccaacgtgctggaggagagcatcaaggagctggagcaggaggaggaggagagaaagagagaggagaacaccagcaacgagagcaccgacgtgaccaagggcgacagcaagaacgccaagaagaagaacaacaagaagaccagcaagaacaagagcagcctgagcagaggcaacaagaagaagcccggcatgcccaacgtgagcaacgacctgagccagaagctgtacgccaccatggagaagcacaaggaggtgttcttcgtgatcagactgatcgccggccccgccgccaacagcctgccccccatcgtggaccccgaccccctgatcccctgcgacctgatggacggcagagacgccttcctgaccctggccagagacaagcacctggagttcagcagcctgagaagagcccagtggagcaccatgtgcatgctggtggagctgcacacccagagccaggacagattcgtgtacacctgcaacgagtgcaagcaccacgtggagaccagatggcactgcaccgtgtgcgaggactacgacctgtgcatcacctgctacaacaccaagaaccacgaccacaagatggagaagctgggcctgggcctggacgacgagagcaacaaccagcaggccgccgccacccagagccccggcgacagcagaagactgagcatccagagatgcatccagagcctggtgcacgcctgccagtgcagaaacgccaactgcagcctgcccagctgccagaagatgaagagagtggtgcagcacaccaagggctgcaagagaaagaccaacggcggctgccccatctgcaagcagctgatcgccctgtgctgctaccacgccaagcactgccaggagaacaagtgccccgtgcccttctgcctgaacatcaagcagaagctgagacagcagcagctgcagcacagactgcagcaggcccagatgctgagaagaagaatggccagcatgcagagaaccggcgtggtgggccagcagcagggcctgcccagccccacccccgccacccccaccacccccaccggccagcagcccaccaccccccagaccccccagcccaccagccagccccagcccaccccccccaacagcatgcccccctacctgcccagaacccaggccgccggccccgtgagccagggcaaggccgccggccaggtgaccccccccacccccccccagaccgcccagccccccctgcccggccccccccccgccgccgtggagatggccatgcagatccagagagccgccgagacccagagacagatggcccacgtgcagatcttccagagacccatccagcaccagatgccccccatgacccccatggcccccatgggcatgaaccccccccccatgaccagaggccccagcggccacctggagcccggcatgggccccaccggcatgcagcagcagcccccctggagccagggcggcctgccccagccccagcagctgcagagcggcatgcccagacccgccatgatgagcgtggcccagcacggccagcccctgaacatggccccccagcccggcctgggccaggtgggcatcagccccctgaagcccggcaccgtgagccagcaggccctgcagaacctgctgagaaccctgagaagccccagcagccccctgcagcagcagcaggtgctgagcatcctgcacgccaacccccagctgctggccgccttcatcaagcagagagccgccaagtacgccaacagcaacccccagcccatccccggccagcccggcatgccccagggccagcccggcctgcagccccccaccatgcccggccagcagggcgtgcacagcaaccccgccatgcagaacatgaaccccatgcaggccggcgtgcagagagccggcctgccccagcagcagccccagcagcagctgcagccccccatgggcggcatgagcccccaggcccagcagatgaacatgaaccacaacaccatgcccagccagttcagagacatcctgagaagacagcagatgatgcagcagcagcagcagcagggcgccggccccggcatcggccccggcatggccaaccacaaccagttccagcagccccagggcgtgggctaccccccccagcagcagcagagaatgcagcaccacatgcagcagatgcagcagggcaacatgggccagatcggccagctgccccaggccctgggcgccgaggccggcgccagcctgcaggcctaccagcagagactgctgcagcagcagatgggcagccccgtgcagcccaaccccatgagcccccagcagcacatgctgcccaaccaggcccagagcccccacctgcagggccagcagatccccaacagcctgagcaaccaggtgagaagcccccagcccgtgcccagccccagaccccagagccagcccccccacagcagccccagccccagaatgcagccccagcccagcccccaccacgtgagcccccagaccagcagcccccaccccggcctggtggccgcccaggccaaccccatggagcagggccacttcgccagccccgaccagaacagcatgctgagccagctggccagcaaccccggcatggccaacctgcacggcgccagcgccaccgacctgggcctgagcaccgacaacagcgacctgaacagcaacctgagccagagcaccctggacatccactag

SEQ ID NO: 10467 - DNA, 1314 bp, Artificial Sequence
  Description of Artificial Sequence: Synthetic coding sequence
atggccctggccggcgcccccgccggcggcccctgcgcccccgccctggaggccctgctgggcgccggcgccctgagactgctggacagcagccagatcgtgatcatcagcgccgcccaggacgccagcgccccccccgcccccaccggccccgccgcccccgccgccggcccctgcgaccccgacctgctgctgttcgccaccccccaggcccccagacccacccccagcgcccccagacccgccctgggcagaccccccgtgaagagaagactggacctggagaccgaccaccagtacctggccgagagcagcggccccgccagaggcagaggcagacaccccggcaagggcgtgaagagccccggcgagaagagcagatacgagaccagcctgaacctgaccaccaagagattcctggagctgctgagccacagcgccgacggcgtggtggacctgaactgggccgccgaggtgctgaaggtgcagaagagaagaatctacgacatcaccaacgtgctggagggcatccagctgatcgccaagaagagcaagaaccacatccagtggctgggcagccacaccaccgtgggcgtgggcggcagactggagggcctgacccaggacctgagacagctgcaggagagcgagcagcagctggaccacctgatgaacatctgcaccacccagctgagactgctgagcgaggacaccgacagccagagactggcctacgtgacctgccaggacctgagaagcatcgccgaccccgccgagcagatggtgatggtgatcaaggccccccccgagacccagctgcaggccgtggacagcagcgagaacttccagatcagcctgaagagcaagcagggccccatcgacgtgttcctgtgccccgaggagaccgtgggcggcatcagccccggcaagacccccagccaggaggtgaccagcgaggaggagaacagagccaccgacagcgccaccatcgtgagccccccccccagcagcccccccagcagcctgaccaccgaccccagccagagcctgctgagcctggagcaggagcccctgctgagcagaatgggcagcctgagagcccccgtggacgaggacagactgagccccctggtggccgccgacagcctgctggagcacgtgagagaggacttcagcggcctgctgcccgaggagttcatcagcctgagccccccccacgaggccctggactaccacttcggcctggaggagggcgagggcatcagagacctgttcgactgcgacttcggcgacctgacccccctggacttctag

SEQ ID NO: 10468 - DNA, 1242 bp, Artificial Sequence
  Description of Artificial Sequence: Synthetic coding sequence
atggccgaggccggcccccaggccccccccccccccggcacccccagcagacacgagaagagcctgggcctgctgaccaccaagttcgtgagcctgctgcaggaggccaaggacggcgtgctggacctgaagctggccgccgacaccctggccgtgagacagaagagaagaatctacgacatcaccaacgtgctggagggcatcggcctgatcgagaagaagagcaagaacagcatccagtggaagggcgtgggccccggctgcaacaccagagagatcgccgacaagctgatcgagctgaaggccgagatcgaggagctgcagcagagagagcaggagctggaccagcacaaggtgtgggtgcagcagagcatcagaaacgtgaccgaggacgtgcagaacagctgcctggcctacgtgacccacgaggacatctgcagatgcttcgccggcgacaccctgctggccatcagagcccccagcggcaccagcctggaggtgcccatccccgagggcctgaacggccagaagaagtaccagatccacctgaagagcgtgagcggccccatcgaggtgctgctggtgaacaaggaggcctggagcagcccccccgtggccgtgcccgtgcccccccccgaggacctgctgcagagccccagcgccgtgagcacccccccccccctgcccaagcccgccctggcccagagccaggaggccagcagacccaacagcccccagctgacccccaccgccgtgcccggcagcgccgaggtgcagggcatggccggccccgccgccgagatcaccgtgagcggcggccccggcaccgacagcaaggacagcggcgagctgagcagcctgcccctgggccccaccaccctggacaccagacccctgcagagcagcgccctgctggacagcagcagcagcagcagcagcagcagcagcagcagcagcaacagcaacagcagcagcagcagcggccccaaccccagcaccagcttcgagcccatcaaggccgaccccaccggcgtgctggagctgcccaaggagctgagcgagatcttcgaccccaccagagagtgcatgagcagcgagctgctggaggagctgatgagcagcgaggtgttcgcccccctgctgagactgagccccccccccggcgaccacgactacatctacaacctggacgagagcgagggcgtgtgcgacctgttcgacgtgcccgtgctgaacctgtag

SEQ ID NO: 10469 - DNA, 1164 bp, Artificial Sequence
  Description of Artificial Sequence: Synthetic coding sequence
atgaccggcaagctggccgagaagctgcccgtgaccatgagcagcctgctgaaccagctgcccgacaacctgtaccccgaggagatccccagcgccctgaacctgttcagcggcagcagcgacagcgtggtgcactacaaccagatggccaccgagaacgtgatggacatcggcctgaccaacgagaagcccaaccccgagctgagctacagcggcagcttccagcccgcccccggcaacaagaccgtgacctacctgggcaagttcgccttcgacagccccagcaactggtgccaggacaacatcatcagcctgatgagcgccggcatcctgggcgtgccccccgccagcggcgccctgagcacccagaccagcaccgccagcatggtgcagcccccccagggcgacgtggaggccatgtaccccgccctgcccccctacagcaactgcggcgacctgtacagcgagcccgtgagcttccacgacccccagggcaaccccggcctggcctacagcccccaggactaccagagcgccaagcccgccctggacagcaacctgttccccatgatccccgactacaacctgtaccaccaccccaacgacatgggcagcatccccgagcacaagcccttccagggcatggaccccatcagagtgaaccccccccccatcacccccctggagaccatcaaggccttcaaggacaagcagatccaccccggcttcggcagcctgccccagccccccctgaccctgaagcccatcagacccagaaagtaccccaacagacccagcaagacccccctgcacgagagaccccacgcctgccccgccgagggctgcgacagaagattcagcagaagcgacgagctgaccagacacctgagaatccacaccggccacaagcccttccagtgcagaatctgcatgagaagcttcagcagaagcgaccacctgaccacccacatcagaacccacaccggcgagaagcccttcgcctgcgagttctgcggcagaaagttcgccagaagcgacgagagaaagagacacgccaagatccacctgaagcagaaggagaagaaggccgagaagggcggcgcccccagcgccagcagcgccccccccgtgagcctggcccccgtggtgaccacctgcgcctag

SEQ ID NO: 10470 - DNA, 687 bp, Artificial Sequence
  Description of Artificial Sequence: Synthetic coding sequence
atggacatcggcctgaccaacgagaagcccaaccccgagctgagctacagcggcagcttccagcccgcccccggcaacaagaccgtgaccatgatccccgactacaacctgtaccaccaccccaacgacatgggcagcatccccgagcacaagcccttccagggcatggaccccatcagagtgaaccccccccccatcacccccctggagaccatcaaggccttcaaggacaagcagatccaccccggcttcggcagcctgccccagccccccctgaccctgaagcccatcagacccagaaagtaccccaacagacccagcaagacccccctgcacgagagaccccacgcctgccccgccgagggctgcgacagaagattcagcagaagcgacgagctgaccagacacctgagaatccacaccggccacaagcccttccagtgcagaatctgcatgagaagcttcagcagaagcgaccacctgaccacccacatcagaacccacaccggcgagaagcccttcgcctgcgagttctgcggcagaaagttcgccagaagcgacgagagaaagagacacgccaagatccacctgaagcagaaggagaagaaggccgagaagggcggcgcccccagcgccagcagcgccccccccgtgagcctggcccccgtggtgaccacctgcgcctag

SEQ ID NO: 10471 - DNA, 1050 bp, Artificial Sequence
  Description of Artificial Sequence: Synthetic coding sequence
atggagccctgcgccgcctggagccccagaggcggcagagagaacgtgatggacatcggcctgaccaacgagaagcccaaccccgagctgagctacagcggcagcttccagcccgcccccggcaacaagaccgtgacctacctgggcaagttcgccttcgacagccccagcaactggtgccaggacaacatcatcagcctgatgagcgccggcatcctgggcgtgccccccgccagcggcgccctgagcacccagaccagcaccgccagcatggtgcagcccccccagggcgacgtggaggccatgtaccccgccctgcccccctacagcaactgcggcgacctgtacagcgagcccgtgagcttccacgacccccagggcaaccccggcctggcctacagcccccaggactaccagagcgccaagcccgccctggacagcaacctgttccccatgatccccgactacaacctgtaccaccaccccaacgacatgggcagcatccccgagcacaagcccttccagggcatggaccccatcagagtgaaccccccccccatcacccccctggagaccatcaaggccttcaaggacaagcagatccaccccggcttcggcagcctgccccagccccccctgaccctgaagcccatcagacccagaaagtaccccaacagacccagcaagacccccctgcacgagagaccccacgcctgccccgccgagggctgcgacagaagattcagcagaagcgacgagctgaccagacacctgagaatccacaccggccacaagcccttccagtgcagaatctgcatgagaagcttcagcagaagcgaccacctgaccacccacatcagaacccacaccggcgagaagcccttcgcctgcgagttctgcggcagaaagttcgccagaagcgacgagagaaagagacacgccaagatccacctgaagcagaaggagaagaaggccgagaagggcggcgcccccagcgccagcagcgccccccccgtgagcctggcccccgtggtgaccacctgcgcctag

SEQ ID NO: 10472 - DNA, 3696 bp, Artificial Sequence
  Description of Artificial Sequence: Synthetic coding sequence
atggccagcgtgtggaagagactgcagagagtgggcaagcacgccagcaagttccagttcgtggccagctaccaggagctgatggtggagtgcaccaagaagtggcagcccgacaagctggtggtggtgtggaccagaagaagcagaagaaagagcagcaaggcccacagctggcagcccggcatcaagaacccctacagaggcgtggtggtgtggcccgtgcccgagaacatcgagatcaccgtgaccctgttcaaggacccccacgccgaggagttcgaggacaaggagtggaccttcgtgatcgagaacgagagccccagcggcagaagaaaggccctggccaccagcagcatcaacatgaagcagtacgccagccccatgcccacccagaccgacgtgaagctgaagttcaagcccctgagcaagaaggtggtgagcgccgccctgcagttcagcctgagctgcatcttcctgagagagggcaaggccaccgacgaggacatgcagagcctggccagcctgatgagcatgaagcaggccgacatcggcaacctggacgacttcgaggaggacaacgaggacgacgacgagaacagagtgaaccaggaggagaaggccgccaagatcaccgagatcgtgaaccagctgaacgccctgagcagcctggacgaggaccaggacgactgcatcaagcaggccaacatgagaagcgccaagagcgccagcagcagcgaggagctgatcaacaagctgaacttcctggacgaggccgagaaggacctggccaccgtgaacagcaaccccttcgacgaccccgacgccgccgagctgaaccccttcggcgaccccgacagcgaggagcccatcaccgagaccgccagccccagaaagaccgaggacagcttctacaacaacagctacaaccccttcaaggaggtgcagaccccccagtacctgaaccccttcgacgagcccgaggccttcgtgaccatcaaggacagccccccccagagcaccaagagaaagaacatcagacccgtggacatgagcaagtacctgtacgccgacagcagcaagaccgaggaggaggagctggacgagagcaaccccttctacgagcccaagagcacccccccccccaacaacctggtgaaccccgtgcaggagctggagaccgagagaagagtgaagagaaaggcccccgccccccccgtgctgagccccaagaccggcgtgctgaacgagaacaccgtgagcgccggcaaggacctgagcaccagccccaagcccagccccatccccagccccgtgctgggcagaaagcccaacgccagccagagcctgctggtgtggtgcaaggaggtgaccaagaactacagaggcgtgaagatcaccaacttcaccaccagctggagaaacggcctgagcttctgcgccatcctgcaccacttcagacccgacctgatcgactacaagagcctgaacccccaggacatcaaggagaacaacaagaaggcctacgacggcttcgccagcatcggcatcagcagactgctggagcccagcgacatggtgctgctggccatccccgacaagctgaccgtgatgacctacctgtaccagatcagagcccacttcagcggccaggagctgaacgtggtgcagatcgaggagaacagcagcaagagcacctacaaggtgggcaactacgagaccgacaccaacagcagcgtggaccaggagaagttctacgccgagctgagcgacctgaagagagagcccgagctgcagcagcccatcagcggcgccgtggacttcctgagccaggacgacagcgtgttcgtgaacgacagcggcgtgggcgagagcgagagcgagcaccagacccccgacgaccacctgagccccagcaccgccagcccctactgcagaagaaccaagagcgacaccgagccccagaagagccagcagagcagcggcagaaccagcggcagcgacgaccccggcatctgcagcaacaccgacagcacccaggcccaggtgctgctgggcaagaagagactgctgaaggccgagaccctggagctgagcgacctgtacgtgagcgacaagaagaaggacatgagcccccccttcatctgcgaggagaccgacgagcagaagctgcagaccctggacatcggcagcaacctggagaaggagaagctggagaacagcagaagcctggagtgcagaagcgaccccgagagccccatcaagaagaccagcctgagccccaccagcaagctgggctacagctacagcagagacctggacctggccaagaagaagcacgccagcctgagacagaccgagagcgaccccgacgccgacagaaccaccctgaaccacgccgaccacagcagcaagatcgtgcagcacagactgctgagcagacaggaggagctgaaggagagagccagagtgctgctggagcaggccagaagagacgccgccctgaaggccggcaacaagcacaacaccaacaccgccacccccttctgcaacagacagctgagcgaccagcaggacgaggagagaagaagacagctgagagagagagccagacagctgatcgccgaggccagaagcggcgtgaagatgagcgagctgcccagctacggcgagatggccgccgagaagctgaaggagagaagcaaggccagcggcgacgagaacgacaacatcgagatcgacaccaacgaggagatccccgagggcttcgtggtgggcggcggcgacgagctgaccaacctggagaacgacctggacacccccgagcagaacagcaagctggtggacctgaagctgaagaagctgctggaggtgcagccccaggtggccaacagccccagcagcgccgcccagaaggccgtgaccgagagcagcgagcaggacatgaagagcggcaccgaggacctgagaaccgagagactgcagaagaccaccgagagattcagaaaccccgtggtgttcagcaaggacagcaccgtgagaaagacccagctgcagagcttcagccagtacatcgagaacagacccgagatgaagagacagagaagcatccaggaggacaccaagaagggcaacgaggagaaggccgccatcaccgagacccagagaaagcccagcgaggacgaggtgctgaacaagggcttcaaggacaccagccagtacgtggtgggcgagctggccgccctggagaacgagcagaagcagatcgacaccagagccgccctggtggagaagagactgagatacctgatggacaccggcagaaacaccgaggaggaggaggccatgatgcaggagtggttcatgctggtgaacaagaagaacgccctgatcagaagaatgaaccagctgagcctgctggagaaggagcacgacctggagagaagatacgagctgctgaacagagagctgagagccatgctggccatcgaggactggcagaagaccgaggcccagaagagaagagagcagctgctgctggacgagctggtggccctggtgaacaagagagacgccctggtgagagacctggacgcccaggagaagcaggccgaggaggaggacgagcacctggagagaaccctggagcagaacaagggcaagatggccaagaaggaggagaagtgcgtgctgcagtag

SEQ ID NO: 10473 - DNA, 3591 bp, Artificial Sequence
  Description of Artificial Sequence: Synthetic coding sequence
atggccagcgtgtggaagagactgcagagagtgggcaagcacgccagcaagttccagttcgtggccagctaccaggagctgatggtggagtgcaccaagaagtggcagcccgacaagctggtggtggtgtggaccagaagaagcagaagaaagagcagcaaggcccacagctggcagcccggcatcaagaacccctacagaggcgtggtggtgtggcccgtgcccgagaacatcgagatcaccgtgaccctgttcaaggacccccacgccgaggagttcgaggacaaggagtggaccttcgtgatcgagaacgagagccccagcggcagaagaaaggccctggccaccagcagcatcaacatgaagcagtacgccagccccatgcccacccagaccgacgtgaagctgaagttcaagcccctgagcaagaaggtggtgagcgccgccctgcagttcagcctgagctgcatcttcctgagagagggcaaggccaccgacgaggacatgcagagcctggccagcctgatgagcatgaagcaggccgacatcggcaacctggacgacttcgaggaggacaacgaggacgacgacgagaacagagtgaaccaggaggagaaggccgccaagatcaccgagctgatcaacaagctgaacttcctggacgaggccgagaaggacctggccaccgtgaacagcaaccccttcgacgaccccgacgccgccgagctgaaccccttcggcgaccccgacagcgaggagcccatcaccgagaccgccagccccagaaagaccgaggacagcttctacaacaacagctacaaccccttcaaggaggtgcagaccccccagtacctgaaccccttcgacgagcccgaggccttcgtgaccatcaaggacagccccccccagagcaccaagagaaagaacatcagacccgtggacatgagcaagtacctgtacgccgacagcagcaagaccgaggaggaggagctggacgagagcaaccccttctacgagcccaagagcacccccccccccaacaacctggtgaaccccgtgcaggagctggagaccgagagaagagtgaagagaaaggcccccgccccccccgtgctgagccccaagaccggcgtgctgaacgagaacaccgtgagcgccggcaaggacctgagcaccagccccaagcccagccccatccccagccccgtgctgggcagaaagcccaacgccagccagagcctgctggtgtggtgcaaggaggtgaccaagaactacagaggcgtgaagatcaccaacttcaccaccagctggagaaacggcctgagcttctgcgccatcctgcaccacttcagacccgacctgatcgactacaagagcctgaacccccaggacatcaaggagaacaacaagaaggcctacgacggcttcgccagcatcggcatcagcagactgctggagcccagcgacatggtgctgctggccatccccgacaagctgaccgtgatgacctacctgtaccagatcagagcccacttcagcggccaggagctgaacgtggtgcagatcgaggagaacagcagcaagagcacctacaaggtgggcaactacgagaccgacaccaacagcagcgtggaccaggagaagttctacgccgagctgagcgacctgaagagagagcccgagctgcagcagcccatcagcggcgccgtggacttcctgagccaggacgacagcgtgttcgtgaacgacagcggcgtgggcgagagcgagagcgagcaccagacccccgacgaccacctgagccccagcaccgccagcccctactgcagaagaaccaagagcgacaccgagccccagaagagccagcagagcagcggcagaaccagcggcagcgacgaccccggcatctgcagcaacaccgacagcacccaggcccaggtgctgctgggcaagaagagactgctgaaggccgagaccctggagctgagcgacctgtacgtgagcgacaagaagaaggacatgagcccccccttcatctgcgaggagaccgacgagcagaagctgcagaccctggacatcggcagcaacctggagaaggagaagctggagaacagcagaagcctggagtgcagaagcgaccccgagagccccatcaagaagaccagcctgagccccaccagcaagctgggctacagctacagcagagacctggacctggccaagaagaagcacgccagcctgagacagaccgagagcgaccccgacgccgacagaaccaccctgaaccacgccgaccacagcagcaagatcgtgcagcacagactgctgagcagacaggaggagctgaaggagagagccagagtgctgctggagcaggccagaagagacgccgccctgaaggccggcaacaagcacaacaccaacaccgccacccccttctgcaacagacagctgagcgaccagcaggacgaggagagaagaagacagctgagagagagagccagacagctgatcgccgaggccagaagcggcgtgaagatgagcgagctgcccagctacggcgagatggccgccgagaagctgaaggagagaagcaaggccagcggcgacgagaacgacaacatcgagatcgacaccaacgaggagatccccgagggcttcgtggtgggcggcggcgacgagctgaccaacctggagaacgacctggacacccccgagcagaacagcaagctggtggacctgaagctgaagaagctgctggaggtgcagccccaggtggccaacagccccagcagcgccgcccagaaggccgtgaccgagagcagcgagcaggacatgaagagcggcaccgaggacctgagaaccgagagactgcagaagaccaccgagagattcagaaaccccgtggtgttcagcaaggacagcaccgtgagaaagacccagctgcagagcttcagccagtacatcgagaacagacccgagatgaagagacagagaagcatccaggaggacaccaagaagggcaacgaggagaaggccgccatcaccgagacccagagaaagcccagcgaggacgaggtgctgaacaagggcttcaaggacaccagccagtacgtggtgggcgagctggccgccctggagaacgagcagaagcagatcgacaccagagccgccctggtggagaagagactgagatacctgatggacaccggcagaaacaccgaggaggaggaggccatgatgcaggagtggttcatgctggtgaacaagaagaacgccctgatcagaagaatgaaccagctgagcctgctggagaaggagcacgacctggagagaagatacgagctgctgaacagagagctgagagccatgctggccatcgaggactggcagaagaccgaggcccagaagagaagagagcagctgctgctggacgagctggtggccctggtgaacaagagagacgccctggtgagagacctggacgcccaggagaagcaggccgaggaggaggacgagcacctggagagaaccctggagcagaacaagggcaagatggccaagaaggaggagaagtgcgtgctgcagtag

SEQ ID NO: 10474 - DNA, 3483 bp, Artificial Sequence
  Description of Artificial Sequence: Synthetic coding sequence
atggccagcgtgtggaagagactgcagagagtgggcaagcacgccagcaagttccagttcgtggccagctaccaggagctgatggtggagtgcaccaagaagtggcagcccgacaagctggtggtggtgtggaccagaagaagcagaagaaagagcagcaaggcccacagctggcagcccggcatcaagaacccctacagaggcgtggtggtgtggcccgtgcccgagaacatcgagatcaccgtgaccctgttcaaggacccccacgccgaggagttcgaggacaaggagtggaccttcgtgatcgagaacgagagccccagcggcagaagaaaggccctggccaccagcagcatcaacatgaagcagtacgccagccccatgcccacccagaccgacgtgaagctgaagttcaagcccctgagcaagaaggtggtgagcgccgccctgcagttcagcctgagctgcatcttcctgagagagggcaaggccaccgacgaggacatgcagagcctggccagcctgatgagcatgaagcaggccgacatcggcaacctggacgacttcgaggaggacaacgaggacgacgacgagaacagagtgaaccaggaggagaaggccgccaagatcaccgagctgatcaacaagctgaacttcctggacgaggccgagaaggacctggccaccgtgaacagcaaccccttcgacgaccccgacgccgccgagctgaaccccttcggcgaccccgacagcgaggagcccatcaccgagaccgccagccccagaaagaccgaggacagcttctacaacaacagctacaaccccttcaaggaggtgcagaccccccagtacctgaaccccttcgacgagcccgaggccttcgtgaccatcaaggacagccccccccagagcaccaagagaaagaacatcagacccgtggacatgagcaagtacctgtacgccgacagcagcaagaccgaggaggaggagctggacgagagcaaccccttctacgagcccaagagcacccccccccccaacaacctggtgaaccccgtgcaggagctggagaccgagagaagagtgaagagaaaggcccccgccccccccgtgctgagccccaagaccggcgtgctgaacgagaacaccgtgagcgccggcaaggacctgagcaccagccccaagcccagccccatccccagccccgtgctgggcagaaagcccaacgccagccagagcctgctggtgtggtgcaaggaggtgaccaagaactacagaggcgtgaagatcaccaacttcaccaccagctggagaaacggcctgagcttctgcgccatcctgcaccacttcagacccgacctgatcgactacaagagcctgaacccccaggacatcaaggagaacaacaagaaggcctacgacggcttcgccagcatcggcatcagcagactgctggagcccagcgacatggtgctgctggccatccccgacaagctgaccgtgatgacctacctgtaccagatcagagcccacttcagcggccaggagctgaacgtggtgcagatcgaggagaacagcagcaagagcacctacaaggtgggcaactacgagaccgacaccaacagcagcgtggaccaggagaagttctacgccgagctgagcgacctgaagagagagcccgagctgcagcagcccatcagcggcgccgtggacttcctgagccaggacgacagcgtgttcgtgaacgacagcggcgtgggcgagagcgagagcgagcaccagacccccgacgaccacctgagccccagcaccgccagcccctactgcagaagaaccaagagcgacaccgagccccagaagagccagcagagcagcggcagaaccagcggcagcgacgaccccggcatctgcagcaacaccgacagcacccaggcccaggtgctgctgggcaagaagagactgctgaaggccgagaccctggagctgagcgacctgtacgtgagcgacaagaagaaggacatgagcccccccttcatctgcgaggagaccgacgagcagaagctgcagaccctggacatcggcagcaacctggagaaggagaagctggagaacagcagaagcctggagtgcagaagcgaccccgagagccccatcaagaagaccagcctgagccccaccagcaagctgggctacagctacagcagagacctggacctggccaagaagaagcacgccagcctgagacagaccgagagcgaccccgacgccgacagaaccaccctgaaccacgccgaccacagcagcaagatcgtgcagcacagactgctgagcagacaggaggagctgaaggagagagccagagtgctgctggagcaggccagaagagacgccgccctgaaggccggcaacaagcacaacaccaacaccgccacccccttctgcaacagacagctgagcgaccagcaggacgaggagagaagaagacagctgagagagagagccagacagctgatcgccgaggccagaagcggcgtgaagatgagcgagctgcccagctacggcgagatggccgccgagaagctgaaggagagaagcaaggccagcggcgagcagaacagcaagctggtggacctgaagctgaagaagctgctggaggtgcagccccaggtggccaacagccccagcagcgccgcccagaaggccgtgaccgagagcagcgagcaggacatgaagagcggcaccgaggacctgagaaccgagagactgcagaagaccaccgagagattcagaaaccccgtggtgttcagcaaggacagcaccgtgagaaagacccagctgcagagcttcagccagtacatcgagaacagacccgagatgaagagacagagaagcatccaggaggacaccaagaagggcaacgaggagaaggccgccatcaccgagacccagagaaagcccagcgaggacgaggtgctgaacaagggcttcaaggacaccagccagtacgtggtgggcgagctggccgccctggagaacgagcagaagcagatcgacaccagagccgccctggtggagaagagactgagatacctgatggacaccggcagaaacaccgaggaggaggaggccatgatgcaggagtggttcatgctggtgaacaagaagaacgccctgatcagaagaatgaaccagctgagcctgctggagaaggagcacgacctggagagaagatacgagctgctgaacagagagctgagagccatgctggccatcgaggactggcagaagaccgaggcccagaagagaagagagcagctgctgctggacgagctggtggccctggtgaacaagagagacgccctggtgagagacctggacgcccaggagaagcaggccgaggaggaggacgagcacctggagagaaccctggagcagaacaagggcaagatggccaagaaggaggagaagtgcgtgctgcagtag

SEQ ID NO: 10475 - DNA, 3591 bp, Artificial Sequence; identical to SEQ ID NO: 10473
  Description of Artificial Sequence: Synthetic coding sequence

SEQ ID NO: 10476 - DNA, 933 bp, Artificial Sequence
  Description of Artificial Sequence: Synthetic coding sequence
atggccagcgtgtggaagagactgcagagagtgggcaagcacgccagcaagttccagttcgtggccagctaccaggagctgatggtggagtgcaccaagaagtggcagcccgacaagctggtggtggtgtggaccagaagaagcagaagaaagagcagcaaggcccacagctggcagcccggcatcaagaacccctacagaggcgtggtggtgtggcccgtgcccgagaacatcgagatcaccgtgaccctgttcaaggacccccacgccgaggagttcgaggacaaggagtggaccttcgtgatcgagaacgagagccccagcggcagaagaaaggccctggccaccagcagcatcaacatgaagcagtacgccagccccatgcccacccagaccgacgtgaagctgaagttcaagcccctgagcaagaaggtggtgagcgccgccctgcagttcagcctgagctgcatcttcctgagagagggcaaggccaccgacgaggacatgcagagcctggccagcctgatgagcatgaagcaggccgacatcggcaacctggacgacttcgaggaggacaacgaggacgacgacgagaacagagtgaaccaggaggagaaggccgccaagatcaccgagctgatcaacaagctgaacttcctggacgaggccgagaaggacctggccaccgtgaacagcaaccccttcgacgaccccgacgccgccgagctgaaccccttcggcgaccccgacagcgaggagcccatcaccgagaccgccagccccagaaagaccgaggacagcttctacaacaacagctacaaccccttcaaggaggtgcagaccccccagtacctgaaccccttcgacgagcccgaggccttcgtgaccatcaaggacagccccccccagagcaccaagagaaagaacatctag

SEQ ID NO: 10477 - DNA, 234 bp, Artificial Sequence
  Description of Artificial Sequence: Synthetic coding sequence
atggccagcgtgtggaagagactgcagagagtgggcaagcacgccagcaagttccagttcgtggccagctaccaggagctgatggtggagtgcaccaagaagtggcagcccgacaagctggtggtggtgtggaccagaagaagcagaagaaagagcagcaaggcccacagctggcagcccggcatcaagaacccctacagaggcgtggtggtgtggcccgtgcccgagaactag

SEQ ID NO: 10478 - DNA, 3483 bp, Artificial Sequence; identical to SEQ ID NO: 10474
  Description of Artificial Sequence: Synthetic coding sequence

SEQ ID NO: 10479 - DNA, 609 bp, Artificial Sequence
  Description of Artificial Sequence: Synthetic coding sequence
atgaagagacagagaagcatccaggaggacaccaagaagggcaacgaggagaaggccgccatcaccgagacccagagaaagcccagcgaggacgaggtgctgaacaagggcttcaaggacaccagccagtacgtggtgggcgagctggccgccctggagaacgagcagaagcagatcgacaccagagccgccctggtggagaagagactgagatacctgatggacaccggcagaaacaccgaggaggaggaggccatgatgcaggagtggttcatgctggtgaacaagaagaacgccctgatcagaagaatgaaccagctgagcctgctggagaaggagcacgacctggagagaagatacgagctgctgaacagagagctgagagccatgctggccatcgaggactggcagaagaccgaggcccagaagagaagagagcagctgctgctggacgagctggtggccctggtgaacaagagagacgccctggtgagagacctggacgcccaggagaagcaggccgaggaggaggacgagcacctggagagaaccctggagcagaacaagggcaagatggccaagaaggaggagaagtgcgtgctgcagtag

SEQ ID NO: 10480 - DNA, 1287 bp, Artificial Sequence
  Description of Artificial Sequence: Synthetic coding sequence
atggaccccagcgtgaccctgtggcagttcctgctgcagctgctgagagagcagggcaacggccacatcatcagctggaccagcagagacggcggcgagttcaagctggtggacgccgaggaggtggccagactgtggggcctgagaaagaacaagaccaacatgaactacgacaagctgagcagagccctgagatactactacgacaagaacatcatcagaaaggtgagcggccagaagttcgtgtacaagttcgtgagctaccccgaggtggccggctgcagcaccgaggactgccccccccagcccgaggtgagcgtgaccagcaccatgcccaacgtggcccccgccgccatccacgccgcccccggcgacaccgtgagcggcaagcccggcacccccaagggcgccggcatggccggccccggcggcctggccagaagcagcagaaacgagtacatgagaagcggcctgtacagcaccttcaccatccagagcctgcagccccagccccccccccaccccagacccgccgtggtgctgcccagcgccgcccccgccggcgccgccgccccccccagcggcagcagaagcaccagccccagccccctggaggcctgcctggaggccgaggaggccggcctgcccctgcaggtgatcctgaccccccccgaggcccccaacctgaagagcgaggagctgaacgtggagcccggcctgggcagagccctgccccccgaggtgaaggtggagggccccaaggaggagctggaggtggccggcgagagaggcttcgtgcccgagaccaccaaggccgagcccgaggtgcccccccaggagggcgtgcccgccagactgcccgccgtggtgatggacaccgccggccaggccggcggccacgccgccagcagccccgagatcagccagccccagaagggcagaaagcccagagacctggagctgcccctgagccccagcctgctgggcggccccggccccgagagaacccccggcagcggcagcggcagcggcctgcaggcccccggccccgccctgacccccagcctgctgcccacccacaccctgacccccgtgctgctgacccccagcagcctgccccccagcatccacttctggagcaccctgagccccatcgcccccagaagccccgccaagctgagcttccagttccccagcagcggcagcgcccaggtgcacatccccagcatcagcgtggacggcctgagcacccccgtggtgctgagccccggcccccagaagccctag

SEQ ID NO: 10481 - DNA, 288 bp, Artificial Sequence
  Description of Artificial Sequence: Synthetic coding sequence
atggaccccagcgtgaccctgtggcagttcctgctgcagctgctgagagagcagggcaacggccacatcatcagctggaccagcagagacggcggcgagttcaagctggtggacgccgaggaggtggccagactgtggggcctgagaaagaacaagaccaacatgaactacgacaagctgagcagagccctgagatactactacgacaagaacatcatcagaaaggtgagcggccagaagttcgtgtacaagttcgtgagctaccccgagagccactgcgccccctag

SEQ ID NO: 10482 - DNA, 1287 bp, Artificial Sequence; identical to SEQ ID NO: 10480
  Description of Artificial Sequence: Synthetic coding sequence

SEQ ID NO: 10483 - DNA, 366 bp, Artificial Sequence
  Description of Artificial Sequence: Synthetic coding sequence
atggacaccgccggccaggccggcggccacgccgccagcagccccgagatcagccagccccagaagggcagaaagcccagagacctggagctgcccctgagccccagcctgctgggcggccccggccccgagagaacccccgccctgctgcccacccacaccctgacccccgtgctgctgacccccagcagcctgccccccagcatccacttctggagcaccctgagccccatcgcccccagaagccccgccaagctgagcttccagttccccagcagcggcagcgcccaggtgcacatccccagcatcagcgtggacggcctgagcacccccgtggtgctgagccccggcccccagaagccctag

SEQ ID NO: 10484 - DNA, 1713 bp, Artificial Sequence
  Description of Artificial Sequence: Synthetic coding sequence
atgagcgagcagagcatctgccaggccagagccgccgtgatggtgtacgacgacgccaacaagaagtgggtgcccgccggcggcagcaccggcttcagcagagtgcacatctaccaccacaccggcaacaacaccttcagagtggtgggcagaaagatccaggaccaccaggtggtgatcaactgcgccatccccaagggcctgaagtacaaccaggccacccagaccttccaccagtggagagacgccagacaggtgtacggcctgaacttcggcagcaaggaggacgccaacgtgttcgccagcgccatgatgcacgccctggaggtgctgaacagccaggagaccggccccaccctgcccagacagaacagccagctgcccgcccaggtgcagaacggccccagccaggaggagctggagatccagagaagacagctgcaggagcagcagagacagaaggagctggagagagagagactggagagagagagaatggagagagagagactggagagagagagactggagagagagagactggagagagagagactggagcaggagcagctggagagagagagacaggagagagagagacaggagagactggagagacaggagagactggagagacaggagagactggagagacaggagagactggacagagagagacaggagagacaggagagagagagactggagagactggagagagagagacaggagagagagagacaggagcagctggagagagagcagctggagtgggagagagagagaagaatcagcagcgccgccgcccccgccagcgtggagacccccctgaacagcgtgctgggcgacagcagcgccagcgagcccggcctgcaggccgccagccagcccgccgagacccccagccagcagggcatcgtgctgggccccctggccccccccccccccccccccctgccccccggccccgcccaggccagcgtggccctgccccccccccccggcccccccccccccccccccctgcccagcaccggccccccccccccccccccccccccccccctgcccaaccaggtgccccccccccccccccccccccccgccccccccctgcccgccagcggcttcttcctggccagcatgagcgaggacaacagacccctgaccggcctggccgccgccatcgccggcgccaagctgagaaaggtgagcagaatggaggacaccagcttccccagcggcggcaacgccatcggcgtgaacagcgccagcagcaagaccgacaccggcagaggcaacggccccctgcccctgggcggcagcggcctgatggaggagatgagcgccctgctggccagaagaagaagaatcgccgagaagggcagcaccatcgagaccgagcagaaggaggacaagggcgaggacagcgagcccgtgaccagcaaggccagcagcaccagcacccccgagcccaccagaaagccctgggagagaaccaacaccatgaacggcagcaagagccccgtgatcagcagacccaagagcacccccctgagccagcccagcgccaacggcgtgcagaccgagggcctggactacgacagactgaagcaggacatcctggacgagatgagaaaggagctgaccaagctgaaggaggagctgatcgacgccatcagacaggagctgagcaagagcaacaccgcctag

SEQ ID NO: 10485 - DNA, 1776 bp, Artificial Sequence
  Description of Artificial Sequence: Synthetic coding sequence
atgagcgagcagagcatctgccaggccagagccgccgtgatggtgtacgacgacgccaacaagaagtgggtgcccgccggcggcagcaccggcttcagcagagtgcacatctaccaccacaccggcaacaacaccttcagagtggtgggcagaaagatccaggaccaccaggtggtgatcaactgcgccatccccaagggcctgaagtacaaccaggccacccagaccttccaccagtggagagacgccagacaggtgtacggcctgaacttcggcagcaaggaggacgccaacgtgttcgccagcgccatgatgcacgccctggaggtgctgaacagccaggagaccggccccaccctgcccagacagaacagccagctgcccgcccaggtgcagaacggccccagccaggaggagctggagatccagagaagacagctgcaggagcagcagagacagaaggagctggagagagagagactggagagagagagaatggagagagagagactggagagagagagactggagagagagagactggagagagagagactggagcaggagcagctggagagagagagacaggagagagagagacaggagagactggagagacaggagagactggagagacaggagagactggagagacaggagagactggacagagagagacaggagagacaggagagagagagactggagagactggagagagagagacaggagagagagagacaggagcagctggagagagagcagctggagtgggagagagagagaagaatcagcagcgccgccgcccccgccagcgtggagacccccctgaacagcgtgctgggcgacagcagcgccagcgagcccggcctgcaggccgccagccagcccgccgagacccccagccagcagggcatcgtgctgggccccctggccccccccccccccccccccctgccccccggccccgcccaggccagcgtggccctgccccccccccccggcccccccccccccccccccctgcccagcaccggccccccccccccccccccccccccccccctgcccaaccaggtgccccccccccccccccccccccccgccccccccctgcccgccagcggcttcttcctggccagcatgagcgaggacaacagacccctgaccggcctggccgccgccatcgccggcgccaagctgagaaaggtgagcagaatggaggacaccagcttccccagcggcggcaacgccatcggcgtgaacagcgccagcagcaagaccgacaccggcagaggcaacggccccctgcccctgggcggcagcggcctgatggaggagatgagcgccctgctggccagaagaagaagaatcgccgagaagggcagcaccatcgagaccgagcagaaggaggacaagggcgaggacagcgagcccgtgaccagcaaggccagcagcaccagcacccccgagcccaccagaaagccctgggagagaaccaacaccatgaacggcagcaagagccccgtgatcagcagaagagacagccccagaaagaaccagatcgtgttcgacaacagaagctacgacagcctgcacagacccaagagcacccccctgagccagcccagcgccaacggcgtgcagaccgagggcctggactacgacagactgaagcaggacatcctggacgagatgagaaaggagctgaccaagctgaaggaggagctgatcgacgccatcagacaggagctgagcaagagcaacaccgcctag

SEQ ID NO: 10486 - DNA, 1599 bp, Artificial Sequence
  Description of Artificial Sequence: Synthetic coding sequence
agcgagcagagcatctgccaggccagagccgccgtgatggtgtacgacgacgccaacaagaagtgggtgcccgccggcggcagcaccggcttcagcagagtgcacatctaccaccacaccggcaacaacaccttcagagtggtgggcagaaagatccaggaccaccaggtggtgatcaactgcgccatccccaagggcctgaagtacaaccaggccacccagaccttccaccagtggagagacgccagacaggtgtacggcctgaacttcggcagcaaggaggacgccaacgtgttcgccagcgccatgatgcacgccctggaggtgctgaacagccaggagaccggccccaccctgcccagacagaacagccagctgcccgcccaggtgcagaacggccccagccaggaggagctggagatccagagaagacagctgcaggagcagcagagacagaaggagctggagagagagagactggagagagagagaatggagagagagagactggagagagagagactggagagagagagactggagagagagagactggagcaggagcagctggagagagagagacaggagagagagagacaggagagactggagagacaggagagactggagagacaggagagactggagagacaggagagactggacagagagagacaggagagacaggagagagagagactggagagactggagagagagagacaggagagagagagacaggagcagctggagagagagcagctggagtgggagagagagagaagaatcagcagcgccggcatcgtgctgggccccctggccccccccccccccccccccctgccccccggccccgcccaggccagcgtggccctgccccccccccccggcccccccccccccccccccctgcccagcaccggccccccccccccccccccccccccccccctgcccaaccaggtgccccccccccccccccccccccccgccccccccctgcccgccagcggcttcttcctggccagcatgagcgaggacaacagacccctgaccggcctggccgccgccatcgccggcgccaagctgagaaaggtgagcagaatggaggacaccagcttccccagcggcggcaacgccatcggcgtgaacagcgccagcagcaagaccgacaccggcagaggcaacggccccctgcccctgggcggcagcggcctgatggaggagatgagcgccctgctggccagaagaagaagaatcgccgagaagggcagcaccatcgagaccgagcagaaggaggacaagggcgaggacagcgagcccgtgaccagcaaggccagcagcaccagcacccccgagcccaccagaaagccctgggagagaaccaacaccatgaacggcagcaagagccccgtgatcagcagacccaagagcacccccctgagccagcccagcgccaacggcgtgcagaccgagggcctggactacgacagactgaagcaggacatcctggacgagatgagaaaggagctgaccaagctgaaggaggagctgatcgacgccatcagacaggagctgagcaagagcaacaccgcctag

SEQ ID NO: 10487 - DNA, 1878 bp, Artificial Sequence
  Description of Artificial Sequence: Synthetic coding sequence
atggacagaggcaccctgcccctggccgtggccctgctgctggccagctgcagcctgagccccaccagcctggccgagaccgtgcactgcgacctgcagcccgtgggccccgagagaggcgaggtgacctacaccaccagccaggtgagcaagggctgcgtggcccaggcccccaacgccatcctggaggtgcacgtgctgttcctggagttccccaccggccccagccagctggagctgaccctgcaggccagcaagcagaacggcacctggcccagagaggtgctgctggtgctgagcgtgaacagcagcgtgttcctgcacctgcaggccctgggcatccccctgcacctggcctacaacagcagcctggtgaccttccaggagccccccggcgtgaacaccaccgagctgcccagcttccccaagacccagatcctggagtgggccgccgagagaggccccatcaccagcgccgccgagctgaacgacccccagagcatcctgctgagactgggccaggcccagggcagcctgagcttctgcatgctggaggccagccaggacatgggcagaaccctggagtggagacccagaacccccgccctggtgagaggctgccacctggagggcgtggccggccacaaggaggcccacatcctgagagtgctgcccggccacagcgccggccccagaaccgtgaccgtgaaggtggagctgagctgcgcccccggcgacctggacgccgtgctgatcctgcagggccccccctacgtgagctggctgatcgacgccaaccacaacatgcagatctggaccaccggcgagtacagcttcaagatcttccccgagaagaacatcagaggcttcaagctgcccgacaccccccagggcctgctgggcgaggccagaatgctgaacgccagcatcgtggccagcttcgtggagctgcccctggccagcatcgtgagcctgcacgccagcagctgcggcggcagactgcagaccagccccgcccccatccagaccaccccccccaaggacacctgcagccccgagctgctgatgagcctgatccagaccaagtgcgccgacgacgccatgaccctggtgctgaagaaggagctggtggcccacctgaagtgcaccatcaccggcctgaccttctgggaccccagctgcgaggccgaggacagaggcgacaagttcgtgctgagaagcgcctacagcagctgcggcatgcaggtgagcgccagcatgatcagcaacgaggccgtggtgaacatcctgagcagcagcagcccccagagaaagaaggtgcactgcctgaacatggacagcctgagcttccagctgggcctgtacctgagcccccacttcctgcaggccagcaacaccatcgagcccggccagcagagcttcgtgcaggtgagagtgagccccagcgtgagcgagttcctgctgcagctggacagctgccacctggacctgggccccgagggcggcaccgtggagctgatccagggcagagccgccaagggcaactgcgtgagcctgctgagccccagccccgagggcgaccccagattcagcttcctgctgcacttctacaccgtgcccatccccaagaccggcaccctgagctgcaccgtggccctgagacccaagaccggcagccaggaccaggaggtgcacagaaccgtgttcatgagactgaacatcatcagccccgacctgagcggctgcaccagcaagggcctggtgctgcccgccgtgctgggcatcaccttcggcgccttcctgatcggcgccctgctgaccgccgccctgtggtacatctacagccacaccagagagtaccccagacccccccagtag

SEQ ID NO: 10488 - DNA, 1977 bp, Artificial Sequence
  Description of Artificial Sequence: Synthetic coding sequence
atggacagaggcaccctgcccctggccgtggccctgctgctggccagctgcagcctgagccccaccagcctggccgagaccgtgcactgcgacctgcagcccgtgggccccgagagaggcgaggtgacctacaccaccagccaggtgagcaagggctgcgtggcccaggcccccaacgccatcctggaggtgcacgtgctgttcctggagttccccaccggccccagccagctggagctgaccctgcaggccagcaagcagaacggcacctggcccagagaggtgctgctggtgctgagcgtgaacagcagcgtgttcctgcacctgcaggccctgggcatccccctgcacctggcctacaacagcagcctggtgaccttccaggagccccccggcgtgaacaccaccgagctgcccagcttccccaagacccagatcctggagtgggccgccgagagaggccccatcaccagcgccgccgagctgaacgacccccagagcatcctgctgagactgggccaggcccagggcagcctgagcttctgcatgctggaggccagccaggacatgggcagaaccctggagtggagacccagaacccccgccctggtgagaggctgccacctggagggcgtggccggccacaaggaggcccacatcctgagagtgctgcccggccacagcgccggccccagaaccgtgaccgtgaaggtggagctgagctgcgcccccggcgacctggacgccgtgctgatcctgcagggccccccctacgtgagctggctgatcgacgccaaccacaacatgcagatctggaccaccggcgagtacagcttcaagatcttccccgagaagaacatcagaggcttcaagctgcccgacaccccccagggcctgctgggcgaggccagaatgctgaacgccagcatcgtggccagcttcgtggagctgcccctggccagcatcgtgagcctgcacgccagcagctgcggcggcagactgcagaccagccccgcccccatccagaccaccccccccaaggacacctgcagccccgagctgctgatgagcctgatccagaccaagtgcgccgacgacgccatgaccctggtgctgaagaaggagctggtggcccacctgaagtgcaccatcaccggcctgaccttctgggaccccagctgcgaggccgaggacagaggcgacaagttcgtgctgagaagcgcctacagcagctgcggcatgcaggtgagcgccagcatgatcagcaacgaggccgtggtgaacatcctgagcagcagcagcccccagagaaagaaggtgcactgcctgaacatggacagcctgagcttccagctgggcctgtacctgagcccccacttcctgcaggccagcaacaccatcgagcccggccagcagagcttcgtgcaggtgagagtgagccccagcgtgagcgagttcctgctgcagctggacagctgccacctggacctgggccccgagggcggcaccgtggagctgatccagggcagagccgccaagggcaactgcgtgagcctgctgagccccagccccgagggcgaccccagattcagcttcctgctgcacttctacaccgtgcccatccccaagaccggcaccctgagctgcaccgtggccctgagacccaagaccggcagccaggaccaggaggtgcacagaaccgtgttcatgagactgaacatcatcagccccgacctgagcggctgcaccagcaagggcctggtgctgcccgccgtgctgggcatcaccttcggcgccttcctgatcggcgccctgctgaccgccgccctgtggtacatctacagccacaccagaagccccagcaagagagagcccgtggtggccgtggccgcccccgccagcagcgagagcagcagcaccaaccacagcatcggcagcacccagagcaccccctgcagcaccagcagcatggcctag

SEQ ID NO: 10489 - DNA, 1977 bp, Artificial Sequence; identical to SEQ ID NO: 10488
  Description of Artificial Sequence: Synthetic coding sequence

SEQ ID NO: 10490 - DNA, 1431 bp, Artificial Sequence
  Description of Artificial Sequence: Synthetic coding sequence
atgctggaggccagccaggacatgggcagaaccctggagtggagacccagaacccccgccctggtgagaggctgccacctggagggcgtggccggccacaaggaggcccacatcctgagagtgctgcccggccacagcgccggccccagaaccgtgaccgtgaaggtggagctgagctgcgcccccggcgacctggacgccgtgctgatcctgcagggccccccctacgtgagctggctgatcgacgccaaccacaacatgcagatctggaccaccggcgagtacagcttcaagatcttccccgagaagaacatcagaggcttcaagctgcccgacaccccccagggcctgctgggcgaggccagaatgctgaacgccagcatcgtggccagcttcgtggagctgcccctggccagcatcgtgagcctgcacgccagcagctgcggcggcagactgcagaccagccccgcccccatccagaccaccccccccaaggacacctgcagccccgagctgctgatgagcctgatccagaccaagtgcgccgacgacgccatgaccctggtgctgaagaaggagctggtggcccacctgaagtgcaccatcaccggcctgaccttctgggaccccagctgcgaggccgaggacagaggcgacaagttcgtgctgagaagcgcctacagcagctgcggcatgcaggtgagcgccagcatgatcagcaacgaggccgtggtgaacatcctgagcagcagcagcccccagagaaagaaggtgcactgcctgaacatggacagcctgagcttccagctgggcctgtacctgagcccccacttcctgcaggccagcaacaccatcgagcccggccagcagagcttcgtgcaggtgagagtgagccccagcgtgagcgagttcctgctgcagctggacagctgccacctggacctgggccccgagggcggcaccgtggagctgatccagggcagagccgccaagggcaactgcgtgagcctgctgagccccagccccgagggcgaccccagattcagcttcctgctgcacttctacaccgtgcccatccccaagaccggcaccctgagctgcaccgtggccctgagacccaagaccggcagccaggaccaggaggtgcacagaaccgtgttcatgagactgaacatcatcagccccgacctgagcggctgcaccagcaagggcctggtgctgcccgccgtgctgggcatcaccttcggcgccttcctgatcggcgccctgctgaccgccgccctgtggtacatctacagccacaccagaagccccagcaagagagagcccgtggtggccgtggccgcccccgccagcagcgagagcagcagcaccaaccacagcatcggcagcacccagagcaccccctgcagcaccagcagcatggcctag

SEQ ID NO: 10491 - DNA, 639 bp, Artificial Sequence
  Description of Artificial Sequence: Synthetic coding sequence
atggactacctgctgatgatcttcagcctgctgttcgtggcctgccagggcgcccccgagaccgccgtgctgggcgccgagctgagcgccgtgggcgagaacggcggcgagaagcccacccccagccccccctggagactgagaagaagcaagagatgcagctgcagcagcctgatggacaaggagtgcgtgtacttctgccacctggacatcatctgggtgaacacccccgagcacgtggtgccctacggcctgggcagccccagaagcaagagagccctggagaacctgctgcccaccaaggccaccgacagagagaacagatgccagtgcgccagccagaaggacaagaagtgctggaacttctgccaggccggcaaggagctgagagccgaggacatcatggagaaggactggaacaaccacaagaagggcaaggactgcagcaagctgggcaagaagtgcatctaccagcagctggtgagaggcagaaagatcagaagaagcagcgaggagcacctgagacagaccagaagcgagaccatgagaaacagcgtgaagagcagcttccacgaccccaagctgaagggcaagcccagcagagagagatacgtgacccacaacagagcccactggtag

SEQ ID NO: 10492 - DNA, 1329 bp, Artificial Sequence
  Description of Artificial Sequence: Synthetic coding sequence
atgcagcccccccccagcctgtgcggcagagccctggtggccctggtgctggcctgcggcctgagcagaatctggggcgaggagagaggcttcccccccgacagagccacccccctgctgcagaccgccgagatcatgaccccccccaccaagaccctgtggcccaagggcagcaacgccagcctggccagaagcctggcccccgccgaggtgcccaagggcgacagaaccgccggcagcccccccagaaccatcagcccccccccctgccagggccccatcgagatcaaggagaccttcaagtacatcaacaccgtggtgagctgcctggtgttcgtgctgggcatcatcggcaacagcaccctgctgagaatcatctacaagaacaagtgcatgagaaacggccccaacatcctgatcgccagcctggccctgggcgacctgctgcacatcgtgatcgacatccccatcaacgtgtacaagctgctggccgaggactggcccttcggcgccgagatgtgcaagctggtgcccttcatccagaaggccagcgtgggcatcaccgtgctgagcctgtgcgccctgagcatcgacagatacagagccgtggccagctggagcagaatcaagggcatcggcgtgcccaagtggaccgccgtggagatcgtgctgatctgggtggtgagcgtggtgctggccgtgcccgaggccatcggcttcgacatcatcaccatggactacaagggcagctacctgagaatctgcctgctgcaccccgtgcagaagaccgccttcatgcagttctacaagaccgccaaggactggtggctgttcagcttctacttctgcctgcccctggccatcaccgccttcttctacaccctgatgacctgcgagatgctgagaaagaagagcggcatgcagatcgccctgaacgaccacctgaagcagagaagagaggtggccaagaccgtgttctgcctggtgctggtgttcgccctgtgctggctgcccctgcacctgagcagaatcctgaagctgaccctgtacaaccagaacgaccccaacagatgcgagctgctgagcttcctgctggtgctggactacatcggcatcaacatggccagcctgaacagctgcatcaaccccatcgccctgtacctggtgagcaagagattcaagaactgcttcaagagctgcctgtgctgctggtgccagagcttcgaggagaagcagagcctggaggagaagcagagctgcctgaagttcaaggccaacgaccacggctacgacaacttcagaagcagcaacaagtacagcagcagctag

SEQ ID NO: 10493 - DNA, 1599 bp, Artificial Sequence
  Description of Artificial Sequence: Synthetic coding sequence
atgaacaagagcacctgcctgatggccgccgagacccccagcaagagatggagactgcactgcctggccttcagccagagattcgtgagagccggccccgcctgcagcagcagagaggcctgcagcagccccagagccggctggaaccccgccggcttcagactgcccggcagatggagccccttcgtggccctgcacctggtgtgccagatcagagaggccctgaagctgagaagcggccacagaacccccagcggcgccggcagcagcatgcagcccccccccagcctgtgcggcagagccctggtggccctggtgctggcctgcggcctgagcagaatctggggcgaggagagaggcttcccccccgacagagccacccccctgctgcagaccgccgagatcatgaccccccccaccaagaccctgtggcccaagggcagcaacgccagcctggccagaagcctggcccccgccgaggtgcccaagggcgacagaaccgccggcagcccccccagaaccatcagcccccccccctgccagggccccatcgagatcaaggagaccttcaagtacatcaacaccgtggtgagctgcctggtgttcgtgctgggcatcatcggcaacagcaccctgctgagaatcatctacaagaacaagtgcatgagaaacggccccaacatcctgatcgccagcctggccctgggcgacctgctgcacatcgtgatcgacatccccatcaacgtgtacaagctgctggccgaggactggcccttcggcgccgagatgtgcaagctggtgcccttcatccagaaggccagcgtgggcatcaccgtgctgagcctgtgcgccctgagcatcgacagatacagagccgtggccagctggagcagaatcaagggcatcggcgtgcccaagtggaccgccgtggagatcgtgctgatctgggtggtgagcgtggtgctggccgtgcccgaggccatcggcttcgacatcatcaccatggactacaagggcagctacctgagaatctgcctgctgcaccccgtgcagaagaccgccttcatgcagttctacaagaccgccaaggactggtggctgttcagcttctacttctgcctgcccctggccatcaccgccttcttctacaccctgatgacctgcgagatgctgagaaagaagagcggcatgcagatcgccctgaacgaccacctgaagcagagaagagaggtggccaagaccgtgttctgcctggtgctggtgttcgccctgtgctggctgcccctgcacctgagcagaatcctgaagctgaccctgtacaaccagaacgaccccaacagatgcgagctgctgagcttcctgctggtgctggactacatcggcatcaacatggccagcctgaacagctgcatcaaccccatcgccctgtacctggtgagcaagagattcaagaactgcttcaagagctgcctgtgctgctggtgccagagcttcgaggagaagcagagcctggaggagaagcagagctgcctgaagttcaaggccaacgaccacggctacgacaacttcagaagcagcaacaagtacagcagcagctag

SEQ ID NO: 10494 - DNA, 1311 bp, Artificial Sequence
  Description of Artificial Sequence: Synthetic coding sequence
atgcagcccccccccagcctgtgcggcagagccctggtggccctggtgctggcctgcggcctgagcagaatctggggcgaggagagaggcttcccccccgacagagccacccccctgctgcagaccgccgagatcatgaccccccccaccaagaccctgtggcccaagggcagcaacgccagcctggccagaagcctggcccccgccgaggtgcccaagggcgacagaaccgccggcagcccccccagaaccatcagcccccccccctgccagggccccatcgagatcaaggagaccttcaagtacatcaacaccgtggtgagctgcctggtgttcgtgctgggcatcatcggcaacagcaccctgctgagaatcatctacaagaacaagtgcatgagaaacggccccaacatcctgatcgccagcctggccctgggcgacctgctgcacatcgtgatcgacatccccatcaacgtgtacaagctgctggccgaggactggcccttcggcgccgagatgtgcaagctggtgcccttcatccagaaggccagcgtgggcatcaccgtgctgagcctgtgcgccctgagcatcgacagatacagagccgtggccagctggagcagaatcaagggcatcggcgtgcccaagtggaccgccgtggagatcgtgctgatctgggtggtgagcgtggtgctggccgtgcccgaggccatcggcttcgacatcatcaccatggactacaagggcagctacctgagaatctgcctgctgcaccccgtgcagaagaccgccttcatgcagttctacaagaccgccaaggactggtggctgttcagcttctacttctgcctgcccctggccatcaccgccttcttctacaccctgatgacctgcgagatgctgagaaagaagagcggcatgcagatcgccctgaacgaccacctgaagcagagaagagaggtggccaagaccgtgttctgcctggtgctggtgttcgccctgtgctggctgcccctgcacctgagcagaatcctgaagctgaccctgtacaaccagaacgaccccaacagatgcgagctgctgagcttcctgctggtgctggactacatcggcatcaacatggccagcctgaacagctgcatcaaccccatcgccctgtacctggtgagcaagagattcaagaactgcttcaaggccggcccccacgtgggcaacaagctggtgatgctgttcagcgtgaacatcgagtgcgacggcaccgtgaaccagaaccccaccatgtggcccgagagaaagagcaacaacaactag

SEQ ID NO: 10495 - DNA, 2787 bp, Artificial Sequence
  Description of Artificial Sequence: Synthetic coding sequence
atggccctgagaagactgggcgccgccctgctgctgctgcccctgctggccgccgtggaggagaccctgatggacagcaccaccgccaccgccgagctgggctggatggtgcacccccccagcggctgggaggaggtgagcggctacgacgagaacatgaacaccatcagaacctaccaggtgtgcaacgtgttcgagagcagccagaacaactggctgagaaccaagttcatcagaagaagaggcgcccacagaatccacgtggagatgaagttcagcgtgagagactgcagcagcatccccagcgtgcccggcagctgcaaggagaccttcaacctgtactactacgaggccgacttcgacagcgccaccaagaccttccccaactggatggagaacccctgggtgaaggtggacaccatcgccgccgacgagagcttcagccaggtggacctgggcggcagagtgatgaagatcaacaccgaggtgagaagcttcggccccgtgagcagaagcggcttctacctggccttccaggactacggcggctgcatgagcctgatcgccgtgagagtgttctacagaaagtgccccagaatcatccagaacggcgccatcttccaggagaccctgagcggcgccgagagcaccagcctggtggccgccagaggcagctgcatcgccaacgccgaggaggtggacgtgcccatcaagctgtactgcaacggcgacggcgagtggctggtgcccatcggcagatgcatgtgcaaggccggcttcgaggccgtggagaacggcaccgtgtgcagaggctgccccagcggcaccttcaaggccaaccagggcgacgaggcctgcacccactgccccatcaacagcagaaccaccagcgagggcgccaccaactgcgtgtgcagaaacggctactacagagccgacctggaccccctggacatgccctgcaccaccatccccagcgccccccaggccgtgatcagcagcgtgaacgagaccagcctgatgctggagtggaccccccccagagacagcggcggcagagaggacctggtgtacaacatcatctgcaagagctgcggcagcggcagaggcgcctgcaccagatgcggcgacaacgtgcagtacgcccccagacagctgggcctgaccgagcccagaatctacatcagcgacctgctggcccacacccagtacaccttcgagatccaggccgtgaacggcgtgaccgaccagagccccttcagcccccagttcgccagcgtgaacatcaccaccaaccaggccgcccccagcgccgtgagcatcatgcaccaggtgagcagaaccgtggacagcatcaccctgagctggagccagcccgaccagcccaacggcgtgatcctggactacgagctgcagtactacgagaaggagctgagcgagtacaacgccaccgccatcaagagccccaccaacaccgtgaccgtgcagggcctgaaggccggcgccatctacgtgttccaggtgagagccagaaccgtggccggctacggcagatacagcggcaagatgtacttccagaccatgaccgaggtgacccccggcatgaagatctacatcgaccccttcacctacgaggaccccaacgaggccgtgagagagttcgccaaggagatcgacatcagctgcgtgaagatcgagcaggtgatcggcgccggcgagttcggcgaggtgtgcagcggccacctgaagctgcccggcaagagagagatcttcgtggccatcaagaccctgaagagcggctacaccgagaagcagagaagagacttcctgagcgaggccagcatcatgggccagttcgaccaccccaacgtgatccacctggagggcgtggtgaccaagagcacccccgtgatgatcatcaccgagttcatggagaacggcagcctggacagcttcctgagacagaacgacggccagttcaccgtgatccagctggtgggcatgctgagaggcatcgccgccggcatgaagtacctggccgacatgaactacgtgcacagagacctggccgccagaaacatcctggtgaacagcaacctggtgtgcaaggtgagcgacttcggcctgagcagattcctggaggacgacaccagcgaccccacctacaccagcgccctgggcggcaagatccccatcagatggaccgcccccgaggccatccagtacagaaagttcaccagcgccagcgacgtgtggagctacggcatcgtgatgtgggaggtgatgagctacggcgagagaccctactgggacatgaccaaccaggacgtgatcaacgccatcgagcaggactacagactgcccccccccatggactgccccagcgccctgcaccagctgatgctggactgctggcagaaggacagaaaccacagacccaagttcggccagatcgtgaacaccctggacaagatgatcagaaaccccaacagcctgaaggccatggcccccctgagcagcggcatcaacctgcccctgctggacagaaccatccccgactacaccagcttcaacaccgtggacgagtggctggaggccatcaagatgggccagtacaaggagagcttcgccaacgccggcttcaccagcttcgacgtggtgagccagatgatgatggaggacatcctgagagtgggcgtgaccctggccggccaccagaagaagatcctgaacagcatccaggtgatgagagcccagatgaaccagatccagagcgtggaggtgtag

SEQ ID NO: 10496 - DNA, 2841 bp, Artificial Sequence
  Description of Artificial Sequence: Synthetic coding sequence
atgtgggtgcccgtgctggccctgcccgtgtgcacctacgccgagaccctgatggacagcaccaccgccaccgccgagctgggctggatggtgcacccccccagcggctgggaggaggtgagcggctacgacgagaacatgaacaccatcagaacctaccaggtgtgcaacgtgttcgagagcagccagaacaactggctgagaaccaagttcatcagaagaagaggcgcccacagaatccacgtggagatgaagttcagcgtgagagactgcagcagcatccccagcgtgcccggcagctgcaaggagaccttcaacctgtactactacgaggccgacttcgacagcgccaccaagaccttccccaactggatggagaacccctgggtgaaggtggacaccatcgccgccgacgagagcttcagccaggtggacctgggcggcagagtgatgaagatcaacaccgaggtgagaagcttcggccccgtgagcagaagcggcttctacctggccttccaggactacggcggctgcatgagcctgatcgccgtgagagtgttctacagaaagtgccccagaatcatccagaacggcgccatcttccaggagaccctgagcggcgccgagagcaccagcctggtggccgccagaggcagctgcatcgccaacgccgaggaggtggacgtgcccatcaagctgtactgcaacggcgacggcgagtggctggtgcccatcggcagatgcatgtgcaaggccggcttcgaggccgtggagaacggcaccgtgtgcagaggctgccccagcggcaccttcaaggccaaccagggcgacgaggcctgcacccactgccccatcaacagcagaaccaccagcgagggcgccaccaactgcgtgtgcagaaacggctactacagagccgacctggaccccctggacatgccctgcaccaccatccccagcgccccccaggccgtgatcagcagcgtgaacgagaccagcctgatgctggagtggaccccccccagagacagcggcggcagagaggacctggtgtacaacatcatctgcaagagctgcggcagcggcagaggcgcctgcaccagatgcggcgacaacgtgcagtacgcccccagacagctgggcctgaccgagcccagaatctacatcagcgacctgctggcccacacccagtacaccttcgagatccaggccgtgaacggcgtgaccgaccagagccccttcagcccccagttcgccagcgtgaacatcaccaccaaccaggccgcccccagcgccgtgagcatcatgcaccaggtgagcagaaccgtggacagcatcaccctgagctggagccagcccgaccagcccaacggcgtgatcctggactacgagctgcagtactacgagaagcaggagctgagcgagtacaacgccaccgccatcaagagccccaccaacaccgtgaccgtgcagggcctgaaggccggcgccatctacgtgttccaggtgagagccagaaccgtggccggctacggcagatacagcggcaagatgtacttccagaccatgaccgaggccgagtaccagaccagcatccaggagaagctgcccctgatcatcggcagcagcgccgccggcctggtgttcctgatcgccgtggtggtgatcgccatcgtgtgcaacagaagaggcttcgagagagccgacagcgagtacaccgacaagctgcagcactacaccagcggccacatgacccccggcatgaagatctacatcgaccccttcacctacgaggaccccaacgaggccgtgagagagttcgccaaggagatcgacatcagctgcgtgaagatcgagcaggtgatcggcgccggcgagttcggcgaggtgtgcagcggccacctgaagctgcccggcaagagagagatcttcgtggccatcaagaccctgaagagcggctacaccgagaagcagagaagagacttcctgagcgaggccagcatcatgggccagttcgaccaccccaacgtgatccacctggagggcgtggtgaccaagagcacccccgtgatgatcatcaccgagttcatggagaacggcagcctggacagcttcctgagacagaacgacggccagttcaccgtgatccagctggtgggcatgctgagaggcatcgccgccggcatgaagtacctggccgacatgaactacgtgcacagagacctggccgccagaaacatcctggtgaacagcaacctggtgtgcaaggtgagcgacttcggcctgagcagattcctggaggacgacaccagcgaccccacctacaccagcgccctgggcggcaagatccccatcagatggaccgcccccgaggccatccagtacagaaagttcaccagcgccagcgacgtgtggagctacggcatcgtgatgtgggaggtgatgagctacggcgagagaccctactgggacatgaccaaccaggacgtgatcaacgccatcgagcaggactacagactgcccccccccatggactgccccagcgccctgcaccagctgatgctggactgctggcagaaggacagaaaccacagacccaagttcggccagatcgtgaacaccctggacaagatgatcagaaaccccaacagcctgaaggccatggcccccctgagcagcggcatcaacctgcccctgctggacagaaccatccccgactacaccagcttcaacaccgtggacgagtggctggaggccatcaagatgggccagtacaaggagagcttcgccaacgccggcttcaccagcttcgacgtggtgagccagatgatgatggagtag

SEQ ID NO: 10497 - DNA, 2961 bp, Artificial Sequence
  Description of Artificial Sequence: Synthetic coding sequence
atggccctgagaagactgggcgccgccctgctgctgctgcccctgctggccgccgtggaggagaccctgatggacagcaccaccgccaccgccgagctgggctggatggtgcacccccccagcggctgggaggaggtgagcggctacgacgagaacatgaacaccatcagaacctaccaggtgtgcaacgtgttcgagagcagccagaacaactggctgagaaccaagttcatcagaagaagaggcgcccacagaatccacgtggagatgaagttcagcgtgagagactgcagcagcatccccagcgtgcccggcagctgcaaggagaccttcaacctgtactactacgaggccgacttcgacagcgccaccaagaccttccccaactggatggagaacccctgggtgaaggtggacaccatcgccgccgacgagagcttcagccaggtggacctgggcggcagagtgatgaagatcaacaccgaggtgagaagcttcggccccgtgagcagaagcggcttctacctggccttccaggactacggcggctgcatgagcctgatcgccgtgagagtgttctacagaaagtgccccagaatcatccagaacggcgccatcttccaggagaccctgagcggcgccgagagcaccagcctggtggccgccagaggcagctgcatcgccaacgccgaggaggtggacgtgcccatcaagctgtactgcaacggcgacggcgagtggctggtgcccatcggcagatgcatgtgcaaggccggcttcgaggccgtggagaacggcaccgtgtgcagaggctgccccagcggcaccttcaaggccaaccagggcgacgaggcctgcacccactgccccatcaacagcagaaccaccagcgagggcgccaccaactgcgtgtgcagaaacggctactacagagccgacctggaccccctggacatgccctgcaccaccatccccagcgccccccaggccgtgatcagcagcgtgaacgagaccagcctgatgctggagtggaccccccccagagacagcggcggcagagaggacctggtgtacaacatcatctgcaagagctgcggcagcggcagaggcgcctgcaccagatgcggcgacaacgtgcagtacgcccccagacagctgggcctgaccgagcccagaatctacatcagcgacctgctggcccacacccagtacaccttcgagatccaggccgtgaacggcgtgaccgaccagagccccttcagcccccagttcgccagcgtgaacatcaccaccaaccaggccgcccccagcgccgtgagcatcatgcaccaggtgagcagaaccgtggacagcatcaccctgagctggagccagcccgaccagcccaacggcgtgatcctggactacgagctgcagtactacgagaaggagctgagcgagtacaacgccaccgccatcaagagccccaccaacaccgtgaccgtgcagggcctgaaggccggcgccatctacgtgttccaggtgagagccagaaccgtggccggctacggcagatacagcggcaagatgtacttccagaccatgaccgaggccgagtaccagaccagcatccaggagaagctgcccctgatcatcggcagcagcgccgccggcctggtgttcctgatcgccgtggtggtgatcgccatcgtgtgcaacagaagaggcttcgagagagccgacagcgagtacaccgacaagctgcagcactacaccagcggccacatgacccccggcatgaagatctacatcgaccccttcacctacgaggaccccaacgaggccgtgagagagttcgccaaggagatcgacatcagctgcgtgaagatcgagcaggtgatcggcgccggcgagttcggcgaggtgtgcagcggccacctgaagctgcccggcaagagagagatcttcgtggccatcaagaccctgaagagcggctacaccgagaagcagagaagagacttcctgagcgaggccagcatcatgggccagttcgaccaccccaacgtgatccacctggagggcgtggtgaccaagagcacccccgtgatgatcatcaccgagttcatggagaacggcagcctggacagcttcctgagacagaacgacggccagttcaccgtgatccagctggtgggcatgctgagaggcatcgccgccggcatgaagtacctggccgacatgaactacgtgcacagagacctggccgccagaaacatcctggtgaacagcaacctggtgtgcaaggtgagcgacttcggcctgagcagattcctggaggacgacaccagcgaccccacctacaccagcgccctgggcggcaagatccccatcagatggaccgcccccgaggccatccagtacagaaagttcaccagcgccagcgacgtgtggagctacggcatcgtgatgtgggaggtgatgagctacggcgagagaccctactgggacatgaccaaccaggacgtgatcaacgccatcgagcaggactacagactgcccccccccatggactgccccagcgccctgcaccagctgatgctggactgctggcagaaggacagaaaccacagacccaagttcggccagatcgtgaacaccctggacaagatgatcagaaaccccaacagcctgaaggccatggcccccctgagcagcggcatcaacctgcccctgctggacagaaccatccccgactacaccagcttcaacaccgtggacgagtggctggaggccatcaagatgggccagtacaaggagagcttcgccaacgccggcttcaccagcttcgacgtggtgagccagatgatgatggaggacatcctgagagtgggcgtgaccctggccggccaccagaagaagatcctgaacagcatccaggtgatgagagcccagatgaaccagatccagagcgtggaggtgtag

SEQ ID NO: 10498 - DNA, 2964 bp, Artificial Sequence
  Description of Artificial Sequence: Synthetic coding sequence
atggccctgagaagactgggcgccgccctgctgctgctgcccctgctggccgccgtggaggagaccctgatggacagcaccaccgccaccgccgagctgggctggatggtgcacccccccagcggctgggaggaggtgagcggctacgacgagaacatgaacaccatcagaacctaccaggtgtgcaacgtgttcgagagcagccagaacaactggctgagaaccaagttcatcagaagaagaggcgcccacagaatccacgtggagatgaagttcagcgtgagagactgcagcagcatccccagcgtgcccggcagctgcaaggagaccttcaacctgtactactacgaggccgacttcgacagcgccaccaagaccttccccaactggatggagaacccctgggtgaaggtggacaccatcgccgccgacgagagcttcagccaggtggacctgggcggcagagtgatgaagatcaacaccgaggtgagaagcttcggccccgtgagcagaagcggcttctacctggccttccaggactacggcggctgcatgagcctgatcgccgtgagagtgttctacagaaagtgccccagaatcatccagaacggcgccatcttccaggagaccctgagcggcgccgagagcaccagcctggtggccgccagaggcagctgcatcgccaacgccgaggaggtggacgtgcccatcaagctgtactgcaacggcgacggcgagtggctggtgcccatcggcagatgcatgtgcaaggccggcttcgaggccgtggagaacggcaccgtgtgcagaggctgccccagcggcaccttcaaggccaaccagggcgacgaggcctgcacccactgccccatcaacagcagaaccaccagcgagggcgccaccaactgcgtgtgcagaaacggctactacagagccgacctggaccccctggacatgccctgcaccaccatccccagcgccccccaggccgtgatcagcagcgtgaacgagaccagcctgatgctggagtggaccccccccagagacagcggcggcagagaggacctggtgtacaacatcatctgcaagagctgcggcagcggcagaggcgcctgcaccagatgcggcgacaacgtgcagtacgcccccagacagctgggcctgaccgagcccagaatctacatcagcgacctgctggcccacacccagtacaccttcgagatccaggccgtgaacggcgtgaccgaccagagccccttcagcccccagttcgccagcgtgaacatcaccaccaaccaggccgcccccagcgccgtgagcatcatgcaccaggtgagcagaaccgtggacagcatcaccctgagctggagccagcccgaccagcccaacggcgtgatcctggactacgagctgcagtactacgagaaggagctgagcgagtacaacgccaccgccatcaagagccccaccaacaccgtgaccgtgcagggcctgaaggccggcgccatctacgtgttccaggtgagagccagaaccgtggccggctacggcagatacagcggcaagatgtacttccagaccatgaccgaggccgagtaccagaccagcatccaggagaagctgcccctgatcatcggcagcagcgccgccggcctggtgttcctgatcgccgtggtggtgatcgccatcgtgtgcaacagaagaagaggcttcgagagagccgacagcgagtacaccgacaagctgcagcactacaccagcggccacatgacccccggcatgaagatctacatcgaccccttcacctacgaggaccccaacgaggccgtgagagagttcgccaaggagatcgacatcagctgcgtgaagatcgagcaggtgatcggcgccggcgagttcggcgaggtgtgcagcggccacctgaagctgcccggcaagagagagatcttcgtggccatcaagaccctgaagagcggctacaccgagaagcagagaagagacttcctgagcgaggccagcatcatgggccagttcgaccaccccaacgtgatccacctggagggcgtggtgaccaagagcacccccgtgatgatcatcaccgagttcatggagaacggcagcctggacagcttcctgagacagaacgacggccagttcaccgtgatccagctggtgggcatgctgagaggcatcgccgccggcatgaagtacctggccgacatgaactacgtgcacagagacctggccgccagaaacatcctggtgaacagcaacctggtgtgcaaggtgagcgacttcggcctgagcagattcctggaggacgacaccagcgaccccacctacaccagcgccctgggcggcaagatccccatcagatggaccgcccccgaggccatccagtacagaaagttcaccagcgccagcgacgtgtggagctacggcatcgtgatgtgggaggtgatgagctacggcgagagaccctactgggacatgaccaaccaggacgtgatcaacgccatcgagcaggactacagactgcccccccccatggactgccccagcgccctgcaccagctgatgctggactgctggcagaaggacagaaaccacagacccaagttcggccagatcgtgaacaccctggacaagatgatcagaaaccccaacagcctgaaggccatggcccccctgagcagcggcatcaacctgcccctgctggacagaaccatccccgactacaccagcttcaacaccgtggacgagtggctggaggccatcaagatgggccagtacaaggagagcttcgccaacgccggcttcaccagcttcgacgtggtgagccagatgatgatggaggacatcctgagagtgggcgtgaccctggccggccaccagaagaagatcctgaacagcatccaggtgatgagagcccagatgaaccagatccagagcgtggaggtgtag

SEQ ID NO: 10499 - DNA, 3168 bp, Artificial Sequence
  Description of Artificial Sequence: Synthetic coding sequence
atggccctgagaagactgggcgccgccctgctgctgctgcccctgctggccgccgtggaggagaccctgatggacagcaccaccgccaccgccgagctgggctggatggtgcacccccccagcggctgggaggaggtgagcggctacgacgagaacatgaacaccatcagaacctaccaggtgtgcaacgtgttcgagagcagccagaacaactggctgagaaccaagttcatcagaagaagaggcgcccacagaatccacgtggagatgaagttcagcgtgagagactgcagcagcatccccagcgtgcccggcagctgcaaggagaccttcaacctgtactactacgaggccgacttcgacagcgccaccaagaccttccccaactggatggagaacccctgggtgaaggtggacaccatcgccgccgacgagagcttcagccaggtggacctgggcggcagagtgatgaagatcaacaccgaggtgagaagcttcggccccgtgagcagaagcggcttctacctggccttccaggactacggcggctgcatgagcctgatcgccgtgagagtgttctacagaaagtgccccagaatcatccagaacggcgccatcttccaggagaccctgagcggcgccgagagcaccagcctggtggccgccagaggcagctgcatcgccaacgccgaggaggtggacgtgcccatcaagctgtactgcaacggcgacggcgagtggctggtgcccatcggcagatgcatgtgcaaggccggcttcgaggccgtggagaacggcaccgtgtgcagaggctgccccagcggcaccttcaaggccaaccagggcgacgaggcctgcacccactgccccatcaacagcagaaccaccagcgagggcgccaccaactgcgtgtgcagaaacggctactacagagccgacctggaccccctggacatgccctgcaccaccatccccagcgccccccaggccgtgatcagcagcgtgaacgagaccagcctgatgctggagtggaccccccccagagacagcggcggcagagaggacctggtgtacaacatcatctgcaagagctgcggcagcggcagaggcgcctgcaccagatgcggcgacaacgtgcagtacgcccccagacagctgggcctgaccgagcccagaatctacatcagcgacctgctggcccacacccagtacaccttcgagatccaggccgtgaacggcgtgaccgaccagagccccttcagcccccagttcgccagcgtgaacatcaccaccaaccaggccgcccccagcgccgtgagcatcatgcaccaggtgagcagaaccgtggacagcatcaccctgagctggagccagcccgaccagcccaacggcgtgatcctggactacgagctgcagtactacgagaaggagctgagcgagtacaacgccaccgccatcaagagccccaccaacaccgtgaccgtgcagggcctgaaggccggcgccatctacgtgttccaggtgagagccagaaccgtggccggctacggcagatacagcggcaagatgtacttccagaccatgaccgaggccgagtaccagaccagcatccaggagaagctgcccctgatcatcggcagcagcgccgccggcctggtgttcctgatcgccgtggtggtgatcgccatcgtgtgcaacagaagaggcttcgagagagccgacagcgagtacaccgacaagctgcagcactacaccagcggccacatgacccccggcatgaagatctacatcgaccccttcacctacgaggaccccaacgaggccgtgagagagttcgccaaggagatcgacatcagctgcgtgaagatcgagcaggtgatcggcgccggcgagttcggcgaggtgtgcagcggccacctgaagctgcccggcaagagagagatcttcgtggccatcaagaccctgaagagcggctacaccgagaagcagagaagagacttcctgagcgaggccagcatcatgggccagttcgaccaccccaacgtgatccacctggagggcgtggtgaccaagagcacccccgtgatgatcatcaccgagttcatggagaacggcagcctggacagcttcctgagacagaacgacggccagttcaccgtgatccagctggtgggcatgctgagaggcatcgccgccggcatgaagtacctggccgacatgaactacgtgcacagagacctggccgccagaaacatcctggtgaacagcaacctggtgtgcaaggtgagcgacttcggcctgagcagattcctggaggacgacaccagcgaccccacctacaccagcgccctgggcggcaagatccccatcagatggaccgcccccgaggccatccagtacagaaagttcaccagcgccagcgacgtgtggagctacggcatcgtgatgtgggaggtgatgagctacggcgagagaccctactgggacatgaccaaccaggacgtgatcaacgccatcgagcaggactacagactgcccccccccatggactgccccagcgccctgcaccagctgatgctggactgctggcagaaggacagaaaccacagacccaagttcggccagatcgtgaacaccctggacaagatgatcagaaaccccaacagcctgaaggccatggcccccctgagcagcggcatcaacctgcccctgctggacagaaccatccccgactacaccagcttcaacaccgtggacgagtggctggaggccatcaagatgggccagtacaaggagagcttcgccaacgccggcttcaccagcttcgacgtggtgagccagatgatgatggaggacatcctgagagtgggcgtgaccctggccggccaccagaagaagatcctgaacagcatccaggtgatgagagcccagatgaaccagatccagagcgtggagggccagcccctggccagaagacccagagccaccggcagaaccaagagatgccagcccagagacgtgaccaagaagacctgcaacagcaacgacggcaagaagaagggcatgggcaagaagaagaccgaccccggcagaggcagagagatccagggcatcttcttcaaggaggacagccacaaggagagcaacgactgcagctgcggcggctag

SEQ ID NO: 10500 - DNA, 1449 bp, Artificial Sequence
  Description of Artificial Sequence: Synthetic coding sequence
atggccctgagaagactgggcgccgccctgctgctgctgcccctgctggccgccgtggaggagaccctgatggacagcaccaccgccaccgccgagctgggctggatggtgcacccccccagcggctgggaggaggtgagcggctacgacgagaacatgaacaccatcagaacctaccaggtgtgcaacgtgttcgagagcagccagaacaactggctgagaaccaagttcatcagaagaagaggcgcccacagaatccacgtggagatgaagttcagcgtgagagactgcagcagcatccccagcgtgcccggcagctgcaaggagaccttcaacctgtactactacgaggccgacttcgacagcgccaccaagaccttccccaactggatggagaacccctgggtgaaggtggacaccatcgccgccgacgagagcttcagccaggtggacctgggcggcagagtgatgaagatcaacaccgaggtgagaagcttcggccccgtgagcagaagcggcttctacctggccttccaggactacggcggctgcatgagcctgatcgccgtgagagtgttctacagaaagtgccccagaatcatccagaacggcgccatcttccaggagaccctgagcggcgccgagagcaccagcctggtggccgccagaggcagctgcatcgccaacgccgaggaggtggacgtgcccatcaagctgtactgcaacggcgacggcgagtggctggtgcccatcggcagatgcatgtgcaaggccggcttcgaggccgtggagaacggcaccgtgtgcagaggctgccccagcggcaccttcaaggccaaccagggcgacgaggcctgcacccactgccccatcaacagcagaaccaccagcgagggcgccaccaactgcgtgtgcagaaacggctactacagagccgacctggaccccctggacatgccctgcaccaccatccccagcgccccccaggccgtgatcagcagcgtgaacgagaccagcctgatgctggagtggaccccccccagagacagcggcggcagagaggacctggtgtacaacatcatctgcaagagctgcggcagcggcagaggcgcctgcaccagatgcggcgacaacgtgcagtacgcccccagacagctgggcctgaccgagcccagaatctacatcagcgacctgctggcccacacccagtacaccttcgagatccaggccgtgaacggcgtgaccgaccagagccccttcagcccccagttcgccagcgtgaacatcaccaccaaccaggccgcccccagcgccgtgagcatcatgcaccaggtgagcagaaccgtggacagcatcaccctgagctggagccagcccgaccagcccaacggcgtgatcctggactacgagctgcagtactacgagaagatgaagacccagagaagctag

SEQ ID NO: 10501 - DNA, 2964 bp, Artificial Sequence
  Description of Artificial Sequence: Synthetic coding sequence
atggagctgagagtgctgctgtgctgggccagcctggccgccgccctggaggagaccctgctgaacaccaagctggagaccgccgacctgaagtgggtgaccttcccccaggtggacggccagtgggaggagctgagcggcctggacgaggagcagcacagcgtgagaacctacgaggtgtgcgacgtgcagagagcccccggccaggcccactggctgagaaccggctgggtgcccagaagaggcgccgtgcacgtgtacgccaccctgagattcaccatgctggagtgcctgagcctgcccagagccggcagaagctgcaaggagaccttcaccgtgttctactacgagagcgacgccgacaccgccaccgccctgacccccgcctggatggagaacccctacatcaaggtggacaccgtggccgccgagcacctgaccagaaagagacccggcgccgaggccaccggcaaggtgaacgtgaagaccctgagactgggccccctgagcaaggccggcttctacctggccttccaggaccagggcgcctgcatggccctgctgagcctgcacctgttctacaagaagtgcgcccagctgaccgtgaacctgaccagattccccgagaccgtgcccagagagctggtggtgcccgtggccggcagctgcgtggtggacgccgtgcccgcccccggccccagccccagcctgtactgcagagaggacggccagtgggccgagcagcccgtgaccggctgcagctgcgcccccggcttcgaggccgccgagggcaacaccaagtgcagagcctgcgcccagggcaccttcaagcccctgagcggcgagggcagctgccagccctgccccgccaacagccacagcaacaccatcggcagcgccgtgtgccagtgcagagtgggctacttcagagccagaaccgaccccagaggcgccccctgcaccaccccccccagcgcccccagaagcgtggtgagcagactgaacggcagcagcctgcacctggagtggagcgcccccctggagagcggcggcagagaggacctgacctacgccctgagatgcagagagtgcagacccggcggcagctgcgccccctgcggcggcgacctgaccttcgaccccggccccagagacctggtggagccctgggtggtggtgagaggcctgagacccgacttcacctacaccttcgaggtgaccgccctgaacggcgtgagcagcctggccaccggccccgtgcccttcgagcccgtgaacgtgaccaccgacagagaggtgccccccgccgtgagcgacatcagagtgaccagaagcagccccagcagcctgagcctggcctgggccgtgcccagagcccccagcggcgccgtgctggactacgaggtgaagtaccacgagaagggcgccgagggccccagcagcgtgagattcctgaagaccagcgagaacagagccgagctgagaggcctgaagagaggcgccagctacctggtgcaggtgagagccagaagcgaggccggctacggccccttcggccaggagcaccacagccagacccagctggacgagagcgagggctggagagagcagctggccctgatcgccggcaccgccgtggtgggcgtggtgctggtgctggtggtgatcgtggtggccgtgctgtgcctgagaaagcagagcaacggcagagaggccgagtacagcgacaagcacggccagtacctgatcggccacggcaccaaggtgtacatcgaccccttcacctacgaggaccccaacgaggccgtgagagagttcgccaaggagatcgacgtgagctacgtgaagatcgaggaggtgatcggcgccggcgagttcggcgaggtgtgcagaggcagactgaaggcccccggcaagaaggagagctgcgtggccatcaagaccctgaagggcggctacaccgagagacagagaagagagttcctgagcgaggccagcatcatgggccagttcgagcaccccaacatcatcagactggagggcgtggtgaccaacagcatgcccgtgatgatcctgaccgagttcatggagaacggcgccctggacagcttcctgagactgaacgacggccagttcaccgtgatccagctggtgggcatgctgagaggcatcgccagcggcatgagatacctggccgagatgagctacgtgcacagagacctggccgccagaaacatcctggtgaacagcaacctggtgtgcaaggtgagcgacttcggcctgagcagattcctggaggagaacagcagcgaccccacctacaccagcagcctgggcggcaagatccccatcagatggaccgcccccgaggccatcgccttcagaaagttcaccagcgccagcgacgcctggagctacggcatcgtgatgtgggaggtgatgagcttcggcgagagaccctactgggacatgagcaaccaggacgtgatcaacgccatcgagcaggactacagactgccccccccccccgactgccccaccagcctgcaccagctgatgctggactgctggcagaaggacagaaacgccagacccagattcccccaggtggtgagcgccctggacaagatgatcagaaaccccgccagcctgaagatcgtggccagagagaacggcggcgccagccaccccctgctggaccagagacagccccactacagcgccttcggcagcgtgggcgagtggctgagagccatcaagatgggcagatacgaggagagcttcgccgccgccggcttcggcagcttcgagctggtgagccagatcagcgccgaggacctgctgagaatcggcgtgaccctggccggccaccagaagaagatcctggccagcgtgcagcacatgaagagccaggccaagcccggcacccccggcggcaccggcggccccgccccccagtactag

SEQ ID NO: 10502 - DNA, 2808 bp, Artificial Sequence
  Description of Artificial Sequence: Synthetic coding sequence
atggagctgagagtgctgctgtgctgggccagcctggccgccgccctggaggagaccctgctgaacaccaagctggagaccgccgacctgaagtgggtgaccttcccccaggtggacggccagtgggaggagctgagcggcctggacgaggagcagcacagcgtgagaacctacgaggtgtgcgacgtgcagagagcccccggccaggcccactggctgagaaccggctgggtgcccagaagaggcgccgtgcacgtgtacgccaccctgagattcaccatgctggagtgcctgagcctgcccagagccggcagaagctgcaaggagaccttcaccgtgttctactacgagagcgacgccgacaccgccaccgccctgacccccgcctggatggagaacccctacatcaaggtggacaccgtggccgccgagcacctgaccagaaagagacccggcgccgaggccaccggcaaggtgaacgtgaagaccctgagactgggccccctgagcaaggccggcttctacctggccttccaggaccagggcgcctgcatggccctgctgagcctgcacctgttctacaagaagtgcgcccagctgaccgtgaacctgaccagattccccgagaccgtgcccagagagctggtggtgcccgtggccggcagctgcgtggtggacgccgtgcccgcccccggccccagccccagcctgtactgcagagaggacggccagtgggccgagcagcccgtgaccggctgcagctgcgcccccggcttcgaggccgccgagggcaacaccaagtgcagagcctgcgcccagggcaccttcaagcccctgagcggcgagggcagctgccagccctgccccgccaacagccacagcaacaccatcggcagcgccgtgtgccagtgcagagtgggctacttcagagccagaaccgaccccagaggcgccccctgcaccaccccccccagcgcccccagaagcgtggtgagcagactgaacggcagcagcctgcacctggagtggagcgcccccctggagagcggcggcagagaggacctgacctacgccctgagatgcagagagtgcagacccggcggcagctgcgccccctgcggcggcgacctgaccttcgaccccggccccagagacctggtggagccctgggtggtggtgagaggcctgagacccgacttcacctacaccttcgaggtgaccgccctgaacggcgtgagcagcctggccaccggccccgtgcccttcgagcccgtgaacgtgaccaccgacagagaggtgccccccgccgtgagcgacatcagagtgaccagaagcagccccagcagcctgagcctggcctgggccgtgcccagagcccccagcggcgccgtgctggactacgaggtgaagtaccacgagaagggcgccgagggccccagcagcgtgagattcctgaagaccagcgagaacagagccgagctgagaggcctgaagagaggcgccagctacctggtgcaggtgagagccagaagcgaggccggctacggccccttcggccaggagcaccacagccagacccagctggacgagagcgagggctggagagagcagctggccctgatcgccggcaccgccgtggtgggcgtggtgctggtgctggtggtgatcgtggtggccgtgctgtgcctgagaaagcagagcaacggcagagaggccgagtacagcgacaagcacggccagtacctgatcggccacggcaccaaggtgtacatcgaccccttcacctacgaggaccccaacgaggccgtgagagagttcgccaaggagatcgacgtgagctacgtgaagatcgaggaggtgatcggcgccggcgagttcggcgaggtgtgcagaggcagactgaaggcccccggcaagaaggagagctgcgtggccatcaagaccctgaagggcggctacaccgagagacagagaagagagttcctgagcgaggccagcatcatgggccagttcgagcaccccaacatcatcagactggagggcgtggtgaccaacagcatgcccgtgatgatcctgaccgagttcatggagaacggcgccctggacagcttcctgagactgaacgacggccagttcaccgtgatccagctggtgggcatgctgagaggcatcgccagcggcatgagatacctggccgagatgagctacgtgcacagagacctggccgccagaaacatcctggtgaacagcaacctggtgtgcaaggtgagcgacttcggcctgagcagattcctggaggagaacagcagcgaccccacctacaccagcagcctgggcggcaagatccccatcagatggaccgcccccgaggccatcgccttcagaaagttcaccagcgccagcgacgcctggagctacggcatcgtgatgtgggaggtgatgagcttcggcgagagaccctactgggacatgagcaaccaggacgtgatcaacgccatcgagcaggactacagactgccccccccccccgactgccccaccagcctgcaccagctgatgctggactgctggcagaaggacagaaacgccagacccagattcccccaggtggtgagcgccctggacaagatgatcagaaaccccgccagcctgaagatcgtggccagagagaacggcggcgacctgctgagaatcggcgtgaccctggccggccaccagaagaagatcctggccagcgtgcagcacatgaagagccaggccaagcccggcacccccggcggcaccggcggccccgccccccagtactag

SEQ ID NO: 10503 - DNA, 552 bp, Artificial Sequence
  Description of Artificial Sequence: Synthetic coding sequence
atggagttcctgtgggcccccctgctgggcctgtgctgcagcctggccgccgccgacagacacaccgtgttctggaacagcagcaaccccaagttcagaaacgaggactacaccatccacgtgcagctgaacgactacgtggacatcatctgcccccactacgaggaccacagcgtggccgacgccgccatggagcagtacatcctgtacctggtggagcacgaggagtaccagctgtgccagccccagagcaaggaccaggtgagatggcagtgcaacagacccagcgccaagcacggccccgagaagctgagcgagaagttccagagattcacccccttcaccctgggcaaggagttcaaggagggccacagctactactacatcagccacagcccccaggcccacgacaacccccaggagaagagactggccgccgacgaccccgaggtgagagtgctgcacagcatcggccacagcgccgcccccagactgttccccctggcctggaccgtgctgctgctgcccctgctgctgctgcagaccccctag

SEQ ID NO: 10504 - DNA, 618 bp, Artificial Sequence
  Description of Artificial Sequence: Synthetic coding sequence
atggagttcctgtgggcccccctgctgggcctgtgctgcagcctggccgccgccgacagacacaccgtgttctggaacagcagcaaccccaagttcagaaacgaggactacaccatccacgtgcagctgaacgactacgtggacatcatctgcccccactacgaggaccacagcgtggccgacgccgccatggagcagtacatcctgtacctggtggagcacgaggagtaccagctgtgccagccccagagcaaggaccaggtgagatggcagtgcaacagacccagcgccaagcacggccccgagaagctgagcgagaagttccagagattcacccccttcaccctgggcaaggagttcaaggagggccacagctactactacatcagcaagcccatccaccagcacgaggacagatgcctgagactgaaggtgaccgtgagcggcaagatcacccacagcccccaggcccacgacaacccccaggagaagagactggccgccgacgaccccgaggtgagagtgctgcacagcatcggccacagcgccgcccccagactgttccccctggcctggaccgtgctgctgctgcccctgctgctgctgcagaccccctag

SEQ ID NO: 10505 - DNA, 1002 bp, Artificial Sequence
  Description of Artificial Sequence: Synthetic coding sequence
atggccgtgagaagagacagcgtgtggaagtactgctggggcgtgctgatggtgctgtgcagaaccgccatcagcaagagcatcgtgctggagcccatctactggaacagcagcaacagcaagttcctgcccggccagggcctggtgctgtacccccagatcggcgacaagctggacatcatctgccccaaggtggacagcaagaccgtgggccagtacgagtactacaaggtgtacatggtggacaaggaccaggccgacagatgcaccatcaagaaggagaacacccccctgctgaactgcgccaagcccgaccaggacatcaagttcaccatcaagttccaggagttcagccccaacctgtggggcctggagttccagaagaacaaggactactacatcatcagcaccagcaacggcagcctggagggcctggacaaccaggagggcggcgtgtgccagaccagagccatgaagatcctgatgaaggtgggccaggacgccagcagcgccggcagcaccagaaacaaggaccccaccagaagacccgagctggaggccggcaccaacggcagaagcagcaccaccagccccttcgtgaagcccaaccccggcagcagcaccgacggcaacagcgccggccacagcggcaacaacatcctgggcagcgaggtggccctgttcgccggcatcgccagcggctgcatcatcttcatcgtgatcatcatcaccctggtggtgctgctgctgaagtacagaagaagacacagaaagcacagcccccagcacaccaccaccctgagcctgagcaccctggccacccccaagagaagcggcaacaacaacggcagcgagcccagcgacatcatcatccccctgagaaccgccgacagcgtgttctgcccccactacgagaaggtgagcggcgactacggccaccccgtgtacatcgtgcaggagatgcccccccagagccccgccaacatctactacaaggtgtag

SEQ ID NO: 10506 - DNA, 3624 bp, Artificial Sequence
  Description of Artificial Sequence: Synthetic coding sequence
atgctgctgaccctgatcatcctgctgcccgtggtgagcaagttcagcttcgtgagcctgagcgccccccagcactggagctgccccgagggcaccctggccggcaacggcaacagcacctgcgtgggccccgcccccttcctgatcttcagccacggcaacagcatcttcagaatcgacaccgagggcaccaactacgagcagctggtggtggacgccggcgtgagcgtgatcatggacttccactacaacgagaagagaatctactgggtggacctggagagacagctgctgcagagagtgttcctgaacggcagcagacaggagagagtgtgcaacatcgagaagaacgtgagcggcatggccatcaactggatcaacgaggaggtgatctggagcaaccagcaggagggcatcatcaccgtgaccgacatgaagggcaacaacagccacatcctgctgagcgccctgaagtaccccgccaacgtggccgtggaccccgtggagagattcatcttctggagcagcgaggtggccggcagcctgtacagagccgacctggacggcgtgggcgtgaaggccctgctggagaccagcgagaagatcaccgccgtgagcctggacgtgctggacaagagactgttctggatccagtacaacagagagggcagcaacagcctgatctgcagctgcgactacgacggcggcagcgtgcacatcagcaagcaccccacccagcacaacctgttcgccatgagcctgttcggcgacagaatcttctacagcacctggaagatgaagaccatctggatcgccaacaagcacaccggcaaggacatggtgagaatcaacctgcacagcagcttcgtgcccctgggcgagctgaaggtggtgcaccccctggcccagcccaaggccgaggacgacacctgggagcccgagcagaagctgtgcaagctgagaaagggcaactgcagcagcaccgtgtgcggccaggacctgcagagccacctgtgcatgtgcgccgagggctacgccctgagcagagacagaaagtactgcgaggacgtgaacgagtgcgccttctggaaccacggctgcaccctgggctgcaagaacacccccggcagctactactgcacctgccccgtgggcttcgtgctgctgcccgacggcaagagatgccaccagctggtgagctgccccagaaacgtgagcgagtgcagccacgactgcgtgctgaccagcgagggccccctgtgcttctgccccgagggcagcgtgctggagagagacggcaagacctgcagcggctgcagcagccccgacaacggcggctgcagccagctgtgcgtgcccctgagccccgtgagctgggagtgcgactgcttccccggctacgacctgcagctggacgagaagagctgcgccgccagcggcccccagcccttcctgctgttcgccaacagccaggacatcagacacatgcacttcgacggcaccgactacggcaccctgctgagccagcagatgggcatggtgtacgccctggaccacgaccccgtggagaacaagatctacttcgcccacaccgccctgaagtggatcgagagagccaacatggacggcagccagagagagagactgatcgaggagggcgtggacgtgcccgagggcctggccgtggactggatcggcagaagattctactggaccgacagaggcaagagcctgatcggcagaagcgacctgaacggcaagagaagcaagatcatcaccaaggagaacatcagccagcccagaggcatcgccgtgcaccccatggccaagagactgttctggaccgacaccggcatcaaccccagaatcgagagcagcagcctgcagggcctgggcagactggtgatcgccagcagcgacctgatctggcccagcggcatcaccatcgacttcctgaccgacaagctgtactggtgcgacgccaagcagagcgtgatcgagatggccaacctggacggcagcaagagaagaagactgacccagaacgacgtgggccaccccttcgccgtggccgtgttcgaggactacgtgtggttcagcgactgggccatgcccagcgtgatgagagtgaacaagagaaccggcaaggacagagtgagactgcagggcagcatgctgaagcccagcagcctggtggtggtgcaccccctggccaagcccggcgccgacccctgcctgtaccagaacggcggctgcgagcacatctgcaagaagagactgggcaccgcctggtgcagctgcagagagggcttcatgaaggccagcgacggcaagacctgcctggccctggacggccaccagctgctggccggcggcgaggtggacctgaagaaccaggtgacccccctggacatcctgagcaagaccagagtgagcgaggacaacatcaccgagagccagcacatgctggtggccgagatcatggtgagcgaccaggacgactgcgcccccgtgggctgcagcatgtacgccagatgcatcagcgagggcgaggacgccacctgccagtgcctgaagggcttcgccggcgacggcaagctgtgcagcgacatcgacgagtgcgagatgggcgtgcccgtgtgcccccccgccagcagcaagtgcatcaacaccgagggcggctacgtgtgcagatgcagcgagggctaccagggcgacggcatccactgcctggacatcgacgagtgccagctgggcgagcacagctgcggcgagaacgccagctgcaccaacaccgagggcggctacacctgcatgtgcgccggcagactgagcgagcccggcctgatctgccccgacagcaccccccccccccacctgagagaggacgaccaccactacagcgtgagaaacagcgacagcgagtgccccctgagccacgacggctactgcctgcacgacggcgtgtgcatgtacatcgaggccctggacaagtacgcctgcaactgcgtggtgggctacatcggcgagagatgccagtacagagacctgaagtggtgggagctgagacacgccggccacggccagcagcagaaggtgatcgtggtggccgtgtgcgtggtggtgctggtgatgctgctgctgctgagcctgtggggcgcccactactacagaacccagaagctgctgagcaagaaccccaagaacccctacgaggagagcagcagagacgtgagaagcagaagacccgccgacaccgaggacggcatgagcagctgcccccagccctggttcgtggtgatcaaggagcaccaggacctgaagaacggcggccagcccgtggccggcgaggacggccaggccgccgacggcagcatgcagcccaccagctggagacaggagccccagctgtgcggcatgggcaccgagcagggctgctggatccccgtgagcagcgacaagggcagctgcccccaggtgatggagagaagcttccacatgcccagctacggcacccagaccctggagggcggcgtggagaagccccacagcctgctgagcgccaaccccctgtggcagcagagagccctggaccccccccaccagatggagctgacccagtag

SEQ ID NO: 10507 - DNA, 3501 bp, Artificial Sequence
  Description of Artificial Sequence: Synthetic coding sequence
atgctgctgaccctgatcatcctgctgcccgtggtgagcaagttcagcttcgtgagcctgagcgccccccagcactggagctgccccgagggcaccctggccggcaacggcaacagcacctgcgtgggccccgcccccttcctgatcttcagccacggcaacagcatcttcagaatcgacaccgagggcaccaactacgagcagctggtggtggacgccggcgtgagcgtgatcatggacttccactacaacgagaagagaatctactgggtggacctggagagacagctgctgcagagagtgttcctgaacggcagcagacaggagagagtgtgcaacatcgagaagaacgtgagcggcatggccatcaactggatcaacgaggaggtgatctggagcaaccagcaggagggcatcatcaccgtgaccgacatgaagggcaacaacagccacatcctgctgagcgccctgaagtaccccgccaacgtggccgtggaccccgtggagagattcatcttctggagcagcgaggtggccggcagcctgtacagagccgacctggacggcgtgggcgtgaaggccctgctggagaccagcgagaagatcaccgccgtgagcctggacgtgctggacaagagactgttctggatccagtacaacagagagggcagcaacagcctgatctgcagctgcgactacgacggcggcagcgtgcacatcagcaagcaccccacccagcacaacctgttcgccatgagcctgttcggcgacagaatcttctacagcacctggaagatgaagaccatctggatcgccaacaagcacaccggcaaggacatggtgagaatcaacctgcacagcagcttcgtgcccctgggcgagctgaaggtggtgcaccccctggcccagcccaaggccgaggacgacacctgggagcccgagcagaagctgtgcaagctgagaaagggcaactgcagcagcaccgtgtgcggccaggacctgcagagccacctgtgcatgtgcgccgagggctacgccctgagcagagacagaaagtactgcgaggacgtgaacgagtgcgccttctggaaccacggctgcaccctgggctgcaagaacacccccggcagctactactgcacctgccccgtgggcttcgtgctgctgcccgacggcaagagatgccaccagctggtgagctgccccagaaacgtgagcgagtgcagccacgactgcgtgctgaccagcgagggccccctgtgcttctgccccgagggcagcgtgctggagagagacggcaagacctgcagcggctgcagcagccccgacaacggcggctgcagccagctgtgcgtgcccctgagccccgtgagctgggagtgcgactgcttccccggctacgacctgcagctggacgagaagagctgcgccgccagcggcccccagcccttcctgctgttcgccaacagccaggacatcagacacatgcacttcgacggcaccgactacggcaccctgctgagccagcagatgggcatggtgtacgccctggaccacgaccccgtggagaacaagatctacttcgcccacaccgccctgaagtggatcgagagagccaacatggacggcagccagagagagagactgatcgaggagggcgtggacgtgcccgagggcctggccgtggactggatcggcagaagattctactggaccgacagaggcaagagcctgatcggcagaagcgacctgaacggcaagagaagcaagatcatcaccaaggagaacatcagccagcccagaggcatcgccgtgcaccccatggccaagagactgttctggaccgacaccggcatcaaccccagaatcgagagcagcagcctgcagggcctgggcagactggtgatcgccagcagcgacctgatctggcccagcggcatcaccatcgacttcctgaccgacaagctgtactggtgcgacgccaagcagagcgtgatcgagatggccaacctggacggcagcaagagaagaagactgacccagaacgacgtgggccaccccttcgccgtggccgtgttcgaggactacgtgtggttcagcgactgggccatgcccagcgtgatgagagtgaacaagagaaccggcaaggacagagtgagactgcagggcagcatgctgaagcccagcagcctggtggtggtgcaccccctggccaagcccggcgccgacccctgcctgtaccagaacggcggctgcgagcacatctgcaagaagagactgggcaccgcctggtgcagctgcagagagggcttcatgaaggccagcgacggcaagacctgcctggccctggacggccaccagctgctggccggcggcgaggtggacctgaagaaccaggtgacccccctggacatcctgagcaagaccagagtgagcgaggacaacatcaccgagagccagcacatgctggtggccgagatcatggtgagcgaccaggacgactgcgcccccgtgggctgcagcatgtacgccagatgcatcagcgagggcgaggacgccacctgccagtgcctgaagggcttcgccggcgacggcaagctgtgcagcgacatcgacgagtgcgagatgggcgtgcccgtgtgcccccccgccagcagcaagtgcatcaacaccgagggcggctacgtgtgcagatgcagcgagggctaccagggcgacggcatccactgcctggacagcaccccccccccccacctgagagaggacgaccaccactacagcgtgagaaacagcgacagcgagtgccccctgagccacgacggctactgcctgcacgacggcgtgtgcatgtacatcgaggccctggacaagtacgcctgcaactgcgtggtgggctacatcggcgagagatgccagtacagagacctgaagtggtgggagctgagacacgccggccacggccagcagcagaaggtgatcgtggtggccgtgtgcgtggtggtgctggtgatgctgctgctgctgagcctgtggggcgcccactactacagaacccagaagctgctgagcaagaaccccaagaacccctacgaggagagcagcagagacgtgagaagcagaagacccgccgacaccgaggacggcatgagcagctgcccccagccctggttcgtggtgatcaaggagcaccaggacctgaagaacggcggccagcccgtggccggcgaggacggccaggccgccgacggcagcatgcagcccaccagctggagacaggagccccagctgtgcggcatgggcaccgagcagggctgctggatccccgtgagcagcgacaagggcagctgcccccaggtgatggagagaagcttccacatgcccagctacggcacccagaccctggagggcggcgtggagaagccccacagcctgctgagcgccaaccccctgtggcagcagagagccctggaccccccccaccagatggagctgacccagtag

SEQ ID NO: 10508 - DNA, 3498 bp, Artificial Sequence
  Description of Artificial Sequence: Synthetic coding sequence
atgctgctgaccctgatcatcctgctgcccgtggtgagcaagttcagcttcgtgagcctgagcgccccccagcactggagctgccccgagggcaccctggccggcaacggcaacagcacctgcgtgggccccgcccccttcctgatcttcagccacggcaacagcatcttcagaatcgacaccgagggcaccaactacgagcagctggtggtggacgccggcgtgagcgtgatcatggacttccactacaacgagaagagaatctactgggtggacctggagagacagctgctgcagagagtgttcctgaacggcagcagacaggagagagtgtgcaacatcgagaagaacgtgagcggcatggccatcaactggatcaacgaggaggtgatctggagcaaccagcaggagggcatcatcaccgtgaccgacatgaagggcaacaacagccacatcctgctgagcgccctgaagtaccccgccaacgtggccgtggaccccgtggagagattcatcttctggagcagcgaggtggccggcagcctgtacagagccgacctggacggcgtgggcgtgaaggccctgctggagaccagcgagaagatcaccgccgtgagcctggacgtgctggacaagagactgttctggatccagtacaacagagagggcagcaacagcctgatctgcagctgcgactacgacggcggcagcgtgcacatcagcaagcaccccacccagcacaacctgttcgccatgagcctgttcggcgacagaatcttctacagcacctggaagatgaagaccatctggatcgccaacaagcacaccggcaaggacatggtgagaatcaacctgcacagcagcttcgtgcccctgggcgagctgaaggtggtgcaccccctggcccagcccaaggccgaggacgacacctgggagcccgacgtgaacgagtgcgccttctggaaccacggctgcaccctgggctgcaagaacacccccggcagctactactgcacctgccccgtgggcttcgtgctgctgcccgacggcaagagatgccaccagctggtgagctgccccagaaacgtgagcgagtgcagccacgactgcgtgctgaccagcgagggccccctgtgcttctgccccgagggcagcgtgctggagagagacggcaagacctgcagcggctgcagcagccccgacaacggcggctgcagccagctgtgcgtgcccctgagccccgtgagctgggagtgcgactgcttccccggctacgacctgcagctggacgagaagagctgcgccgccagcggcccccagcccttcctgctgttcgccaacagccaggacatcagacacatgcacttcgacggcaccgactacggcaccctgctgagccagcagatgggcatggtgtacgccctggaccacgaccccgtggagaacaagatctacttcgcccacaccgccctgaagtggatcgagagagccaacatggacggcagccagagagagagactgatcgaggagggcgtggacgtgcccgagggcctggccgtggactggatcggcagaagattctactggaccgacagaggcaagagcctgatcggcagaagcgacctgaacggcaagagaagcaagatcatcaccaaggagaacatcagccagcccagaggcatcgccgtgcaccccatggccaagagactgttctggaccgacaccggcatcaaccccagaatcgagagcagcagcctgcagggcctgggcagactggtgatcgccagcagcgacctgatctggcccagcggcatcaccatcgacttcctgaccgacaagctgtactggtgcgacgccaagcagagcgtgatcgagatggccaacctggacggcagcaagagaagaagactgacccagaacgacgtgggccaccccttcgccgtggccgtgttcgaggactacgtgtggttcagcgactgggccatgcccagcgtgatgagagtgaacaagagaaccggcaaggacagagtgagactgcagggcagcatgctgaagcccagcagcctggtggtggtgcaccccctggccaagcccggcgccgacccctgcctgtaccagaacggcggctgcgagcacatctgcaagaagagactgggcaccgcctggtgcagctgcagagagggcttcatgaaggccagcgacggcaagacctgcctggccctggacggccaccagctgctggccggcggcgaggtggacctgaagaaccaggtgacccccctggacatcctgagcaagaccagagtgagcgaggacaacatcaccgagagccagcacatgctggtggccgagatcatggtgagcgaccaggacgactgcgcccccgtgggctgcagcatgtacgccagatgcatcagcgagggcgaggacgccacctgccagtgcctgaagggcttcgccggcgacggcaagctgtgcagcgacatcgacgagtgcgagatgggcgtgcccgtgtgcccccccgccagcagcaagtgcatcaacaccgagggcggctacgtgtgcagatgcagcgagggctaccagggcgacggcatccactgcctggacatcgacgagtgccagctgggcgagcacagctgcggcgagaacgccagctgcaccaacaccgagggcggctacacctgcatgtgcgccggcagactgagcgagcccggcctgatctgccccgacagcaccccccccccccacctgagagaggacgaccaccactacagcgtgagaaacagcgacagcgagtgccccctgagccacgacggctactgcctgcacgacggcgtgtgcatgtacatcgaggccctggacaagtacgcctgcaactgcgtggtgggctacatcggcgagagatgccagtacagagacctgaagtggtgggagctgagacacgccggccacggccagcagcagaaggtgatcgtggtggccgtgtgcgtggtggtgctggtgatgctgctgctgctgagcctgtggggcgcccactactacagaacccagaagctgctgagcaagaaccccaagaacccctacgaggagagcagcagagacgtgagaagcagaagacccgccgacaccgaggacggcatgagcagctgcccccagccctggttcgtggtgatcaaggagcaccaggacctgaagaacggcggccagcccgtggccggcgaggacggccaggccgccgacggcagcatgcagcccaccagctggagacaggagccccagctgtgcggcatgggcaccgagcagggctgctggatccccgtgagcagcgacaagggcagctgcccccaggtgatggagagaagcttccacatgcccagctacggcacccagaccctggagggcggcgtggagaagccccacagcctgctgagcgccaaccccctgtggcagcagagagccctggaccccccccaccagatggagctgacccagtag

SEQ ID NO: 10509 - DNA, 3633 bp, Artificial Sequence
  Description of Artificial Sequence: Synthetic coding sequence
atgagacccagcggcaccgccggcgccgccctgctggccctgctggccgccctgtgccccgccagcagagccctggaggagaagaaggtgtgccagggcaccagcaacaagctgacccagctgggcaccttcgaggaccacttcctgagcctgcagagaatgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcaggagatcctgcacggcgccgtgagattcagcaacaaccccgccctgtgcaacgtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggctgcaccggccccggcctggagggctgccccaccaacggccccaagatccccagcatcgccaccggcatggtgggcgccctgctgctgctgctggtggtggccctgggcatcggcctgttcatgagaagaagacacatcgtgagaaagagaaccctgagaagactgctgcaggagagagagctggtggagcccctgacccccagcggcgaggcccccaaccaggccctgctgagaatcctgaaggagaccgagttcaagaagatcaaggtgctgggcagcggcgccttcggcaccgtgtacaagggcctgtggatccccgagggcgagaaggtgaagatccccgtggccatcaaggagctgagagaggccaccagccccaaggccaacaaggagatcctggacgaggcctacgtgatggccagcgtggacaacccccacgtgtgcagactgctgggcatctgcctgaccagcaccgtgcagctgatcacccagctgatgcccttcggctgcctgctggactacgtgagagagcacaaggacaacatcggcagccagtacctgctgaactggtgcgtgcagatcgccaagggcatgaactacctggaggacagaagactggtgcacagagacctggccgccagaaacgtgctggtgaagaccccccagcacgtgaagatcaccgacttcggcctggccaagctgctgggcgccgaggagaaggagtaccacgccgagggcggcaaggtgcccatcaagtggatggccctggagagcatcctgcacagaatctacacccaccagagcgacgtgtggagctacggcgtgaccgtgtgggagctgatgaccttcggcagcaagccctacgacggcatccccgccagcgagatcagcagcatcctggagaagggcgagagactgccccagccccccatctgcaccatcgacgtgtacatgatcatggtgaagtgctggatgatcgacgccgacagcagacccaagttcagagagctgatcatcgagttcagcaagatggccagagacccccagagatacctggtgatccagggcgacgagagaatgcacctgcccagccccaccgacagcaacttctacagagccctgatggacgaggaggacatggacgacgtggtggacgccgacgagtacctgatcccccagcagggcttcttcagcagccccagcaccagcagaacccccctgctgagcagcctgagcgccaccagcaacaacagcaccgtggcctgcatcgacagaaacggcctgcagagctgccccatcaaggaggacagcttcctgcagagatacagcagcgaccccaccggcgccctgaccgaggacagcatcgacgacaccttcctgcccgtgcccgagtacatcaaccagagcgtgcccaagagacccgccggcagcgtgcagaaccccgtgtaccacaaccagcccctgaaccccgcccccagcagagacccccactaccaggacccccacagcaccgccgtgggcaaccccgagtacctgaacaccgtgcagcccacctgcgtgaacagcaccttcgacagccccgcccactgggcccagaagggcagccaccagatcagcctggacaaccccgactaccagcaggacttcttccccaaggaggccaagcccaacggcatcttcaagggcagcaccgccgagaacgccgagtacctgagagtggccccccagagcagcgagttcatcggcgcctag

SEQ ID NO: 10510 - DNA, 1887 bp, Artificial Sequence
  Description of Artificial Sequence: Synthetic coding sequence
atgagacccagcggcaccgccggcgccgccctgctggccctgctggccgccctgtgccccgccagcagagccctggaggagaagaaggtgtgccagggcaccagcaacaagctgacccagctgggcaccttcgaggaccacttcctgagcctgcagagaatgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcaggagatcctgcacggcgccgtgagattcagcaacaaccccgccctgtgcaacgtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggcagctag

SEQ ID NO: 10511 - DNA, 2118 bp, Artificial Sequence
  Description of Artificial Sequence: Synthetic coding sequence
atgagacccagcggcaccgccggcgccgccctgctggccctgctggccgccctgtgccccgccagcagagccctggaggagaagaaggtgtgccagggcaccagcaacaagctgacccagctgggcaccttcgaggaccacttcctgagcctgcagagaatgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcaggagatcctgcacggcgccgtgagattcagcaacaaccccgccctgtgcaacgtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggccccggcaacgagagcctgaaggccatgctgttctgcctgttcaagctgagcagctgcaaccagagcaacgacggcagcgtgagccaccagagcggcagccccgccgcccaggagagctgcctgggctggatccccagcctgctgcccagcgagttccagctgggctggggcggctgcagccacctgcacgcctggcccagcgccagcgtgatcatcaccgccagcagctgccactag

SEQ ID NO: 10512 - DNA, 3243 bp, Artificial Sequence
  Description of Artificial Sequence: Synthetic coding sequence
aacagaaccgagggcgccgcccacgagaagttcaccggcaaccccgcctggagaagagccgtgcagcagcagccctgccccgtggtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggctgcaccggccccggcctggagggctgccccaccaacggccccaagatccccagcatcgccaccggcatggtgggcgccctgctgctgctgctggtggtggccctgggcatcggcctgttcatgagaagaagacacatcgtgagaaagagaaccctgagaagactgctgcaggagagagagctggtggagcccctgacccccagcggcgaggcccccaaccaggccctgctgagaatcctgaaggagaccgagttcaagaagatcaaggtgctgggcagcggcgccttcggcaccgtgtacaagggcctgtggatccccgagggcgagaaggtgaagatccccgtggccatcaaggagctgagagaggccaccagccccaaggccaacaaggagatcctggacgaggcctacgtgatggccagcgtggacaacccccacgtgtgcagactgctgggcatctgcctgaccagcaccgtgcagctgatcacccagctgatgcccttcggctgcctgctggactacgtgagagagcacaaggacaacatcggcagccagtacctgctgaactggtgcgtgcagatcgccaagggcatgaactacctggaggacagaagactggtgcacagagacctggccgccagaaacgtgctggtgaagaccccccagcacgtgaagatcaccgacttcggcctggccaagctgctgggcgccgaggagaaggagtaccacgccgagggcggcaaggtgcccatcaagtggatggccctggagagcatcctgcacagaatctacacccaccagagcgacgtgtggagctacggcgtgaccgtgtgggagctgatgaccttcggcagcaagccctacgacggcatccccgccagcgagatcagcagcatcctggagaagggcgagagactgccccagccccccatctgcaccatcgacgtgtacatgatcatggtgaagtgctggatgatcgacgccgacagcagacccaagttcagagagctgatcatcgagttcagcaagatggccagagacccccagagatacctggtgatccagggcgacgagagaatgcacctgcccagccccaccgacagcaacttctacagagccctgatggacgaggaggacatggacgacgtggtggacgccgacgagtacctgatcccccagcagggcttcttcagcagccccagcaccagcagaacccccctgctgagcagcctgagcgccaccagcaacaacagcaccgtggcctgcatcgacagaaacggcctgcagagctgccccatcaaggaggacagcttcctgcagagatacagcagcgaccccaccggcgccctgaccgaggacagcatcgacgacaccttcctgcccgtgcccgagtacatcaaccagagcgtgcccaagagacccgccggcagcgtgcagaaccccgtgtaccacaaccagcccctgaaccccgcccccagcagagacccccactaccaggacccccacagcaccgccgtgggcaaccccgagtacctgaacaccgtgcagcccacctgcgtgaacagcaccttcgacagccccgcccactgggcccagaagggcagccaccagatcagcctggacaaccccgactaccagcaggacttcttccccaaggaggccaagcccaacggcatcttcaagggcagcaccgccgagaacgccgagtacctgagagtggccccccagagcagcgagttcatcggcgcctag

SEQ ID NO: 10513 - DNA, 1218 bp, Artificial Sequence
  Description of Artificial Sequence: Synthetic coding sequence
atgagacccagcggcaccgccggcgccgccctgctggccctgctggccgccctgtgccccgccagcagagccctggaggagaagaaggtgtgccagggcaccagcaacaagctgacccagctgggcaccttcgaggaccacttcctgagcctgcagagaatgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcaggagatcctgcacggcgccgtgagattcagcaacaaccccgccctgtgcaacgtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcctgagctag

SEQ ID NO: 10514 - DNA, 1974 bp, Artificial Sequence
  Description of Artificial Sequence: Synthetic coding sequence
atgagacccagcggcaccgccggcgccgccctgctggccctgctggccgccctgtgccccgccagcagagccctggaggagaagaaggtgtgccagggcaccagcaacaagctgacccagctgggcaccttcgaggaccacttcctgagcctgcagagaatgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcaggagatcctgcacggcgccgtgagattcagcaacaaccccgccctgtgcaacgtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggctgcaccggccccggcctggagggctgccccaccaacggcagctacatcgtgagccacttccccagaagcttctacaagatgagcgtgcactag

SEQ ID NO: 10515 - DNA, 3474 bp, Artificial Sequence
  Description of Artificial Sequence: Synthetic coding sequence
atgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcaggagatcctgcacggcgccgtgagattcagcaacaaccccgccctgtgcaacgtggagagcatccagtggagagacatcgtgagcagcgacttcctgagcaacatgagcatggacttccagaaccacctgggcagctgccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggctgcaccggccccggcctggagggctgccccaccaacggccccaagatccccagcatcgccaccggcatggtgggcgccctgctgctgctgctggtggtggccctgggcatcggcctgttcatgagaagaagacacatcgtgagaaagagaaccctgagaagactgctgcaggagagagagctggtggagcccctgacccccagcggcgaggcccccaaccaggccctgctgagaatcctgaaggagaccgagttcaagaagatcaaggtgctgggcagcggcgccttcggcaccgtgtacaagggcctgtggatccccgagggcgagaaggtgaagatccccgtggccatcaaggagctgagagaggccaccagccccaaggccaacaaggagatcctggacgaggcctacgtgatggccagcgtggacaacccccacgtgtgcagactgctgggcatctgcctgaccagcaccgtgcagctgatcacccagctgatgcccttcggctgcctgctggactacgtgagagagcacaaggacaacatcggcagccagtacctgctgaactggtgcgtgcagatcgccaagggcatgaactacctggaggacagaagactggtgcacagagacctggccgccagaaacgtgctggtgaagaccccccagcacgtgaagatcaccgacttcggcctggccaagctgctgggcgccgaggagaaggagtaccacgccgagggcggcaaggtgcccatcaagtggatggccctggagagcatcctgcacagaatctacacccaccagagcgacgtgtggagctacggcgtgaccgtgtgggagctgatgaccttcggcagcaagccctacgacggcatccccgccagcgagatcagcagcatcctggagaagggcgagagactgccccagccccccatctgcaccatcgacgtgtacatgatcatggtgaagtgctggatgatcgacgccgacagcagacccaagttcagagagctgatcatcgagttcagcaagatggccagagacccccagagatacctggtgatccagggcgacgagagaatgcacctgcccagccccaccgacagcaacttctacagagccctgatggacgaggaggacatggacgacgtggtggacgccgacgagtacctgatcccccagcagggcttcttcagcagccccagcaccagcagaacccccctgctgagcagcctgagcgccaccagcaacaacagcaccgtggcctgcatcgacagaaacggcctgcagagctgccccatcaaggaggacagcttcctgcagagatacagcagcgaccccaccggcgccctgaccgaggacagcatcgacgacaccttcctgcccgtgcccgagtacatcaaccagagcgtgcccaagagacccgccggcagcgtgcagaaccccgtgtaccacaaccagcccctgaaccccgcccccagcagagacccccactaccaggacccccacagcaccgccgtgggcaaccccgagtacctgaacaccgtgcagcccacctgcgtgaacagcaccttcgacagccccgcccactgggcccagaagggcagccaccagatcagcctggacaaccccgactaccagcaggacttcttccccaaggaggccaagcccaacggcatcttcaagggcagcaccgccgagaacgccgagtacctgagagtggccccccagagcagcgagttcatcggcgcctag

SEQ ID NO: 10516 - DNA, 3276 bp, Artificial Sequence
  Description of Artificial Sequence: Synthetic coding sequence
atgagacccagcggcaccgccggcgccgccctgctggccctgctggccgccctgtgccccgccagcagagccctggaggagaagaaggtgtgccagggcaccagcaacaagctgacccagctgggcaccttcgaggaccacttcctgagcctgcagagaatgttcaacaactgcgaggtggtgctgggcaacctggagatcacctacgtgcagagaaactacgacctgagcttcctgaagaccatccaggaggtggccggctacgtgctgatcgccctgaacaccgtggagagaatccccctggagaacctgcagatcatcagaggcaacatgtactacgagaacagctacgccctggccgtgctgagcaactacgacgccaacaagaccggcctgaaggagctgcccatgagaaacctgcagggccagaagtgcgaccccagctgccccaacggcagctgctggggcgccggcgaggagaactgccagaagctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggctgcaccggccccggcctggagggctgccccaccaacggccccaagatccccagcatcgccaccggcatggtgggcgccctgctgctgctgctggtggtggccctgggcatcggcctgttcatgagaagaagacacatcgtgagaaagagaaccctgagaagactgctgcaggagagagagctggtggagcccctgacccccagcggcgaggcccccaaccaggccctgctgagaatcctgaaggagaccgagttcaagaagatcaaggtgctgggcagcggcgccttcggcaccgtgtacaagggcctgtggatccccgagggcgagaaggtgaagatccccgtggccatcaaggagctgagagaggccaccagccccaaggccaacaaggagatcctggacgaggcctacgtgatggccagcgtggacaacccccacgtgtgcagactgctgggcatctgcctgaccagcaccgtgcagctgatcacccagctgatgcccttcggctgcctgctggactacgtgagagagcacaaggacaacatcggcagccagtacctgctgaactggtgcgtgcagatcgccaagggcatgaactacctggaggacagaagactggtgcacagagacctggccgccagaaacgtgctggtgaagaccccccagcacgtgaagatcaccgacttcggcctggccaagctgctgggcgccgaggagaaggagtaccacgccgagggcggcaaggtgcccatcaagtggatggccctggagagcatcctgcacagaatctacacccaccagagcgacgtgtggagctacggcgtgaccgtgtgggagctgatgaccttcggcagcaagccctacgacggcatccccgccagcgagatcagcagcatcctggagaagggcgagagactgccccagccccccatctgcaccatcgacgtgtacatgatcatggtgaagtgctggatgatcgacgccgacagcagacccaagttcagagagctgatcatcgagttcagcaagatggccagagacccccagagatacctggtgatccagggcgacgagagaatgcacctgcccagccccaccgacagcaacttctacagagccctgatggacgaggaggacatggacgacgtggtggacgccgacgagtacctgatcccccagcagggcttcttcagcagccccagcaccagcagaacccccctgctgagcagcctgagcgccaccagcaacaacagcaccgtggcctgcatcgacagaaacggcctgcagagctgccccatcaaggaggacagcttcctgcagagatacagcagcgaccccaccggcgccctgaccgaggacagcatcgacgacaccttcctgcccgtgcccggcgagtggctggtgtggaagcagagctgcagcagcaccagcagcacccacagcgccgccgccagcctgcagtgccccagccaggtgctgccccccgccagccccgagggcgagaccgtggccgacctgcagacccagtag

SEQ ID NO: 10517 - DNA, 1395 bp, Artificial Sequence
  Description of Artificial Sequence: Synthetic coding sequence
atgagcagcctgaccaagatcatctgcgcccagcagtgcagcggcagatgcagaggcaagagccccagcgactgctgccacaaccagtgcgccgccggctgcaccggccccagagagagcgactgcctggtgtgcagaaagttcagagacgaggccacctgcaaggacacctgcccccccctgatgctgtacaaccccaccacctaccagatggacgtgaaccccgagggcaagtacagcttcggcgccacctgcgtgaagaagtgccccagaaactacgtggtgaccgaccacggcagctgcgtgagagcctgcggcgccgacagctacgagatggaggaggacggcgtgagaaagtgcaagaagtgcgagggcccctgcagaaaggtgtgcaacggcatcggcatcggcgagttcaaggacagcctgagcatcaacgccaccaacatcaagcacttcaagaactgcaccagcatcagcggcgacctgcacatcctgcccgtggccttcagaggcgacagcttcacccacaccccccccctggacccccaggagctggacatcctgaagaccgtgaaggagatcaccggcttcctgctgatccaggcctggcccgagaacagaaccgacctgcacgccttcgagaacctggagatcatcagaggcagaaccaagcagcacggccagttcagcctggccgtggtgagcctgaacatcaccagcctgggcctgagaagcctgaaggagatcagcgacggcgacgtgatcatcagcggcaacaagaacctgtgctacgccaacaccatcaactggaagaagctgttcggcaccagcggccagaagaccaagatcatcagcaacagaggcgagaacagctgcaaggccaccggccaggtgtgccacgccctgtgcagccccgagggctgctggggccccgagcccagagactgcgtgagctgcagaaacgtgagcagaggcagagagtgcgtggacaagtgcaacctgctggagggcgagcccagagagttcgtggagaacagcgagtgcatccagtgccaccccgagtgcctgccccaggccatgaacatcacctgcaccggcagaggccccgacaactgcatccagtgcgcccactacatcgacggcccccactgcgtgaagacctgccccgccggcgtgatgggcgagaacaacaccctggtgtggaagtacgccgacgccggccacgtgtgccacctgtgccaccccaactgcacctacggctgcaccggccccggcctggagggctgccccaccaacggccccaagatccccagcatcgccaccggcatggtgggcgccctgctgctgctgctggtggtggccctgggcatcggcctgttcatgagaagatag

SEQ ID NO: 10518 - DNA, 843 bp, Artificial Sequence
  Description of Artificial Sequence: Synthetic coding sequence
atgcccgccgacatcatggagaagaacagcagcagccccgtggccgccacccccgccagcgtgaacaccacccccgacaagcccaagaccgccagcgagcacagaaagagcagcaagcccatcatggagaagagaagaagagccagaatcaacgagagcctgagccagctgaagaccctgatcctggacgccctgaagaaggacagcagcagacacagcaagctggagaaggccgacatcctggagatgaccgtgaagcacctgagaaacctgcagagagcccagatgaccgccgccctgagcaccgaccccagcgtgctgggcaagtacagagccggcttcagcgagtgcatgaacgaggtgaccagattcctgagcacctgcgagggcgtgaacaccgaggtgagaaccagactgctgggccacctggccaactgcatgacccagatcaacgccatgacctaccccggccagccccaccccgccctgcaggccccccccccccccccccccggccccggcggcccccagcacgcccccttcgccccccccccccccctggtgcccatccccggcggcgccgcccccccccccggcggcgccccctgcaagctgggcagccaggccggcgaggccgccaaggtgttcggcggcttccaggtggtgcccgcccccgacggccagttcgccttcctgatccccaacggcgccttcgcccacagcggccccgtgatccccgtgtacaccagcaacagcggcaccagcgtgggccccaacgccgtgagccccagcagcggccccagcctgaccgccgacagcatgtggagaccctggagaaactag

SEQ ID NO: 10519 - DNA, 57 bp, Artificial Sequence
  Description of Artificial Sequence: Synthetic coding sequence
atggccgagaacagcgtgctgaccagcaccaccggcagaaccagcctggccgactag

SEQ ID NO: 10520 - DNA, 2745 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggaggagatgccccagatcgagaccagagtgatcctggtgcaggaggccggcaagcaggaggagctgatcaaggccctgaagaccatcaagatcatggaggtgcccgtgatcaagatcaaggagagctgccccggcaagagcgacgagaagctgatcaagagcgtgatcaacatggacatcaaggtgggcttcgtgaagatggagagcgtggaggagttcgagggcctggacagccccgagttcgagaacgtgttcgtggtgaccgacttccaggacagcgtgttcaacgacctgtacaaggccgactgcagagtgatcggcccccccgtggtgctgaactgcagccagaagggcgagcccctgcccttcagctgcagacccctgtactgcaccagcatgatgaacctggtgctgtgcttcaccggcttcagaaagaaggaggagctggtgagactggtgaccctggtgcaccacatgggcggcgtgatcagaaaggacttcaacagcaaggtgacccacctggtggccaactgcacccagggcgagaagttcagagtggccgtgagcctgggcacccccatcatgaagcccgagtggatctacaaggcctgggagagaagaaacgagcaggacttctacgccgccgtggacgacttcagaaacgagttcaaggtgccccccttccaggactgcatcctgagcttcctgggcttcagcgacgaggagaagaccaacatggaggagatgaccgagatgcagggcggcaagtacctgcccctgggcgacgagagatgcacccacctggtggtggaggagaacatcgtgaaggacctgcccttcgagcccagcaagaagctgtacgtggtgaagcaggagtggttctggggcagcatccagatggacgccagagccggcgagaccatgtacctgtacgagaaggccaacacccccgagctgaagaagagcgtgagcatgctgagcctgaacacccccaacagcaacagaaagagaagaagactgaaggagaccctggcccagctgagcagagagaccgacgtgagccccttcccccccagaaagagacccagcgccgagcacagcctgagcatcggcagcctgctggacatcagcaacacccccgagagcagcatcaactacggcgacacccccaagagctgcaccaagagcagcaagagcagcacccccgtgcccagcaagcagagcgccagatggcaggtggccaaggagctgtaccagaccgagagcaactacgtgaacatcctggccaccatcatccagctgttccaggtgcccctggaggaggagggccagagaggcggccccatcctggcccccgaggagatcaagaccatcttcggcagcatccccgacatcttcgacgtgcacaccaagatcaaggacgacctggaggacctgatcgtgaactgggacgagagcaagagcatcggcgacatcttcctgaagtacagcaaggacctggtgaagacctacccccccttcgtgaacttcttcgagatgagcaaggagaccatcatcaagtgcgagaagcagaagcccagattccacgccttcctgaagatcaaccaggccaagcccgagtgcggcagacagagcctggtggagctgctgatcagacccgtgcagagactgcccagcgtggccctgctgctgaacgacctgaagaagcacaccgccgacgagaaccccgacaagagcaccctggagaaggccatcggcagcctgaaggaggtgatgacccacatcaacgaggacaagagaaagaccgaggcccagaagcagatcttcgacgtggtgtacgaggtggacggctgccccgccaacctgctgagcagccacagaagcctggtgcagagagtggagaccatcagcctgggcgagcacccctgcgacagaggcgagcaggtgaccctgttcctgttcaacgactgcctggagatcgccagaaagagacacaaggtgatcggcaccttcagaagcccccacggccagaccagaccccccgccagcctgaagcacatccacctgatgcccctgagccagatcaagaaggtgctggacatcagagagaccgaggactgccacaacgccttcgccctgctggtgagaccccccaccgagcaggccaacgtgctgctgagcttccagatgaccagcgacgagctgcccaaggagaactggctgaagatgctgtgcagacacgtggccaacaccatctgcaaggccgacgccgagaacctgatctacaccgccgaccccgagagcttcgaggtgaacaccaaggacatggacagcaccctgagcagagccagcagagccatcaagaagaccagcaagaaggtgaccagagccttcagcttcagcaagacccccaagagagccctgagaagagccctgatgaccagccacggcagcgtggagggcagaagccccagcagcaacgacaagcacgtgatgagcagactgagcagcaccagcagcctggccggcatccccagccccagcctggtgagcctgcccagcttcttcgagagaagaagccacaccctgagcagaagcaccacccacctgatctag

SEQ ID NO: 10521 - DNA, 480 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggaggagatgccccagatcgagaccagagtgatcctggtgcaggaggccggcaagcaggaggagctgatcaaggccctgaaggacatcaaggtgggcttcgtgaagatggagagcgtggaggagttcgagggcctggacagccccgagttcgagaacgtgttcgtggtgaccgacttccaggacagcgtgttcaacgacctgtacaaggccgactgcagagtgatcggcccccccgtggtgctgaactgcagccagaagggcgagcccctgcccttcagctgcagacccctgtactgcaccagcatgatgaacctggtgctgtgcttcaccggcttcagaaagaaggagtag

SEQ ID NO: 10522 - DNA, 2649 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggagatgccccagatcgagaccagagtgatcctggtgcaggaggccggcaagcaggaggagctgatcaaggccctgaaggacatcaaggtgggcttcgtgaagatggagagcgtggaggagttcgagggcctggacagccccgagttcgagaacgtgttcgtggtgaccgacttccaggacagcgtgttcaacgacctgtacaaggccgactgcagagtgatcggcccccccgtggtgctgaactgcagccagaagggcgagcccctgcccttcagctgcagacccctgtactgcaccagcatgatgaacctggtgctgtgcttcaccggcttcagaaagaaggaggagctggtgagactggtgaccctggtgcaccacatgggcggcgtgatcagaaaggacttcaacagcaaggtgacccacctggtggccaactgcacccagggcgagaagttcagagtggccgtgagcctgggcacccccatcatgaagcccgagtggatctacaaggcctgggagagaagaaacgagcaggacttctacgccgccgtggacgacttcagaaacgagttcaaggtgccccccttccaggactgcatcctgagcttcctgggcttcagcgacgaggagaagaccaacatggaggagatgaccgagatgcagggcggcaagtacctgcccctgggcgacgagagatgcacccacctggtggtggaggagaacatcgtgaaggacctgcccttcgagcccagcaagaagctgtacgtggtgaagcaggagtggttctggggcagcatccagatggacgccagagccggcgagaccatgtacctgtacgagaaggccaacacccccgagctgaagaagagcgtgagcatgctgagcctgaacacccccaacagcaacagaaagagaagaagactgaaggagaccctggcccagctgagcagagagaccgacgtgagccccttcccccccagaaagagacccagcgccgagcacagcctgagcatcggcagcctgctggacatcagcaacacccccgagagcagcatcaactacggcgacacccccaagagctgcaccaagagcagcaagagcagcacccccgtgcccagcaagcagagcgccagatggcaggtggccaaggagctgtaccagaccgagagcaactacgtgaacatcctggccaccatcatccagctgttccaggtgcccctggaggaggagggccagagaggcggccccatcctggcccccgaggagatcaagaccatcttcggcagcatccccgacatcttcgacgtgcacaccaagatcaaggacgacctggaggacctgatcgtgaactgggacgagagcaagagcatcggcgacatcttcctgaagtacagcaaggacctggtgaagacctacccccccttcgtgaacttcttcgagatgagcaaggagaccatcatcaagtgcgagaagcagaagcccagattccacgccttcctgaagatcaaccaggccaagcccgagtgcggcagacagagcctggtggagctgctgatcagacccgtgcagagactgcccagcgtggccctgctgctgaacgacctgaagaagcacaccgccgacgagaaccccgacaagagcaccctggagaaggccatcggcagcctgaaggaggtgatgacccacatcaacgaggacaagagaaagaccgaggcccagaagcagatcttcgacgtggtgtacgaggtggacggctgccccgccaacctgctgagcagccacagaagcctggtgcagagagtggagaccatcagcctgggcgagcacccctgcgacagaggcgagcaggtgaccctgttcctgttcaacgactgcctggagatcgccagaaagagacacaaggtgatcggcaccttcagaagcccccacggccagaccagaccccccgccagcctgaagcacatccacctgatgcccctgagccagatcaagaaggtgctggacatcagagagaccgaggactgccacaacgccttcgccctgctggtgagaccccccaccgagcaggccaacgtgctgctgagcttccagatgaccagcgacgagctgcccaaggagaactggctgaagatgctgtgcagacacgtggccaacaccatctgcaaggccgacgccgagaacctgatctacaccgccgaccccgagagcttcgaggtgaacaccaaggacatggacagcaccctgagcagagccagcagagccatcaagaagaccagcaagaaggtgaccagagccttcagcttcagcaagacccccaagagagccctgagaagagccctgatgaccagccacggcagcgtggagggcagaagccccagcagcaacgacaagcacgtgatgagcagactgagcagcaccagcagcctggccggcatccccagccccagcctggtgagcctgcccagcttcttcgagagaagaagccacaccctgagcagaagcaccacccacctgatctag

SEQ ID NO: 10523 - DNA, 321 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggaggagatgccccagatcgagaccagagtgatcctggtgcaggaggccggcaagcaggaggagctgatcaaggccctgaaggacatcaaggtgggcttcgtgaagatggagagcgtggaggagttcgagggcctggacagccccgagttcgagaacgtgttcgtggtgaccgacttccaggacagcgtgtag

SEQ ID NO: 10524 - DNA, 2784 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggaggagatgccccagatcgagaccagagtgatcctggtgcaggaggccggcaagcaggaggagctgatcaaggccctgaaggacatcaaggtgggcttcgtgaagatggagagcgtggaggagttcgagggcctggacagccccgagttcgagaacgtgttcgtggtgaccgacttccaggacagcgtgttcaacgacctgtacaaggccgactgcagagtgatcggcccccccgtggtgctgaactgcagccagaagggcgagcccctgcccttcagctgcagacccctgtactgcaccagcatgatgaacctggtgctgtgcttcaccggcttcagaaagaaggaggagctggtgagactggtgaccctggtgcaccacatgggcggcgtgatcagaaaggacttcaacagcaaggtgacccacctggtggccaactgcacccagggcgagaagttcagagtggccgtgagcctgggcacccccatcatgaagcccgagtggatctacaaggcctgggagagaagaaacgagcaggacttctacgccgccgtggacgacttcagaaacgagttcaaggtgccccccttccaggactgcatcctgagcttcctgggcttcagcgacgaggagaagaccaacatggaggagatgaccgagatgcagggcggcaagtacctgcccctgggcgacgagagatgcacccacctggtggtggaggagaacatcgtgaaggacctgcccttcgagcccagcaagaagctgtacgtggtgaagcaggagtggttctggggcagcatccagatggacgccagagccggcgagaccatgtacctgtacgagaaggccaacacccccgagctgaagaagagcgtgagcatgctgagcctgaacacccccaacagcaacagaaagagaagaagactgaaggagaccctggcccagctgagcagagagaccgacgtgagccccttcccccccagaaagagacccagcgccgagcacagcctgagcatcggcagcctgctggacatcagcaacacccccgagagcagcatcaactacggcgacacccccaagagctgcaccaagagcagcaagagcagcacccccgtgcccagcaagcagagcgccagatggcaggtggccaaggagctgtaccagaccgagagcaactacgtgaacatcctggccaccatcatccagctgttccaggtgcccctggaggaggagggccagagaggcggccccatcctggcccccgaggagatcaagaccatcttcggcagcatccccgacatcttcgacgtgcacaccaagatcaaggacgacctggaggacctgatcgtgaactgggacgagagcaagagcatcggcgacatcttcctgaagtacagcaaggacctggtgaagacctacccccccttcgtgaacttcttcgagatgagcaaggagaccatcatcaagtgcgagaagcagaagcccagattccacgccttcctgaagatcaaccaggccaagcccgagtgcggcagacagagcctggtggagctgctgatcagacccgtgcagagactgcccagcgtggccctgctgctgaacgacctgaagaagcacaccgccgacgagaaccccgacaagagcaccctggagaaggccatcggcagcctgaaggaggtgatgacccacatcaacgaggacaagagaaagaccgaggcccagaagcagatcttcgacgtggtgtacgaggtggacggctgccccgccaacctgctgagcagccacagaagcctggtgcagagagtggagaccatcagcctgggcgagcacccctgcgacagaggcgagcaggtgaccctgttcctgttcaacgactgcctggagatcgccagaaagagacacaaggtgatcggcaccttcagaagcccccacggccagaccagaccccccgccagcctgaagcacatccacctgatgcccctgagccagatcaagaaggtgctggacatcagagagaccgaggactgccacaacgccttcgccctgctggtgagaccccccaccgagcaggccaacgtgctgctgagcttccagatgaccagcgacgagctgcccaaggagaactggctgaagatgctgtgcagacacgtggccaacaccatctgcaaggccgacgccgagaacctgatctacaccgccgaccccgagagcttcgaggtgaacaccaaggacatggacagcaccctgagcagagccagcagagccatcaagaagaccagcaagaaggtgaccagagccttcagcttcagcaagacccccaagagagccctgagaagagccctgatgaccagccacggcagcgtggagggcagaagccccagcagcaacgacaagcacgtgatgagcagactgagcagcaccagcagcctggccatcacccacagcgtgagcaccagcaacgtgatcggcttcaccaagcacgtgtacgtgcagagactgaacagcaccggcggcagaagccagtacagctggttccagagcgtgagacacagcgccttcagagccagcttcagcgagatcctggagggcaacaccgacttcagcaacttcaagaaggtgctgagcaagagcagcctgaccttcgtgaagaactag

SEQ ID NO: 10525 - DNA, 2652 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggaggagatgccccagatcgagaccagagtgatcctggtgcaggaggccggcaagcaggaggagctgatcaaggccctgaaggacatcaaggtgggcttcgtgaagatggagagcgtggaggagttcgagggcctggacagccccgagttcgagaacgtgttcgtggtgaccgacttccaggacagcgtgttcaacgacctgtacaaggccgactgcagagtgatcggcccccccgtggtgctgaactgcagccagaagggcgagcccctgcccttcagctgcagacccctgtactgcaccagcatgatgaacctggtgctgtgcttcaccggcttcagaaagaaggaggagctggtgagactggtgaccctggtgcaccacatgggcggcgtgatcagaaaggacttcaacagcaaggtgacccacctggtggccaactgcacccagggcgagaagttcagagtggccgtgagcctgggcacccccatcatgaagcccgagtggatctacaaggcctgggagagaagaaacgagcaggacttctacgccgccgtggacgacttcagaaacgagttcaaggtgccccccttccaggactgcatcctgagcttcctgggcttcagcgacgaggagaagaccaacatggaggagatgaccgagatgcagggcggcaagtacctgcccctgggcgacgagagatgcacccacctggtggtggaggagaacatcgtgaaggacctgcccttcgagcccagcaagaagctgtacgtggtgaagcaggagtggttctggggcagcatccagatggacgccagagccggcgagaccatgtacctgtacgagaaggccaacacccccgagctgaagaagagcgtgagcatgctgagcctgaacacccccaacagcaacagaaagagaagaagactgaaggagaccctggcccagctgagcagagagaccgacgtgagccccttcccccccagaaagagacccagcgccgagcacagcctgagcatcggcagcctgctggacatcagcaacacccccgagagcagcatcaactacggcgacacccccaagagctgcaccaagagcagcaagagcagcacccccgtgcccagcaagcagagcgccagatggcaggtggccaaggagctgtaccagaccgagagcaactacgtgaacatcctggccaccatcatccagctgttccaggtgcccctggaggaggagggccagagaggcggccccatcctggcccccgaggagatcaagaccatcttcggcagcatccccgacatcttcgacgtgcacaccaagatcaaggacgacctggaggacctgatcgtgaactgggacgagagcaagagcatcggcgacatcttcctgaagtacagcaaggacctggtgaagacctacccccccttcgtgaacttcttcgagatgagcaaggagaccatcatcaagtgcgagaagcagaagcccagattccacgccttcctgaagatcaaccaggccaagcccgagtgcggcagacagagcctggtggagctgctgatcagacccgtgcagagactgcccagcgtggccctgctgctgaacgacctgaagaagcacaccgccgacgagaaccccgacaagagcaccctggagaaggccatcggcagcctgaaggaggtgatgacccacatcaacgaggacaagagaaagaccgaggcccagaagcagatcttcgacgtggtgtacgaggtggacggctgccccgccaacctgctgagcagccacagaagcctggtgcagagagtggagaccatcagcctgggcgagcacccctgcgacagaggcgagcaggtgaccctgttcctgttcaacgactgcctggagatcgccagaaagagacacaaggtgatcggcaccttcagaagcccccacggccagaccagaccccccgccagcctgaagcacatccacctgatgcccctgagccagatcaagaaggtgctggacatcagagagaccgaggactgccacaacgccttcgccctgctggtgagaccccccaccgagcaggccaacgtgctgctgagcttccagatgaccagcgacgagctgcccaaggagaactggctgaagatgctgtgcagacacgtggccaacaccatctgcaaggccgacgccgagaacctgatctacaccgccgaccccgagagcttcgaggtgaacaccaaggacatggacagcaccctgagcagagccagcagagccatcaagaagaccagcaagaaggtgaccagagccttcagcttcagcaagacccccaagagagccctgagaagagccctgatgaccagccacggcagcgtggagggcagaagccccagcagcaacgacaagcacgtgatgagcagactgagcagcaccagcagcctggccggcatccccagccccagcctggtgagcctgcccagcttcttcgagagaagaagccacaccctgagcagaagcaccacccacctgatctag

SEQ ID NO: 10526 - DNA, 2745 bp, Artificial Sequence; identical to SEQ ID NO: 10520
  Description of Artificial Sequence: Synthetic coding sequence

SEQ ID NO: 10527 - DNA, 1389 bp, Artificial Sequence
  Description of Artificial Sequence: Synthetic coding sequence
atgagcatcgccggcgtggccgcccaggagatcagagtgcccctgaagaccggcttcctgcacaacggcagagccatgggcaacatgagaaagacctactggagcagcagaagcgagttcaagaacaacttcctgaacatcgaccccatcaccatggcctacagcctgaacagcagcgcccaggagagactgatccccctgggccacgccagcaagagcgcccccatgaacggccactgcttcgccgagaacggccccagccagaagagcagcctgccccccctgctgatcccccccagcgagaacctgggcccccacgaggaggaccaggtggtgtgcggcttcaagaagctgaccgtgaacggcgtgtgcgccagcaccccccccctgacccccatcaagaacagccccagcctgttcccctgcgcccccctgtgcgagagaggcagcagacccctgccccccctgcccatcagcgaggccctgagcctggacgacaccgactgcgaggtggagttcctgaccagcagcgacaccgacttcctgctggaggacagcaccctgagcgacttcaagtacgacgtgcccggcagaagaagcttcagaggctgcggccagatcaactacgcctacttcgacacccccgccgtgagcgccgccgacctgagctacgtgagcgaccagaacggcggcgtgcccgaccccaaccccccccccccccagacccacagaagactgagaagaagccacagcggccccgccggcagcttcaacaagcccgccatcagaatcagcaactgctgcatccacagagccagccccaacagcgacgaggacaagcccgaggtgccccccagagtgcccatcccccccagacccgtgaagcccgactacagaagatggagcgccgaggtgaccagcagcacctacagcgacgaggacagaccccccaaggtgccccccagagagcccctgagccccagcaacagcagaacccccagccccaagagcctgcccagctacctgaacggcgtgatgccccccacccagagcttcgcccccgaccccaagtacgtgagcagcaaggccctgcagagacagaacagcgagggcagcgccagcaaggtgccctgcatcctgcccatcatcgagaacggcaagaaggtgagcagcacccactactacctgctgcccgagagacccccctacctggacaagtacgagaagttcttcagagaggccgaggagaccaacggcggcgcccagatccagcccctgcccgccgactgcggcatcagcagcgccaccgagaagcccgacagcaagaccaagatggacctgggcggccacgtgaagagaaagcacctgagctacgtggtgagcccctag

SEQ ID NO: 10528 - DNA, 1713 bp, Artificial Sequence
  Description of Artificial Sequence: Synthetic coding sequence
atggccctgaagaagagcagccccagcctggacagcggcgacagcgacagcgaggagctgcccaccttcgccttcctgaagaaggagcccagcagcaccaagagaagacagcccgagagagaggagaagatcgtggtggtggacatcagcgactgcgaggccagctgcccccccgcccccgagctgttcagcccccccgtgcccgagatcgccgagaccgtgacccagacccagcccgtgagactgctgagcagcgagagcgaggacgaggaggagttcatccccctggcccagagactgacctgcaagttcctgacccacaagcagctgagccccgaggacagcagcagccccgtgaagagcgtgctggaccaccagaacaacgagggcgccagctgcgactggaagaagcccttccccaagatccccgaggtgcccctgcacgacacccccgagagaagcgccgccgacaacaaggacctgatcctggacccctgctgccagctgcccgcctacctgagcacctgccccggccagagcagcagcctggccgtgaccaagaccaacagcgacatcctgcccccccagaagaagaccaagcccagccagaaggtgcagggcagaggcagccacggctgcagacagcagagacaggccagacagaaggagagcaccctgagaagacaggagagaaagaacgccgccctggtgaccagaatgaaggcccagagacccgaggagtgcctgaagcacatcatcgtggtgctggaccccgtgctgctgcagatggagggcggcggccagctgctgggcgccctgcagaccatggagtgcagatgcgtgatcgaggcccaggccgtgccctgcagcgtgacctggagaagaagagccggccccagcgaggacagagaggactgggtggaggagcccaccgtgctggtgctgctgagagccgaggccttcgtgagcatgatcgacaacggcaagcagggcagcctggacagcaccatgaagggcaaggagaccctgcagggcttcgtgaccgacatcaccgccaagaccgccggcaaggccctgagcctggtgatcgtggaccaggagaagtgcttcagcgcccagaacccccccagaagaggcaagcagggcgccaacaagcagaccaagaagcagcagcagagacagcccgaggccagcatcggcagcatggtgagcagagtggacgccgaggaggccctggtggacctgcagctgcacaccgaggcccaggcccagatcgtgcagagctggaaggagctggccgacttcacctgcgccttcaccaaggccgtggccgaggcccccttcaagaagctgagagacgagaccaccttcagcttctgcctggagagcgactgggccggcggcgtgaaggtggacctggccggcagaggcctggccctggtgtggagaagacagatccagcagctgaacagagtgagcctggagatggccagcgccgtggtgaacgcctaccccagcccccagctgctggtgcaggcctaccagcagtgcttcagcgacaaggagagacagaacctgctggccgacatccaggtgagaagaggcgagggcgtgaccagcaccagcagaagaatcggccccgagctgagcagaagaatctacctgcagatgaccaccctgcagccccacctgagcctggacagcgccgactag

SEQ ID NO: 10529 - DNA, 1752 bp, Artificial Sequence
  Description of Artificial Sequence: Synthetic coding sequence
atggccctgaagaagagcagccccagcctggacagcggcgacagcgacagcgaggagctgcccaccttcgccttcctgaagaaggagcccagcagcaccaagagaagacagcccgagagagaggagaagatcgtggtggtggacatcagcgactgcgaggccagctgcccccccgcccccgagctgttcagcccccccgtgcccgagatcgccgagaccgtgacccagacccagcccgtgagactgctgagcagcgagagcgaggacgaggaggagttcatccccctggcccagagactgacctgcaagttcctgacccacaagcagctgagccccgaggacagcagcagccccgtgaagagcgtgctggaccaccagaacaacgagggcgccagctgcgactggaagaagcccttccccaagatccccgaggtgcccctgcacgacacccccgagagaagcgccgccgacaacaaggacctgatcctggacccctgctgccagctgcccgcctacctgagcacctgccccggccagagcagcagcctggccgtgaccaagaccaacagcgacatcctgcccccccagaagaagaccaagcccagccagaaggtgcagggcagaggcagccacggctgcagacagcagagacaggccagacagaaggagagcaccctgagaagacaggagagaaagaacgccgccctggtgaccagaatgaaggcccagagacccgaggagtgcctgaagcacatcatcgtggtgctggaccccgtgctgctgcagatggagggcggcggccagctgctgggcgccctgcagaccatggagtgcagatgcgtgatcgaggcccaggccgtgccctgcagcgtgacctggagaagaagagccggccccagcgaggacagagaggactgggtggaggagcccaccgtgctggtgctgctgagagccgaggccttcgtgagcatgatcgacaacggcaagcagggcagcctggacagcaccatgaagggcaaggagaccctgcagggcttcgtgaccgacatcaccgccaagaccgccggcaaggccctgagcctggtgatcgtggaccaggagaagtgcttcagcctggagctgctgttcttcgacttcctgccctgcaccagcgcccagaacccccccagaagaggcaagcagggcgccaacaagcagaccaagaagcagcagcagagacagcccgaggccagcatcggcagcatggtgagcagagtggacgccgaggaggccctggtggacctgcagctgcacaccgaggcccaggcccagatcgtgcagagctggaaggagctggccgacttcacctgcgccttcaccaaggccgtggccgaggcccccttcaagaagctgagagacgagaccaccttcagcttctgcctggagagcgactgggccggcggcgtgaaggtggacctggccggcagaggcctggccctggtgtggagaagacagatccagcagctgaacagagtgagcctggagatggccagcgccgtggtgaacgcctaccccagcccccagctgctggtgcaggcctaccagcagtgcttcagcgacaaggagagacagaacctgctggccgacatccaggtgagaagaggcgagggcgtgaccagcaccagcagaagaatcggccccgagctgagcagaagaatctacctgcagatgaccaccctgcagccccacctgagcctggacagcgccgactag

SEQ ID NO: 10530 - DNA, 1752 bp, Artificial Sequence; identical to SEQ ID NO: 10529
  Description of Artificial Sequence: Synthetic coding sequence

SEQ ID NO: 10531 - DNA, 684 bp, Artificial Sequence
  Description of Artificial Sequence: Synthetic coding sequence
atggccgacctgctgggcagcatcctgagcagcatggagaagccccccagcctgggcgaccaggagaccagaagaaaggccagagagcaggccgccagactgaagaagctgcaggagcaggagaagcagcagaaggtggagttcagaaagagaatggagaaggaggtgagcgacttcatccaggacagcggccagatcaagaagaagttccagcccatgaacaagatcgagagaagcatcctgcacgacgtggtggaggtggccggcctgaccagcttcagcttcggcgaggacgacgactgcagatacgtgatgatcttcaagaaggagttcgcccccagcgacgaggagctggacagctacagaagaggcgaggagtgggacccccagaaggccgaggagaagagaaagctgaaggagctggcccagagacaggaggaggaggccgcccagcagggccccgtggtggtgagccccgccagcgactacaaggacaagtacagccacctgatcggcaagggcgccgccaaggacgccgcccacatgctgcaggccaacaagacctacggctgcgtgcccgtggccaacaagagagacaccagaagcatcgaggaggccatgaacgagatcagagccaagaagagactgagacagagcggcgaggagctgccccccaccagctag

SEQ ID NO: 10532 - DNA, 1788 bp, Artificial Sequence
  Description of Artificial Sequence: Synthetic coding sequence
atgaccatgaccctgcacaccaaggccagcggcatggccctgctgcaccagatccagggcaacgagctggagcccctgaacagaccccagctgaagatccccctggagagacccctgggcgaggtgtacctggacagcagcaagcccgccgtgtacaactaccccgagggcgccgcctacgagttcaacgccgccgccgccgccaacgcccaggtgtacggccagaccggcctgccctacggccccggcagcgaggccgccgccttcggcagcaacggcctgggcggcttcccccccctgaacagcgtgagccccagccccctgatgctgctgcacccccccccccagctgagccccttcctgcagccccacggccagcaggtgccctactacctggagaacgagcccagcggctacaccgtgagagaggccggcccccccgccttctacagacccaacagcgacaacagaagacagggcggcagagagagactggccagcaccaacgacaagggcagcatggccatggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagagacagagagacgacggcgagggcagaggcgaggtgggcagcgccggcgacatgagagccgccaacctgtggcccagccccctgatgatcaagagaagcaagaagaacagcctggccctgagcctgaccgccgaccagatggtgagcgccctgctggacgccgagccccccatcctgtacagcgagtacgaccccaccagacccttcagcgaggccagcatgatgggcctgctgaccaacctggccgacagagagctggtgcacatgatcaactgggccaagagagtgcccggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcgtgtacaccttcctgagcagcaccctgaagagcctggaggagaaggaccacatccacagagtgctggacaagatcaccgacaccctgatccacctgatggccaaggccggcctgaccctgcagcagcagcaccagagactggcccagctgctgctgatcctgagccacatcagacacatgagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 10533 - DNA, 549 bp, Artificial Sequence
  Description of Artificial Sequence: Synthetic coding sequence
atggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagctgctgctgatcctgagccacatcagacacatgagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 10534 - DNA, 255 bp, Artificial Sequence
  Description of Artificial Sequence: Synthetic coding sequence
atgaccatgaccctgcacaccaaggccagcggcatggccctgctgcaccagatccagggcaacgagctggagcccctgaacagaccccagctgaagatccccctggagagacccctgggcgaggtgtacctggacagcagcaagcccgccgtgtacaactaccccgagggcgccgcctacgagttcaacgccgccgccgccgccaacgcccaggtgtacggccagaccggcctgccctacggccccggcagctag

SEQ ID NO: 10535 - DNA, 1005 bp, Artificial Sequence
  Description of Artificial Sequence: Synthetic coding sequence
atgaccatgaccctgcacaccaaggccagcggcatggccctgctgcaccagatccagggcaacgagctggagcccctgaacagaccccagctgaagatccccctggagagacccctgggcgaggtgtacctggacagcagcaagcccgccgtgtacaactaccccgagggcgccgcctacgagttcaacgccgccgccgccgccaacgcccaggtgtacggccagaccggcctgccctacggccccggcagcgaggccgccgccttcggcagcaacggcctgggcggcttcccccccctgaacagcgtgagccccagccccctgatgctgctgcacccccccccccagctgagccccttcctgcagccccacggccagcaggtgccctactacctggagaacgagcccagcggctacaccgtgagagaggccggcccccccgccttctacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcgtgtacaccttcctgagcagcaccctgaagagcctggaggagaaggaccacatccacagagtgctggacaagatcaccgacaccctgatccacctgatggccaaggccggcctgaccctgcagcagcagcaccagagactggcccagctgctgctgatcctgagccacatcagacacatgagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 10536 - DNA, 324 bp, Artificial Sequence
  Description of Artificial Sequence: Synthetic coding sequence
cacaacgactacatgtgccccgccaccaaccagtgcaccatcgacaagaacagaagaaagagctgccaggcctgcagactgagaaagtgctacgaggtgggcatgatgaagggcggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagatag

SEQ ID NO: 10537 - DNA, 1167 bp, Artificial Sequence
  Description of Artificial Sequence: Synthetic coding sequence
tgactgaagatcatcagctgccagcccagcgacaagcccgtgccccccggcgagaacgcccccgagtggagagccggccagcccggcagcgcccccagaagccactgcggcagaagcgccgccggccccggccacagaagacccctgtgcgacttcaacggcgagggccccaacagcgacaacagaagacagggcggcagagagagactggccagcaccaacgacaagggcagcatggccatggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagagacagagagacgacggcgagggcagaggcgaggtgggcagcgccggcgacatgagagccgccaacctgtggcccagccccctgatgatcaagagaagcaagaagaacagcctggccctgagcctgaccgccgaccagatggtgagcgccctgctggacgccgagccccccatcctgtacagcgagtacgaccccaccagacccttcagcgaggccagcatgatgggcctgctgaccaacctggccgacagagagctggtgcacatgatcaactgggccaagagagtgcccggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcatcagccacgtggaggccaagaagagaatcctgaacctgcaccccaagatcttcggcaacaagtggttccccagagtgtag

SEQ ID NO: 10538 - DNA, 813 bp, Artificial Sequence
  Description of Artificial Sequence: Synthetic coding sequence
atgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagagacagagagacgacggcgagggcagaggcgaggtgggcagcgccggcgacatgagagccgccaacctgtggcccagccccctgatgatcaagagaagcaagaagaacagcctggccctgagcctgaccgccgaccagatggtgagcgccctgctggacgccgagccccccatcctgtacagcgagtacgaccccaccagacccttcagcgaggccagcatgatgggcctgctgaccaacctggccgacagagagctggtgcacatgatcaactgggccaagagagtgcccggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 10539 - DNA, 1572 bp, Artificial Sequence
  Description of Artificial Sequence: Synthetic coding sequence
atgaccatgaccctgcacaccaaggccagcggcatggccctgctgcaccagatccagggcaacgagctggagcccccccccctgaacagcgtgagccccagccccctgatgctgctgcacccccccccccagctgagccccttcctgcagccccacggccagcaggtgccctactacctggagaacgagcccagcggctacaccgtgagagaggccggcccccccgccttctacagacccaacagcgacaacagaagacagggcggcagagagagactggccagcaccaacgacaagggcagcatggccatggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagagacagagagacgacggcgagggcagaggcgaggtgggcagcgccggcgacatgagagccgccaacctgtggcccagccccctgatgatcaagagaagcaagaagaacagcctggccctgagcctgaccgccgaccagatggtgagcgccctgctggacgccgagccccccatcctgtacagcgagtacgaccccaccagacccttcagcgaggccagcatgatgggcctgctgaccaacctggccgacagagagctggtgcacatgatcaactgggccaagagagtgcccggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcgtgtacaccttcctgagcagcaccctgaagagcctggaggagaaggaccacatccacagagtgctggacaagatcaccgacaccctgatccacctgatggccaaggccggcctgaccctgcagcagcagcaccagagactggcccagctgctgctgatcctgagccacatcagacacatgagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 10540 - DNA, 1788 bp, Artificial Sequence; identical to SEQ ID NO: 10532
  Description of Artificial Sequence: Synthetic coding sequence

SEQ ID NO: 10541 - DNA, 1788 bp, Artificial Sequence; identical to SEQ ID NO: 10532
  Description of Artificial Sequence: Synthetic coding sequence

SEQ ID NO: 10542 - DNA, 348 bp, Artificial Sequence
  Description of Artificial Sequence: Synthetic coding sequence
atgaccatgaccctgcacaccaaggccagcggcatggccctgctgcaccagatccagggcaacgagctggagcccctgaacagaccccagctgaagatccccctggagagacccctgggcgaggtgtacctggacagcagcaagcccgccgtgtacaactaccccgagggcgccgcctacgagttcaacgccgccgccgccgccaacgcccaggtgtacggccagaccggcctgccctacggccccggcagcgaggccgccgccttcggcagcaacggcctgggcggcttcccccccctgaacagcgtgagccccagccccctgatgctgctgcacccccccccctag

SEQ ID NO: 10543 - DNA, 1452 bp, Artificial Sequence
  Description of Artificial Sequence: Synthetic coding sequence
atgaccatgaccctgcacaccaaggccagcggcatggccctgctgcaccagatccagggcaacgagctggagcccctgaacagaccccagctgaagatccccctggagagacccctgggcgaggtgtacctggacagcagcaagcccgccgtgtacaactaccccgagggcgccgcctacgagttcaacgccgccgccgccgccaacgcccaggtgtacggccagaccggcctgccctacggccccggcagcgaggccgccgccttcggcagcaacggcctgggcggcttcccccccctgaacagcgtgagccccagccccctgatgctgctgcacccccccccccagctgagccccttcctgcagccccacggccagcaggtgccctactacctggagaacgagcccagcggctacaccgtgagagaggccggcccccccgccttctacagacccaacagcgacaacagaagacagggcggcagagagagactggccagcaccaacgacaagggcagcatggccatggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcgtgtacaccttcctgagcagcaccctgaagagcctggaggagaaggaccacatccacagagtgctggacaagatcaccgacaccctgatccacctgatggccaaggccggcctgaccctgcagcagcagcaccagagactggcccagctgctgctgatcctgagccacatcagacacatgagcaacaagggcatggagcacctgtacagcatgaagtgcaagaacgtggtgcccctgtacgacctgctgctggagatgctggacgcccacagactgcacgcccccaccagcagaggcggcgccagcgtggaggagaccgaccagagccacctggccaccgccggcagcaccagcagccacagcctgcagaagtactacatcaccggcgaggccgagggcttccccgccaccgtgtag

SEQ ID NO: 10544 - DNA, 933 bp, Artificial Sequence
  Description of Artificial Sequence: Synthetic coding sequence
atggccatggagagcgccaaggagaccagatactgcgccgtgtgcaacgactacgccagcggctaccactacggcgtgtggagctgcgagggctgcaaggccttcttcaagagaagcatccagggccacaacgactacatgtgccccgccaccaaccagtgcaccatcgacaagaacagaagaaagagctgccaggcctgcagactgagaaagtgctacgaggtgggcatgatgaagggcggcatcagaaaggacagaagaggcggcagaatgctgaagcacaagagacagagagacgacggcgagggcagaggcgaggtgggcagcgccggcgacatgagagccgccaacctgtggcccagccccctgatgatcaagagaagcaagaagaacagcctggccctgagcctgaccgccgaccagatggtgagcgccctgctggacgccgagccccccatcctgtacagcgagtacgaccccaccagacccttcagcgaggccagcatgatgggcctgctgaccaacctggccgacagagagctggtgcacatgatcaactgggccaagagagtgcccggcttcgtggacctgaccctgcacgaccaggtgcacctgctggagtgcgcctggctggagatcctgatgatcggcctggtgtggagaagcatggagcaccccggcaagctgctgttcgcccccaacctgctgctggacagaaaccagggcaagtgcgtggagggcatggtggagatcttcgacatgctgctggccaccagcagcagattcagaatgatgaacctgcagggcgaggagttcgtgtgcctgaagagcatcatcctgctgaacagcggcatcagccacgtggaggccaagaagagaatcctgaacctgcaccccaagatcttcggcaacaagtggttccccagagtgtag

SEQ ID NO: 10545 - DNA, 1320 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctacgtggacagccaccacgagtaccccgccatgaccttctacagccccgccgtgatgaactacagcatccccagcaacgtgaccaacctggagggcggccccggcagacagaccaccagccccaacgtgctgtggcccacccccggccacctgagccccctggtggtgcacagacagctgagccacctgtacgccgagccccagaagagcccctggtgcgaggccagaagcctggagcacaccctgcccgtgaacagagagaccctgaagagaaaggtgagcggcaacagatgcgccagccccgtgaccggccccggcagcaagagagacgcccacttctgcgccgtgtgcagcgactacgccagcggctaccactacggcgtgtggagctgcgagggctgcaaggccttcttcaagagaagcatccagggccacaacgactacatctgccccgccaccaaccagtgcaccatcgacaagaacagaagaaagagctgccaggcctgcagactgagaaagtgctacgaggtgggcatggtgaagtgcggcagcagaagagagagatgcggctacagactggtgagaagacagagaagcgccgacgagcagctgcactgcgccggcaaggccaagagaagcggcggccacgcccccagagtgagagagctgctgctggacgccctgagccccgagcagctggtgctgaccctgctggaggccgagcccccccacgtgctgatcagcagacccagcgcccccttcaccgaggccagcatgatgatgagcctgaccaagctggccgacaaggagctggtgcacatgatcagctgggccaagaagatccccggcatgtaccccctggtgaccgccacccaggacgccgacagcagcagaaagctggcccacctgctgaacgccgtgaccgacgccctggtgtgggtgatcgccaagagcggcatcagcagccagcagcagagcatgagactggccaacctgctgatgctgctgagccacgtgagacacgccagcaacaagggcatggagcacctgctgaacatgaagtgcaagaacgtggtgcccgtgtacgacctgctgctggagatgctgaacgcccacgtgctgagaggctgcaagagcagcatcaccggcagcgagtgcagccccgccgaggacagcaagagcaaggagggcagccagaacccccagagccagtag

SEQ ID NO: 10546 - DNA, 1593 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctacgtggacagccaccacgagtaccccgccatgaccttctacagccccgccgtgatgaactacagcatccccagcaacgtgaccaacctggagggcggccccggcagacagaccaccagccccaacgtgctgtggcccacccccggccacctgagccccctggtggtgcacagacagctgagccacctgtacgccgagccccagaagagcccctggtgcgaggccagaagcctggagcacaccctgcccgtgaacagagagaccctgaagagaaaggtgagcggcaacagatgcgccagccccgtgaccggccccggcagcaagagagacgcccacttctgcgccgtgtgcagcgactacgccagcggctaccactacggcgtgtggagctgcgagggctgcaaggccttcttcaagagaagcatccagggccacaacgactacatctgccccgccaccaaccagtgcaccatcgacaagaacagaagaaagagctgccaggcctgcagactgagaaagtgctacgaggtgggcatggtgaagtgcggcagcagaagagagagatgcggctacagactggtgagaagacagagaagcgccgacgagcagctgcactgcgccggcaaggccaagagaagcggcggccacgcccccagagtgagagagctgctgctggacgccctgagccccgagcagctggtgctgaccctgctggaggccgagcccccccacgtgctgatcagcagacccagcgcccccttcaccgaggccagcatgatgatgagcctgaccaagctggccgacaaggagctggtgcacatgatcagctgggccaagaagatccccggcttcgtggagctgagcctgttcgaccaggtgagactgctggagagctgctggatggaggtgctgatgatgggcctgatgtggagaagcatcgaccaccccggcaagctgatcttcgcccccgacctggtgctggacagagacgagggcaagtgcgtggagggcatcctggagatcttcgacatgctgctggccaccaccagcagattcagagagctgaagctgcagcacaaggagtacctgtgcgtgaaggccatgatcctgctgaacagcagcatgtaccccctggtgaccgccacccaggacgccgacagcagcagaaagctggcccacctgctgaacgccgtgaccgacgccctggtgtgggtgatcgccaagagcggcatcagcagccagcagcagagcatgagactggccaacctgctgatgctgctgagccacgtgagacacgccagcaacaagggcatggagcacctgctgaacatgaagtgcaagaacgtggtgcccgtgtacgacctgctgctggagatgctgaacgcccacgtgctgagaggctgcaagagcagcatcaccggcagcgagtgcagccccgccgaggacagcaagagcaaggagggcagccagaacccccagagccagtag

SEQ ID NO: 10547 - DNA, 1488 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctacgtggacagccaccacgagtaccccgccatgaccttctacagccccgccgtgatgaactacagcatccccagcaacgtgaccaacctggagggcggccccggcagacagaccaccagccccaacgtgctgtggcccacccccggccacctgagccccctggtggtgcacagacagctgagccacctgtacgccgagccccagaagagcccctggtgcgaggccagaagcctggagcacaccctgcccgtgaacagagagaccctgaagagaaaggtgagcggcaacagatgcgccagccccgtgaccggccccggcagcaagagagacgcccacttctgcgccgtgtgcagcgactacgccagcggctaccactacggcgtgtggagctgcgagggctgcaaggccttcttcaagagaagcatccagggccacaacgactacatctgccccgccaccaaccagtgcaccatcgacaagaacagaagaaagagctgccaggcctgcagactgagaaagtgctacgaggtgggcatggtgaagtgcggcagcagaagagagagatgcggctacagactggtgagaagacagagaagcgccgacgagcagctgcactgcgccggcaaggccaagagaagcggcggccacgcccccagagtgagagagctgctgctggacgccctgagccccgagcagctggtgctgaccctgctggaggccgagcccccccacgtgctgatcagcagacccagcgcccccttcaccgaggccagcatgatgatgagcctgaccaagctggccgacaaggagctggtgcacatgatcagctgggccaagaagatccccggcttcgtggagctgagcctgttcgaccaggtgagactgctggagagctgctggatggaggtgctgatgatgggcctgatgtggagaagcatcgaccaccccggcaagctgatcttcgcccccgacctggtgctggacagagacgagggcaagtgcgtggagggcatcctggagatcttcgacatgctgctggccaccaccagcagattcagagagctgaagctgcagcacaaggagtacctgtgcgtgaaggccatgatcctgctgaacagcagcatgtaccccctggtgaccgccacccaggacgccgacagcagcagaaagctggcccacctgctgaacgccgtgaccgacgccctggtgtgggtgatcgccaagagcggcatcagcagccagcagcagagcatgagactggccaacctgctgatgctgctgagccacgtgagacacgccagagccgagaaggccagccagaccctgaccagcttcggcatgaagatggagaccctgctgcccgaggccaccatggagcagtag

SEQ ID NO: 10548 - DNA, 1446 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctacgtggacagccaccacgagtaccccgccatgaccttctacagccccgccgtgatgaactacagcatccccagcaacgtgaccaacctggagggcggccccggcagacagaccaccagccccaacgtgctgtggcccacccccggccacctgagccccctggtggtgcacagacagctgagccacctgtacgccgagccccagaagagcccctggtgcgaggccagaagcctggagcacaccctgcccgtgaacagagagaccctgaagagaaaggtgagcggcaacagatgcgccagccccgtgaccggccccggcagcaagagagacgcccacttctgcgccgtgtgcagcgactacgccagcggctaccactacggcgtgtggagctgcgagggctgcaaggccttcttcaagagaagcatccagggccacaacgactacatctgccccgccaccaaccagtgcaccatcgacaagaacagaagaaagagctgccaggcctgcagactgagaaagtgctacgaggtgggcatggtgaagtgcggcagcagaagagagagatgcggctacagactggtgagaagacagagaagcgccgacgagcagctgcactgcgccggcaaggccaagagaagcggcggccacgcccccagagtgagagagctgctgctggacgccctgagccccgagcagctggtgctgaccctgctggaggccgagcccccccacgtgctgatcagcagacccagcgcccccttcaccgaggccagcatgatgatgagcctgaccaagctggccgacaaggagctggtgcacatgatcagctgggccaagaagatccccggcttcgtggagctgagcctgttcgaccaggtgagactgctggagagctgctggatggaggtgctgatgatgggcctgatgtggagaagcatcgaccaccccggcaagctgatcttcgcccccgacctggtgctggacagagacgagggcaagtgcgtggagggcatcctggagatcttcgacatgctgctggccaccaccagcagattcagagagctgaagctgcagcacaaggagtacctgtgcgtgaaggccatgatcctgctgaacagcagcatgtaccccctggtgaccgccacccaggacgccgacagcagcagaaagctggcccacctgctgaacgccgtgaccgacgccctggtgtgggtgatcgccaagagcggcatcagcagccagcagcagagcatgagactggccaacctgctgatgctgctgagccacgtgagacacgccagatggggcgagaagcagttcatccacctgaagctgagctag

SEQ ID NO: 10549 - DNA, 1488 bp, Artificial Sequence; identical to SEQ ID NO: 10547
  Description of Artificial Sequence: Synthetic coding sequence

SEQ ID NO: 10550 - DNA, 1542 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctacgtggacagccaccacgagtaccccgccatgaccttctacagccccgccgtgatgaactacagcatccccagcaacgtgaccaacctggagggcggccccggcagacagaccaccagccccaacgtgctgtggcccacccccggccacctgagccccctggtggtgcacagacagctgagccacctgtacgccgagccccagaagagcccctggtgcgaggccagaagcctggagcacaccctgcccgtgaacagagagaccctgaagagaaaggtgagcggcaacagatgcgccagccccgtgaccggccccggcagcaagagagacgcccacttctgcgccgtgtgcagcgactacgccagcggctaccactacggcgtgtggagctgcgagggctgcaaggccttcttcaagagaagcatccagggccacaacgactacatctgccccgccaccaaccagtgcaccatcgacaagaacagaagaaagagctgccaggcctgcagactgagaaagtgctacgaggtgggcatggtgaagtgcggcagcagaagagagagatgcggctacagactggtgagaagacagagaagcgccgacgagcagctgcactgcgccggcaaggccaagagaagcggcggccacgcccccagagtgagagagctgctgctggacgccctgagccccgagcagctggtgctgaccctgctggaggccgagcccccccacgtgctgatcagcagacccagcgcccccttcaccgaggccagcatgatgatgagcctgaccaagctggccgacaaggagctggtgcacatgatcagctgggccaagaagatccccggcttcgtggagctgagcctgttcgaccaggtgagactgctggagagctgctggatggaggtgctgatgatgggcctgatgtggagaagcatcgaccaccccggcaagctgatcttcgcccccgacctggtgctggacagagacgagggcaagtgcgtggagggcatcctggagatcttcgacatgctgctggccaccaccagcagattcagagagctgaagctgcagcacaaggagtacctgtgcgtgaaggccatgatcctgctgaacagcagcatgtaccccctggtgaccgccacccaggacgccgacagcagcagaaagctggcccacctgctgaacgccgtgaccgacgccctggtgtgggtgatcgccaagagcggcatcagcagccagcagcagagcatgagactggccaacctgctgatgctgctgagccacgtgagacacgccagcagcctgagcctgagctggagactgttcatgctgagagaggccagctgccacggcgtgagacagacccccggcggcgcccacgtgagcgtgagcagaagcagaagcttcgaggcctgccagcagcccagagagtag

SEQ ID NO: 10551 - DNA, 1488 bp, Artificial Sequence; identical to SEQ ID NO: 10547
  Description of Artificial Sequence: Synthetic coding sequence

SEQ ID NO: 10552 - DNA, 1419 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctacgtggacagccaccacgagtaccccgccatgaccttctacagccccgccgtgatgaactacagcatccccagcaacgtgaccaacctggagggcggccccggcagacagaccaccagccccaacgtgctgtggcccacccccggccacctgagccccctggtggtgcacagacagctgagccacctgtacgccgagccccagaagagcccctggtgcgaggccagaagcctggagcacaccctgcccgtgaacagagagaccctgaagagaaaggtgagcggcaacagatgcgccagccccgtgaccggccccggcagcaagagagacgcccacttctgcgccgtgtgcagcgactacgccagcggctaccactacggcgtgtggagctgcgagggctgcaaggccttcttcaagagaagcatccagggccacaacgactacatctgccccgccaccaaccagtgcaccatcgacaagaacagaagaaagagctgccaggcctgcagactgagaaagtgctacgaggtgggcatggtgaagtgcggcagcagaagagagagatgcggctacagactggtgagaagacagagaagcgccgacgagcagctgcactgcgccggcaaggccaagagaagcggcggccacgcccccagagtgagagagctgctgctggacgccctgagccccgagcagctggtgctgaccctgctggaggccgagcccccccacgtgctgatcagcagacccagcgcccccttcaccgaggccagcatgatgatgagcctgaccaagctggccgacaaggagctggtgcacatgatcagctgggccaagaagatccccggcttcgtggagctgagcctgttcgaccaggtgagactgctggagagctgctggatggaggtgctgatgatgggcctgatgtggagaagcatcgaccaccccggcaagctgatcttcgcccccgacctggtgctggacagagacgagggcaagtgcgtggagggcatcctggagatcttcgacatgctgctggccaccaccagcagattcagagagctgaagctgcagcacaaggagtacctgtgcgtgaaggccatgatcctgctgaacagcagcatgtaccccctggtgaccgccacccaggacgccgacagcagcagaaagctggcccacctgctgaacgccgtgaccgacgccctggtgtgggtgatcgccaagagcggcatcagcagccagcagcagagcatgagactggccaacctgctgatgctgctgagccacgtgagacacgccagatacgccccctag

SEQ ID NO: 10553 - DNA, 1446 bp, Artificial Sequence; identical to SEQ ID NO: 10548
  Description of Artificial Sequence: Synthetic coding sequence

SEQ ID NO: 10554 - DNA, 1380 bp, Artificial Sequence
  Description of Artificial Sequence: Synthetic coding sequence
atggacggcttctacgaccagcaggtgccctacatggtgaccaacagccagagaggcagaaactgcaacgagaagcccaccaacgtgagaaagagaaagttcatcaacagagacctggcccacgacagcgaggagctgttccaggacctgagccagctgcaggagacctggctggccgaggtggccttccacggcctgcccctgaagatcaagaaggagccccacagcccctgcagcgagatcagcagcgcctgcagccaggagcagcccttcaagttcagctacggcgagaagtgcctgtacaacgtgagcgcctacgaccagaagccccaggtgggcatgagacccagcaacccccccacccccagcagcacccccgtgagccccctgcaccacgccagccccaacagcacccacacccccaagcccgacagagccttccccgcccacctgccccccagccagagcatccccgacagcagctaccccatggaccacagattcagaagacagctgagcgagccctgcaacagcttcccccccctgcccaccatgcccagagagggcagacccatgtaccagagacagatgagcgagcccaacatccccttccccccccagggcttcaagcaggagtaccacgaccccgtgtacgagcacaacaccatggtgggcagcgccgccagccagagcttccccccccccctgatgatcaagcaggagcccagagacttcgcctacgacagcgaggtgcccagctgccacagcatctacatgagacaggagggcttcctggcccaccccagcagaaccgagggctgcatgttcgagaagggccccagacagttctacgacgacacctgcgtggtgcccgagaagttcgacggcgacatcaagcaggagcccggcatgtacagagagggccccacctaccagagaagaggcagcctgcagctgtggcagttcctggtggccctgctggacgaccccagcaacagccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgaggccctgttcagcatggccttccccgacaaccagagacccctgctgaagaccgacatggagagacacatcaacgaggaggacaccgtgcccctgagccacttcgacgagagcatggcctacatgcccgagggcggctgctgcaacccccacccctacaacgagggctacgtgtactag

SEQ ID NO: 10555 - DNA, 1380 bp, Artificial Sequence; identical to SEQ ID NO: 10554
  Description of Artificial Sequence: Synthetic coding sequence

SEQ ID NO: 10556 - DNA, 1125 bp, Artificial Sequence
  Description of Artificial Sequence: Synthetic coding sequence
atgctgcaggacctgagcgccagcgtgttcttccccccctgcagccagcacagaaccctggcccaggtgcccgacaacgacgagcagttcgtgcccgactaccaggccgagagcctggccttccacggcctgcccctgaagatcaagaaggagccccacagcccctgcagcgagatcagcagcgcctgcagccaggagcagcccttcaagttcagctacggcgagaagtgcctgtacaacgtgagattcagaagacagctgagcgagccctgcaacagcttcccccccctgcccaccatgcccagagagggcagacccatgtaccagagacagatgagcgagcccaacatccccttccccccccagggcttcaagcaggagtaccacgaccccgtgtacgagcacaacaccatggtgggcagcgccgccagccagagcttccccccccccctgatgatcaagcaggagcccagagacttcgcctacgacagcgaggtgcccagctgccacagcatctacatgagacaggagggcttcctggcccaccccagcagaaccgagggctgcatgttcgagaagggccccagacagttctacgacgacacctgcgtggtgcccgagaagttcgacggcgacatcaagcaggagcccggcatgtacagagagggccccacctaccagagaagaggcagcctgcagctgtggcagttcctggtggccctgctggacgaccccagcaacagccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgaggccctgttcagcatggccttccccgacaaccagagacccctgctgaagaccgacatggagagacacatcaacgaggaggacaccgtgcccctgagccacttcgacgagagcatggcctacatgcccgagggcggctgctgcaacccccacccctacaacgagggctacgtgtactag

SEQ ID NO: 10557 - DNA, 1380 bp, Artificial Sequence; identical to SEQ ID NO: 10554
  Description of Artificial Sequence: Synthetic coding sequence

SEQ ID NO: 10558 - DNA, 1434 bp, Artificial Sequence
  Description of Artificial Sequence: Synthetic coding sequence
atggacggcttctacgaccagcaggtgccctacatggtgaccaacagccagagaggcagaaactgcaacgagaagcccaccaacgtgagaaagagaaagttcatcaacagagacctggcccacgacagcgaggagctgttccaggacctgagccagctgcaggagacctggctggccgaggcccaggtgcccgacaacgacgagcagttcgtgcccgactaccaggccgagagcctggccttccacggcctgcccctgaagatcaagaaggagccccacagcccctgcagcgagatcagcagcgcctgcagccaggagcagcccttcaagttcagctacggcgagaagtgcctgtacaacgtgagcgcctacgaccagaagccccaggtgggcatgagacccagcaacccccccacccccagcagcacccccgtgagccccctgcaccacgccagccccaacagcacccacacccccaagcccgacagagccttccccgcccacctgccccccagccagagcatccccgacagcagctaccccatggaccacagattcagaagacagctgagcgagccctgcaacagcttcccccccctgcccaccatgcccagagagggcagacccatgtaccagagacagatgagcgagcccaacatccccttccccccccagggcttcaagcaggagtaccacgaccccgtgtacgagcacaacaccatggtgggcagcgccgccagccagagcttccccccccccctgatgatcaagcaggagcccagagacttcgcctacgacagcgaggtgcccagctgccacagcatctacatgagacaggagggcttcctggcccaccccagcagaaccgagggctgcatgttcgagaagggccccagacagttctacgacgacacctgcgtggtgcccgagaagttcgacggcgacatcaagcaggagcccggcatgtacagagagggccccacctaccagagaagaggcagcctgcagctgtggcagttcctggtggccctgctggacgaccccagcaacagccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgaggccctgttcagcatggccttccccgacaaccagagacccctgctgaagaccgacatggagagacacatcaacgaggaggacaccgtgcccctgagccacttcgacgagagcatggcctacatgcccgagggcggctgctgcaacccccacccctacaacgagggctacgtgtactag

SEQ ID NO: 10559 - DNA, 1260 bp, Artificial Sequence
  Description of Artificial Sequence: Synthetic coding sequence
atgctgcaggacctgagcgccagcgtgttcttccccccctgcagccagcacagaaccctggtggccttccacggcctgcccctgaagatcaagaaggagccccacagcccctgcagcgagatcagcagcgcctgcagccaggagcagcccttcaagttcagctacggcgagaagtgcctgtacaacgtgagcgcctacgaccagaagccccaggtgggcatgagacccagcaacccccccacccccagcagcacccccgtgagccccctgcaccacgccagccccaacagcacccacacccccaagcccgacagagccttccccgcccacctgccccccagccagagcatccccgacagcagctaccccatggaccacagattcagaagacagctgagcgagccctgcaacagcttcccccccctgcccaccatgcccagagagggcagacccatgtaccagagacagatgagcgagcccaacatccccttccccccccagggcttcaagcaggagtaccacgaccccgtgtacgagcacaacaccatggtgggcagcgccgccagccagagcttccccccccccctgatgatcaagcaggagcccagagacttcgcctacgacagcgaggtgcccagctgccacagcatctacatgagacaggagggcttcctggcccaccccagcagaaccgagggctgcatgttcgagaagggccccagacagttctacgacgacacctgcgtggtgcccgagaagttcgacggcgacatcaagcaggagcccggcatgtacagagagggccccacctaccagagaagaggcagcctgcagctgtggcagttcctggtggccctgctggacgaccccagcaacagccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgaggccctgttcagcatggccttccccgacaaccagagacccctgctgaagaccgacatggagagacacatcaacgaggaggacaccgtgcccctgagccacttcgacgagagcatggcctacatgcccgagggcggctgctgcaacccccacccctacaacgagggctacgtgtactag

SEQ ID NO: 10560 - DNA, 372 bp, Artificial Sequence
  Description of Artificial Sequence: Synthetic coding sequence
atggacggcttctacgaccagcaggtgccctacatggtgaccaacagccagagaggcagaaactgcaacgagaagcccaccaacgtgagaaagagaaagttcatcaacagagacctggcccacgacagcgaggagctgttccaggacctgagccagctgcaggagacctggctggccgaggcccaggtgcccgacaacgacgagcagttcgtgcccgactaccaggccgagagcctggccttccacggcctgcccctgaagatcaagaaggagccccacagcccctgcagcgagatcagcagcgcctgcagccaggagcagcccttcaagttcagctacggcgagaagtgcctgtacaacgtgagcgcctag

SEQ ID NO: 10561 - DNA, 1434 bp, Artificial Sequence; identical to SEQ ID NO: 10558
  Description of Artificial Sequence: Synthetic coding sequence

SEQ ID NO: 10562 - DNA, 288 bp, Artificial Sequence
  Description of Artificial Sequence: Synthetic coding sequence
atggacggcttctacgaccagcaggtgccctacatggtgaccaacagccagagaggcagaaactgcaacgagaagcccaccaacgtgagaaagagaaagttcatcaacagagacctggcccacgacagcgaggagctgttccaggacctgagccagctgcaggagacctggctggccgaggcccaggtgcccgacaacgacgagcagttcgtgcccgactaccaggccgagagcctggccttccacggcctgcccctgaagatcaagaaggagccccacagcccctag

SEQ ID NO: 10563 - DNA, 63 bp, Artificial Sequence
  Description of Artificial Sequence: Synthetic coding sequence
atggacggcttctacgaccagcaggtgccctacatggtgaccaacagccagagaggcagatag

SEQ ID NO: 10564 - DNA, 1314 bp, Artificial Sequence
  Description of Artificial Sequence: Synthetic coding sequence
atgctgcaggacctgagcgccagcgtgttcttccccccctgcagccagcacagaaccctggcccaggtgcccgacaacgacgagcagttcgtgcccgactaccaggccgagagcctggccttccacggcctgcccctgaagatcaagaaggagccccacagcccctgcagcgagatcagcagcgcctgcagccaggagcagcccttcaagttcagctacggcgagaagtgcctgtacaacgtgagcgcctacgaccagaagccccaggtgggcatgagacccagcaacccccccacccccagcagcacccccgtgagccccctgcaccacgccagccccaacagcacccacacccccaagcccgacagagccttccccgcccacctgccccccagccagagcatccccgacagcagctaccccatggaccacagattcagaagacagctgagcgagccctgcaacagcttcccccccctgcccaccatgcccagagagggcagacccatgtaccagagacagatgagcgagcccaacatccccttccccccccagggcttcaagcaggagtaccacgaccccgtgtacgagcacaacaccatggtgggcagcgccgccagccagagcttccccccccccctgatgatcaagcaggagcccagagacttcgcctacgacagcgaggtgcccagctgccacagcatctacatgagacaggagggcttcctggcccaccccagcagaaccgagggctgcatgttcgagaagggccccagacagttctacgacgacacctgcgtggtgcccgagaagttcgacggcgacatcaagcaggagcccggcatgtacagagagggccccacctaccagagaagaggcagcctgcagctgtggcagttcctggtggccctgctggacgaccccagcaacagccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgaggccctgttcagcatggccttccccgacaaccagagacccctgctgaagaccgacatggagagacacatcaacgaggaggacaccgtgcccctgagccacttcgacgagagcatggcctacatgcccgagggcggctgctgcaacccccacccctacaacgagggctacgtgtactag

SEQ ID NO: 10565 - DNA, 1365 bp, Artificial Sequence
  Description of Artificial Sequence: Synthetic coding sequence
atggacggcttctacgaccagcaggtgccctacatggtgaccaacagccagagaggcagaaactgcaacgagaagcccaccaacgtgagaaagagaaagttcatcaacagagacctggcccacgacagcgaggagctgttccaggacctgagccagctgcaggagacctggctggccgaggcccaggtgcccgacaacgacgagcagttcgtgcccgactaccaggccgagagcctggccttccacggcctgcccctgaagatcaagaaggagccccacagcccctgcagcgagatcagcagcgcctgcagccaggagcagcccttcaagttcagctacggcgagaagtgcctgtacaacgtgagcgcctacgaccagaagccccaggtgggcatgagacccagcaacccccccacccccagcagcacccccgtgagccccctgcaccacgccagccccaacagcacccacacccccaagcccgacagagccttccccgcccacctgccccccagccagagcatccccgacagcagctaccccatggaccacagattcagaagacagctgagcgagccctgcaacagcttcccccccctgcccaccatgcccagagagggcagacccatgtaccagagacagatgagcgagcccaacatccccttccccccccagggcttcaagcaggagtaccacgaccccgtgtacgagcacaacaccatggtgggcagcgccgccagccagagcttccccccccccctgatgatcaagcaggagcccagagacttcgcctacgacagcggctgcatgttcgagaagggccccagacagttctacgacgacacctgcgtggtgcccgagaagttcgacggcgacatcaagcaggagcccggcatgtacagagagggccccacctaccagagaagaggcagcctgcagctgtggcagttcctggtggccctgctggacgaccccagcaacagccacttcatcgcctggaccggcagaggcatggagttcaagctgatcgagcccgaggaggtggccagaagatggggcatccagaagaacagacccgccatgaactacgacaagctgagcagaagcctgagatactactacgagaagggcatcatgcagaaggtggccggcgagagatacgtgtacaagttcgtgtgcgaccccgaggccctgttcagcatggccttccccgacaaccagagacccctgctgaagaccgacatggagagacacatcaacgaggaggacaccgtgcccctgagccacttcgacgagagcatggcctacatgcccgagggcggctgctgcaacccccacccctacaacgagggctacgtgtactag

SEQ ID NO: 10566 - DNA, 1455 bp, Artificial Sequence
  Description of Artificial Sequence: Synthetic coding sequence
atggagagaagaatgaaggccggctacctggaccagcaggtgccctacaccttcagcagcaagagccccggcaacggcagcctgagagaggccctgatcggccccctgggcaagctgatggaccccggcagcctgccccccctggacagcgaggacctgttccaggacctgagccacttccaggagacctggctggccgaggcccaggtgcccgacagcgacgagcagttcgtgcccgacttccacagcgagaacctggccttccacagccccaccaccagaatcaagaaggagccccagagccccagaaccgaccccgccctgagctgcagcagaaagccccccctgccctaccaccacggcgagcagtgcctgtacagcagcgcctacgacccccccagacagatcgccatcaagagccccgcccccggcgccctgggccagagccccctgcagcccttccccagagccgagcagagaaacttcctgagaagcagcggcaccagccagccccaccccggccacggctacctgggcgagcacagcagcgtgttccagcagcccctggacatctgccacagcttcaccagccagggcggcggcagagagcccctgcccgccccctaccagcaccagctgagcgagccctgccccccctacccccagcagagcttcaagcaggagtaccacgaccccctgtacgagcaggccggccagcccgccgtggaccagggcggcgtgaacggccacagataccccggcgccggcgtggtgatcaagcaggagcagaccgacttcgcctacgacagcgacgtgaccggctgcgccagcatgtacctgcacaccgagggcttcagcggccccagccccggcgacggcgccatgggctacggctacgagaagcccctgagacccttccccgacgacgtgtgcgtggtgcccgagaagttcgagggcgacatcaagcaggagggcgtgggcgccttcagagagggccccccctaccagagaagaggcgccctgcagctgtggcagttcctggtggccctgctggacgaccccaccaacgcccacttcatcgcctggaccggcagaggcatggagttcaagctgatcgagcccgaggaggtggccagactgtggggcatccagaagaacagacccgccatgaactacgacaagctgagcagaagcctgagatactactacgagaagggcatcatgcagaaggtggccggcgagagatacgtgtacaagttcgtgtgcgagcccgaggccctgttcagcctggccttccccgacaaccagagacccgccctgaaggccgagttcgacagacccgtgagcgaggaggacaccgtgcccctgagccacctggacgagagccccgcctacctgcccgagctggccggccccgcccagcccttcggccccaagggcggctacagctactag

SEQ ID NO: 10567 - DNA, 1455 bp, Artificial Sequence; identical to SEQ ID NO: 10566
  Description of Artificial Sequence: Synthetic coding sequence

SEQ ID NO: 10568 - DNA, 1338 bp, Artificial Sequence
  Description of Artificial Sequence: Synthetic coding sequence
atggaccccggcagcctgccccccctggacagcgaggacctgttccaggacctgagccacttccaggagacctggctggccgaggcccaggtgcccgacagcgacgagcagttcgtgcccgacttccacagcgagaacctggccttccacagccccaccaccagaatcaagaaggagccccagagccccagaaccgaccccgccctgagctgcagcagaaagccccccctgccctaccaccacggcgagcagtgcctgtacagcagcgcctacgacccccccagacagatcgccatcaagagccccgcccccggcgccctgggccagagccccctgcagcccttccccagagccgagcagagaaacttcctgagaagcagcggcaccagccagccccaccccggccacggctacctgggcgagcacagcagcgtgttccagcagcccctggacatctgccacagcttcaccagccagggcggcggcagagagcccctgcccgccccctaccagcaccagctgagcgagccctgccccccctacccccagcagagcttcaagcaggagtaccacgaccccctgtacgagcaggccggccagcccgccgtggaccagggcggcgtgaacggccacagataccccggcgccggcgtggtgatcaagcaggagcagaccgacttcgcctacgacagcgacgtgaccggctgcgccagcatgtacctgcacaccgagggcttcagcggccccagccccggcgacggcgccatgggctacggctacgagaagcccctgagacccttccccgacgacgtgtgcgtggtgcccgagaagttcgagggcgacatcaagcaggagggcgtgggcgccttcagagagggccccccctaccagagaagaggcgccctgcagctgtggcagttcctggtggccctgctggacgaccccaccaacgcccacttcatcgcctggaccggcagaggcatggagttcaagctgatcgagcccgaggaggtggccagactgtggggcatccagaagaacagacccgccatgaactacgacaagctgagcagaagcctgagatactactacgagaagggcatcatgcagaaggtggccggcgagagatacgtgtacaagttcgtgtgcgagcccgaggccctgttcagcctggccttccccgacaaccagagacccgccctgaaggccgagttcgacagacccgtgagcgaggaggacaccgtgcccctgagccacctggacgagagccccgcctacctgcccgagctggccggccccgcccagcccttcggccccaagggcggctacagctactag

SEQ ID NO: 10569 - DNA, 1293 bp, Artificial Sequence
  Description of Artificial Sequence: Synthetic coding sequence
atggagagaagaatgaaggccggctacctggaccagcaggtgccctacaccttcagcagcaagagccccggcaacggcagcctgagagaggccctgatcggccccctgggcaagctgatggaccccggcagcctgccccccctggacagcgaggacctgttccaggacctgagccacttccaggagacctggctggccgaggcccaggtgcccgacagcgacgagcagttcgtgcccgacttccacagcgagaacctggccttccacagccccaccaccagaatcaagaaggagccccagagccccagaaccgaccccgccctgagctgcagcagaaagccccccctgccctaccaccacggcgagcagtgcctgtacagcagcagcgtgttccagcagcccctggacatctgccacagcttcaccagccagggcggcggcagagagcccctgcccgccccctaccagcaccagctgagcgagccctgccccccctacccccagcagagcttcaagcaggagtaccacgaccccctgtacgagcaggccggccagcccgccgtggaccagggcggcgtgaacggccacagataccccggcgccggcgtggtgatcaagcaggagcagaccgacttcgcctacgacagcgacgtgaccggctgcgccagcatgtacctgcacaccgagggcttcagcggccccagccccggcgacggcgccatgggctacggctacgagaagcccctgagacccttccccgacgacgtgtgcgtggtgcccgagaagttcgagggcgacatcaagcaggagggcgtgggcgccttcagagagggccccccctaccagagaagaggcgccctgcagctgtggcagttcctggtggccctgctggacgaccccaccaacgcccacttcatcgcctggaccggcagaggcatggagttcaagctgatcgagcccgaggaggtggccagactgtggggcatccagaagaacagacccgccatgaactacgacaagctgagcagaagcctgagatactactacgagaagggcatcatgcagaaggtggccggcgagagatacgtgtacaagttcgtgtgcgagcccgaggccctgttcagcctggccttccccgacaaccagagacccgccctgaaggccgagttcgacagacccgtgagcgaggaggacaccgtgcccctgagccacctggacgagagccccgcctacctgcccgagctggccggccccgcccagcccttcggccccaagggcggctacagctactag

SEQ ID NO: 10570 - DNA, 1338 bp, Artificial Sequence; identical to SEQ ID NO: 10568
  Description of Artificial Sequence: Synthetic coding sequence

SEQ ID NO: 10571 - DNA, 1791 bp, Artificial Sequence
  Description of Artificial Sequence: Synthetic coding sequence
atggccggcagaagagtgaacgtgaacgtgggcgtgctgggccacatcgacagcggcaagaccgccctggccagagccctgagcaccaccgccagcaccgccgccttcgacaagcagccccagagcagagagagaggcatcaccctggacctgggcttcagctgcttcagcgtgcccctgcccgccagactgagaagcagcctgcccgagttccaggccgcccccgaggccgagcccgagcccggcgagcccctgctgcaggtgaccctggtggactgccccggccacgccagcctgatcagaaccatcatcggcggcgcccagatcatcgacctgatgatgctggtgatcgacgtgaccaagggcatgcagacccagagcgccgagtgcctggtgatcggccagatcgcctgccagaagctggtggtggtgctgaacaagatcgacctgctgcccgagggcaagagacaggccgccatcgacaagatgaccaagaagatgcagaagaccctggagaacaccaagttcagaggcgcccccatcatccccgtggccgccaagcccggcggccccgaggcccccgagaccgaggccccccagggcatccccgagctgatcgagctgctgaccagccagatcagcatccccaccagagaccccagcggccccttcctgatgagcgtggaccactgcttcagcatcaagggccagggcaccgtgatgaccggcaccatcctgagcggcagcatcagcctgggcgacagcgtggagatccccgccctgaaggtggtgaagaaggtgaagagcatgcagatgttccacatgcccatcaccagcgccatgcagggcgacagactgggcatctgcgtgacccagttcgaccccaagctgctggagagaggcctggtgtgcgcccccgagagcctgcacaccgtgcacgccgccctgatcagcgtggagaagatcccctacttcagaggccccctgcagaccaaggccaagttccacatcaccgtgggccacgagaccgtgatgggcagactgatgttcttcagccccgcccccgacaacttcgaccaggagcccatcctggacagcttcaacttcagccaggagtacctgttccaggagcagtacctgagcaaggacctgacccccgccgtgaccgacaacgacgaggccgacaagaaggccggccaggccaccgagggccactgccccagacagcagtgggccctggtggagttcgagaagcccgtgacctgccccagactgtgcctggtgatcggcagcagactggacgccgacatccacaccaacacctgcagactggccttccacggcatcctgctgcacggcctggaggacagaaactacgccgacagcttcctgcccagactgaaggtgtacaagctgaagcacaagcacggcctggtggagagagccatggacgactacagcgtgatcggcagaagcctgttcaagaaggagaccaacatccagctgttcgtgggcctgaaggtgcacctgagcaccggcgagctgggcatcatcgacagcgccttcggccagagcggcaagttcaagatccacatccccggcggcctgagccccgagagcaagaagatcctgacccccgccctgaagaagagagccagagccggcagaggcgaggccaccagacaggaggagagcgccgagagaagcgagcccagccagcacgtggtgctgagcctgaccttcaagagatacgtgttcgacacccacaagagaatggtgcagagcccctag

SEQ ID NO: 10572 - DNA, 1233 bp, Artificial Sequence
  Description of Artificial Sequence: Synthetic coding sequence
atggccgccgagatccacagcagaccccagagcagcagacccgtgctgctgagcaagatcgagggccaccaggacgccgtgaccgccgccctgctgatccccaaggaggacggcgtgatcaccgccagcgaggacagaaccatcagagtgtggctgaagagagacagcggccagtactggcccagcatctaccacaccatggccagcccctgcagcgccatggcctaccaccacgacagcagaagaatcttcgtgggccaggacaacggcgccgtgatggagttccacgtgagcgaggacttcaacaagatgaacttcatcaagacctaccccgcccaccagaacagagtgagcgccatcatcttcagcctggccaccgagtgggtgatcagcaccggccacgacaagtgcgtgagctggatgtgcaccagaagcggcaacatgctgggcagacacttcttcaccagctgggccagctgcctgcagtacgacttcgacacccagtacgccttcgtgggcgactacagcggccagatcaccctgctgaagctggagcagaacacctgcagcgtgatcaccaccctgaagggccacgagggcagcgtggcctgcctgtggtgggaccccatccagagactgctgttcagcggcgccagcgacaacagcatcatcatgtgggacatcggcggcagaaagggcagaaccctgctgctgcagggccaccacgacaaggtgcagagcctgtgctacctgcagctgaccagacagctggtgagctgcagcagcgacggcggcatcgccgtgtggaacatggacgtgagcagagaggaggccccccagtggctggagagcgacagctgccagaagtgcgagcagcccttcttctggaacatcaagcagatgtgggacaccaagaccctgggcctgagacagcaccactgcagaaagtgcggccaggccgtgtgcggcaagtgcagcagcaagagaagcagctaccccgtgatgggcttcgagttccaggtgagagtgtgcgacagctgctacgacagcatcaaggacgaggacagaaccagcctggccaccttccacgagggcaagcacaacatcagccacatgagcatggacatcgccagaggcctgatggtgacctgcggcaccgacagaatcgtgaagatctgggacatgacccccgtggtgggctgcagcctggccaccggcttcagcccccactag

SEQ ID NO: 10573 - DNA, 1092 bp, Artificial Sequence
  Description of Artificial Sequence: Synthetic coding sequence
atggccggcgacctgagcgccggcttcttcatggaggagctgaacacctacagacagaagcagggcgtggtgctgaagtaccaggagctgcccaacagcggccccccccacgacagaagattcaccttccaggtgatcatcgacggcagagagttccccgagggcgagggcagaagcaagaaggaggccaagaacgccgccgccaagctggccgtggagatcctgaacaaggagaagaaggccgtgagccccctgctgctgaccaccaccaacagcagcgagggcctgagcatgggcaactacatcggcctgatcaacagaatcgcccagaagaagagactgaccgtgaactacgagcagtgcgccagcggcgtgcacggccccgagggcttccactacaagtgcaagatgggccagaaggagtacagcatcggcaccggcagcaccaagcaggaggccaagcagctggccgccaagctggcctacctgcagatcctgagcgaggagaccagcgtgaagagcgactacctgagcagcggcagcttcgccaccacctgcgagagccagagcaacagcctggtgaccagcaccctggccagcgagagcagcagcgagggcgacttcagcgccgacaccagcgagatcaacagcaacagcgacagcctgaacagcagcagcctgctgatgaacggcctgagaaacaaccagagaaaggccaagagaagcctggcccccagattcgacctgcccgacatgaaggagaccaagtacaccgtggacaagagattcggcatggacttcaaggagatcgagctgatcggcagcggcggcttcggccaggtgttcaaggccaagcacagaatcgacggcaagacctacgtgatcaagagagtgaagtacaacaacgagagcaagaccaagtgcctgttcatccagatggagttctgcgacaagggcaccctggagcagtggatcgagaagagaagaggcgagaagctggacaaggtgctggccctggagctgttcgagcagatcaccaagggcgtggactacatccacagcaagaagaagaagaagaagaagaagaagtag

SEQ ID NO: 10574 - DNA, 309 bp, Artificial Sequence
  Description of Artificial Sequence: Synthetic coding sequence
atggccggcgacctgagcgccggcttcttcatggaggagctgaacacctacagacagaagcagggcgtggtgctgaagtaccaggagctgcccaacagcggccccccccacgacagaagattcaccttccaggtgatcatcgacggcagagagttccccgagggcgagggcagaagcaagaaggaggccaagaacgccgccgccaagctggccgtggagatcctgaacaaggagaagaaggccgtgagccccctgctgctgaccaccaccaacagcagcgagggcctgagcatgggcaactacatctag

SEQ ID NO: 10575 - DNA, 1656 bp, Artificial Sequence
  Description of Artificial Sequence: Synthetic coding sequence
atggccggcgacctgagcgccggcttcttcatggaggagctgaacacctacagacagaagcagggcgtggtgctgaagtaccaggagctgcccaacagcggccccccccacgacagaagattcaccttccaggtgatcatcgacggcagagagttccccgagggcgagggcagaagcaagaaggaggccaagaacgccgccgccaagctggccgtggagatcctgaacaaggagaagaaggccgtgagccccctgctgctgaccaccaccaacagcagcgagggcctgagcatgggcaactacatcggcctgatcaacagaatcgcccagaagaagagactgaccgtgaactacgagcagtgcgccagcggcgtgcacggccccgagggcttccactacaagtgcaagatgggccagaaggagtacagcatcggcaccggcagcaccaagcaggaggccaagcagctggccgccaagctggcctacctgcagatcctgagcgaggagaccagcgtgaagagcgactacctgagcagcggcagcttcgccaccacctgcgagagccagagcaacagcctggtgaccagcaccctggccagcgagagcagcagcgagggcgacttcagcgccgacaccagcgagatcaacagcaacagcgacagcctgaacagcagcagcctgctgatgaacggcctgagaaacaaccagagaaaggccaagagaagcctggcccccagattcgacctgcccgacatgaaggagaccaagtacaccgtggacaagagattcggcatggacttcaaggagatcgagctgatcggcagcggcggcttcggccaggtgttcaaggccaagcacagaatcgacggcaagacctacgtgatcaagagagtgaagtacaacaacgagaaggccgagagagaggtgaaggccctggccaagctggaccacgtgaacatcgtgcactacaacggctgctgggacggcttcgactacgaccccgagaccagcgacgacagcctggagagcagcgactacgaccccgagaacagcaagaacagcagcagaagcaagaccaagtgcctgttcatccagatggagttctgcgacaagggcaccctggagcagtggatcgagaagagaagaggcgagaagctggacaaggtgctggccctggagctgttcgagcagatcaccaagggcgtggactacatccacagcaagaagctgatccacagagacctgaagcccagcaacatcttcctggtggacaccaagcaggtgaagatcggcgacttcggcctggtgaccagcctgaagaacgacggcaagagaaccagaagcaagggcaccctgagatacatgagccccgagcagatcagcagccaggactacggcaaggaggtggacctgtacgccctgggcctgatcctggccgagctgctgcacgtgtgcgacaccgccttcgagaccagcaagttcttcaccgacctgagagacggcatcatcagcgacatcttcgacaagaaggagaagaccctgctgcagaagctgctgagcaagaagcccgaggacagacccaacaccagcgagatcctgagaaccctgaccgtgtggaagaagagccccgagaagaacgagagacacacctgctag

SEQ ID NO: 10576 - DNA, 351 bp, Artificial Sequence
  Description of Artificial Sequence: Synthetic coding sequence
atggccggcgacctgagcgccggcttcttcatggaggagctgaacacctacagacagaagcagggcgtggtgctgaagtaccaggagctgcccaacagcggccccccccacgacagaagattcaccttccaggtgatcatcgacggcagagagttccccgagggcgagggcagaagcaagaaggaggccaagaacgccgccgccaagctggccgtggagatcctgaacaaggagaagaaggccgtgagccccctgctgctgaccaccaccaacagcagcgagggcctgagcatgggcaactacatcggcctgatcaacagaatcgcccagaagaagagactgaccgtgtag

SEQ ID NO: 10577 - DNA, 1533 bp, Artificial Sequence
  Description of Artificial Sequence: Synthetic coding sequence
atggccggcgacctgagcgccggcttcttcatggaggagctgaacacctacagacagaagcagggcgtggtgctgaagtaccaggagctgcccaacagcggccccccccacgacagaagattcaccttccaggtgatcatcgacggcagagagttccccgagggcgagggcagaagcaagaaggaggccaagaacgccgccgccaagctggccgtggagatcctgaacaaggagaagaaggccgtgagccccctgctgctgaccaccaccaacagcagcgagggcctgagcatgggcaactacatcggcctgatcaacagaatcgcccagaagaagagactgaccgtgaactacgagcagtgcgccagcggcgtgcacggccccgagggcttccactacaagtgcaagatgggccagaaggagtacagcatcggcaccggcagcaccaagcaggaggccaagcagctggccgccaagctggcctacctgcagatcctgagcgaggagaccagcgtgaagagcgactacctgagcagcggcagcttcgccaccacctgcgagagccagagcaacagcctggtgaccagcaccctggccagcgagagcagcagcgagggcgacttcagcgccgacaccagcgagatcaacagcaacagcgacagcctgaacagcagcagcctgctgatgaacggcctgagaaacaaccagagaaaggccaagagaagcctggcccccagattcgacctgcccgacatgaaggagaccaagtacaccgtggacaagagaaaggccgagagagaggtgaaggccctggccaagctggaccacgtgaacatcgtgcactacaacggctgctgggacggcttcgactacgaccccgagaccagcgacgacagcctggagagcagcgactacgaccccgagaacagcaagaacagcagcagaagcaagaccaagtgcctgttcatccagatggagttctgcgacaagggcaccctggagcagtggatcgagaagagaagaggcgagaagctggacaaggtgctggccctggagctgttcgagcagatcaccaagggcgtggactacatccacagcaagaagctgatccacagagacctgaagcccagcaacatcttcctggtggacaccaagcaggtgaagatcggcgacttcggcctggtgaccagcctgaagaacgacggcaagagaaccagaagcaagggcaccctgagatacatgagccccgagcagatcagcagccaggactacggcaaggaggtggacctgtacgccctgggcctgatcctggccgagctgctgcacgtgtgcgacaccgccttcgagaccagcaagttcttcaccgacctgagagacggcatcatcagcgacatcttcgacaagaaggagaagaccctgctgcagaagctgctgagcaagaagcccgaggacagacccaacaccagcgagatcctgagaaccctgaccgtgtggaagaagagccccgagaagaacgagagacacacctgctag

SEQ ID NO: 10578 - DNA, 4800 bp, Artificial Sequence
  Description of Artificial Sequence: Synthetic coding sequence
atgaacaaggccccccagagcaccggccccccccccgcccccagccccggcctgccccagcccgccttcccccccggccagaccgcccccgtggtgttcagcaccccccaggccacccagatgaacacccccagccagcccagacagcacttctaccccagcagagcccagccccccagcagcgccgccagcagagtgcagagcgccgcccccgccagacccggccccgccgcccacgtgtaccccgccggcagccaggtgatgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggccccgccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10579 - DNA, 4803 bp, Artificial Sequence
  Description of Artificial Sequence: Synthetic coding sequence
atgaacaaggccccccagagcaccggccccccccccgcccccagccccggcctgccccagcccgccttcccccccggccagaccgcccccgtggtgttcagcaccccccaggccacccagatgaacacccccagccagcccagacagcacttctaccccagcagagcccagccccccagcagcgccgccagcagagtgcagagcgccgcccccgccagacccggccccgccgcccacgtgtaccccgccggcagccaggtgatgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggcccccaggccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10580 - DNA, 4800 bp, Artificial Sequence; identical to SEQ ID NO: 10578
  Description of Artificial Sequence: Synthetic coding sequence

SEQ ID NO: 10581 - DNA, 4308 bp, Artificial Sequence
  Description of Artificial Sequence: Synthetic coding sequence
atgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggccccgccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10582 - DNA, 4821 bp, Artificial Sequence
  Description of Artificial Sequence: Synthetic coding sequence
atgaacaaggccccccagagcaccggccccccccccgcccccagccccggcctgccccagcccgccttcccccccggccagaccgcccccgtggtgttcagcaccccccaggccacccagatgaacacccccagccagcccagacagggcggcttcagaagcctgcagcacttctaccccagcagagcccagccccccagcagcgccgccagcagagtgcagagcgccgcccccgccagacccggccccgccgcccacgtgtaccccgccggcagccaggtgatgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggccccgccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10583 - DNA, 4821 bp, Artificial Sequence; identical to SEQ ID NO: 10582
  Description of Artificial Sequence: Synthetic coding sequence

SEQ ID NO: 10584 - DNA, 4539 bp, Artificial Sequence
  Description of Artificial Sequence: Synthetic coding sequence
atgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggccccgccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10585 - DNA, 4539 bp, Artificial Sequence; identical to SEQ ID NO: 10584
  Description of Artificial Sequence: Synthetic coding sequence

SEQ ID NO: 10586 - DNA, 4683 bp, Artificial Sequence
  Description of Artificial Sequence: Synthetic coding sequence
atgaacacccccagccagcccagacagcacttctaccccagcagagcccagccccccagcagcgccgccagcagagtgcagagcgccgcccccgccagacccggccccgccgcccacgtgtaccccgccggcagccaggtgatgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggcccccaggccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10587 - DNA, 4680 bp, Artificial Sequence
  Description of Artificial Sequence: Synthetic coding sequence
atgaacacccccagccagcccagacagcacttctaccccagcagagcccagccccccagcagcgccgccagcagagtgcagagcgccgcccccgccagacccggccccgccgcccacgtgtaccccgccggcagccaggtgatgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggccccgccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10588 - DNA, 4821 bp, Artificial Sequence; identical to SEQ ID NO: 10582
  Description of Artificial Sequence: Synthetic coding sequence

SEQ ID NO: 10589 - DNA, 492 bp, Artificial Sequence
  Description of Artificial Sequence: Synthetic coding sequence
atgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccactag

SEQ ID NO: 10590 - DNA, 4542 bp, Artificial Sequence
  Description of Artificial Sequence: Synthetic coding sequence
atgatgatccccagccagatcagctaccccgccagccagggcgcctactacatccccggccagggcagaagcacctacgtggtgcccacccagcagtaccccgtgcagcccggcgcccccggcttctaccccggcgccagccccaccgagttcggcacctacgccggcgcctactaccccgcccagggcgtgcagcagttccccaccggcgtggcccccacccccgtgctgatgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggcccccaggccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10591 - DNA, 432 bp, Artificial Sequence
  Description of Artificial Sequence: Synthetic coding sequence
atgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagtag

SEQ ID NO: 10592 - DNA, 4215 bp, Artificial Sequence
  Description of Artificial Sequence: Synthetic coding sequence
atgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggcccccaggccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10593 - DNA, 4212 bp, Artificial Sequence
  Description of Artificial Sequence: Synthetic coding sequence
atgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggccccgccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10594 - DNA, 4311 bp, Artificial Sequence
  Description of Artificial Sequence: Synthetic coding sequence
atgaaccagcccccccagatcgcccccaagagagagagaaagaccatcagaatcagagaccccaaccagggcggcaaggacatcaccgaggagatcatgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgaggagctgctgccccccgagagcacccccatccccgccaacctgagccagaacctggaggccgccgccgccacccaggtggccgtgagcgtgcccaagagaagaagaaagatcaaggagctgaacaagaaggaggccgtgggcgacctgctggacgccttcaaggaggccaaccccgccgtgcccgaggtggagaaccagccccccgccggcagcaaccccggccccgagagcgagggcagcggcgtgccccccagacccgaggaggccgacgagacctgggacagcaaggaggacaagatccacaacgccgagaacatccagcccggcgagcagaagtacgagtacaagagcgaccagtggaagcccctgaacctggaggagaagaagagatacgacagagagttcctgctgggcttccagttcatcttcgccagcatgcagaagcccgagggcctgccccacatcagcgacgtggtgctggacaaggccaacaagacccccctgagacccctggaccccaccagactgcagggcatcaactgcggccccgacttcacccccagcttcgccaacctgggcagaaccaccctgagcaccagaggcccccccagaggcggccccggcggcgagctgcccagaggcccccaggccggcctgggccccagaagaagccagcagggccccagaaaggagcccagaaagatcatcgccaccgtgctgatgaccgaggacatcaagctgaacaaggccgagaaggcctggaagcccagcagcaagagaaccgccgccgacaaggacagaggcgaggaggacgccgacggcagcaagacccaggacctgttcagaagagtgagaagcatcctgaacaagctgaccccccagatgttccagcagctgatgaagcaggtgacccagctggccatcgacaccgaggagagactgaagggcgtgatcgacctgatcttcgagaaggccatcagcgagcccaacttcagcgtggcctacgccaacatgtgcagatgcctgatggccctgaaggtgcccaccaccgagaagcccaccgtgaccgtgaacttcagaaagctgctgctgaacagatgccagaaggagttcgagaaggacaaggacgacgacgaggtgttcgagaagaagcagaaggagatggacgaggccgccaccgccgaggagagaggcagactgaaggaggagctggaggaggccagagacatcgccagaagaagaagcctgggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcatcaaggagaagaagaccagcagcagaatcagattcatgctgcaggacgtgctggacctgagaggcagcaactgggtgcccagaagaggcgaccagggccccaagaccatcgaccagatccacaaggaggccgagatggaggagcacagagagcacatcaaggtgcagcagctgatggccaagggcagcgacaagagaagaggcggcccccccggcccccccatcagcagaggcctgcccctggtggacgacggcggctggaacaccgtgcccatcagcaagggcagcagacccatcgacaccagcagactgaccaagatcaccaagcccggcagcatcgacagcaacaaccagctgttcgcccccggcggcagactgagctggggcaagggcagcagcggcggcagcggcgccaagcccagcgacgccgccagcgaggccgccagacccgccaccagcaccctgaacagattcagcgccctgcagcaggccgtgcccaccgagagcaccgacaacagaagagtggtgcagagaagcagcctgagcagagagagaggcgagaaggccggcgacagaggcgacagactggagagaagcgagagaggcggcgacagaggcgacagactggacagagccagaacccccgccaccaagagaagcttcagcaaggaggtggaggagagaagcagagagagacccagccagcccgagggcctgagaaaggccgccagcctgaccgaggacagagacagaggcagagacgccgtgaagagagaggccgccctgccccccgtgagccccctgaaggccgccctgagcgaggaggagctggagaagaagagcaaggccatcatcgaggagtacctgcacctgaacgacatgaaggaggccgtgcagtgcgtgcaggagctggccagccccagcctgctgttcatcttcgtgagacacggcgtggagagcaccctggagagaagcgccatcgccagagagcacatgggccagctgctgcaccagctgctgtgcgccggccacctgagcaccgcccagtactaccagggcctgtacgagatcctggagctggccgaggacatggagatcgacatcccccacgtgtggctgtacctggccgagctggtgacccccatcctgcaggagggcggcgtgcccatgggcgagctgttcagagagatcaccaagcccctgagacccctgggcaaggccgccagcctgctgctggagatcctgggcctgctgtgcaagagcatgggccccaagaaggtgggcaccctgtggagagaggccggcctgagctggaaggagttcctgcccgagggccaggacatcggcgccttcgtggccgagcagaaggtggagtacaccctgggcgaggagagcgaggcccccggccagagagccctgcccagcgaggagctgaacagacagctggagaagctgctgaaggagggcagcagcaaccagagagtgttcgactggatcgaggccaacctgagcgagcagcagatcgtgagcaacaccctggtgagagccctgatgaccgccgtgtgctacagcgccatcatcttcgagacccccctgagagtggacgtggccgtgctgaaggccagagccaagctgctgcagaagtacctgtgcgacgagcagaaggagctgcaggccctgtacgccctgcaggccctggtggtgaccctggagcagccccccaacctgctgagaatgttcttcgacgccctgtacgacgaggacgtggtgaaggaggacgccttctacagctgggagagcagcaaggaccccgccgagcagcagggcaagggcgtggccctgaagagcgtgaccgccttcttcaagtggctgagagaggccgaggaggagagcgaccacaactag

SEQ ID NO: 10595 - DNA, 384 bp, Artificial Sequence
  Description of Artificial Sequence: Synthetic coding sequence
atgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagccctag

SEQ ID NO: 10596 - DNA, 264 bp, Artificial Sequence
  Description of Artificial Sequence: Synthetic coding sequence
atgaacacccccagccagcccagacagcacttctaccccagcagagcccagccccccagcagcgccgccagcagagtgcagagcgccgcccccgccagacccggccccgccgcccacgtgtaccccgccggcagccaggtgatgatgatccccagccagatcagctaccccgccagccagggcgcctactacatccccggccagggcagaagcacctacgtggtgcccacccagcagtaccccgtgcagcccggcgccccctag

SEQ ID NO: 10597 - DNA, 858 bp, Artificial Sequence
  Description of Artificial Sequence: Synthetic coding sequence
atgagcggcgccagaaccgccagcacccccacccccccccagaccggcggcggcctggagccccaggccaacggcgagaccccccaggtggccgtgatcgtgagacccgacgacagaagccagggcgccatcatcgccgacagacccggcctgcccggccccgagcacagccccagcgagagccagcccagcagccccagccccacccccagccccagccccgtgctggagcccggcagcgagcccaacctggccgtgctgagcatccccggcgacaccatgaccaccatccagatgagcgtggaggagagcacccccatcagcagagagaccggcgagccctacagactgagccccgagcccacccccctggccgagcccatcctggaggtggaggtgaccctgagcaagcccgtgcccgagagcgagttcagcagcagccccctgcaggcccccacccccctggccagccacaccgtggagatccacgagcccaacggcatggtgcccagcgaggacctggagcccgaggtggagagcagccccgagctggcccccccccccgcctgccccagcgagagccccgtgcccatcgcccccaccgcccagcccgaggagctgctgaacggcgcccccagcccccccgccgtggacctgagccccgtgagcgagcccgaggagcaggccaaggaggtgaccgccagcatggccccccccaccatccccagcgccacccccgccaccgcccccagcgccaccagccccgcccaggaggaggagatggaggaggaggaggaggaggaggagggcgaggccggcgaggccggcgaggccgagagcgagaagggcggcgagtag

SEQ ID NO: 10598 - DNA, 1836 bp, Artificial Sequence
  Description of Artificial Sequence: Synthetic coding sequence
atggccgccagcgccaagaagaagaacaagaagggcaagaccatcagcctgaccgacttcctggccgaggacggcggcaccggcggcggcagcacctacgtgagcaagcccgtgagctgggccgacgagaccgacgacctggagggcgacgtgagcaccacctggcacagcaacgacgacgacgtgtacagagccccccccatcgacagaagcatcctgcccaccgcccccagagccgccagagagcccaacatcgacagaagcagactgcccaagagccccccctacaccgccttcctgggcaacctgccctacgacgtgaccgaggagagcatcaaggagttcttcagaggcctgaacatcagcgccgtgagactgcccagagagcccagcaaccccgagagactgaagggcttcggctacgccgagttcgaggacctggacagcctgctgagcgccctgagcctgaacgaggagagcctgggcaacagaagaatcagagtggacgtggccgaccaggcccaggacaaggacagagacgacagaagcttcggcagagacagaaacagagacagcgacaagaccgacaccgactggagagccagacccgccaccgacagcttcgacgactacccccccagaagaggcgacgacagcttcggcgacaagtacagagacagatacgacagcgacagatacagagacggctacagagacggctacagagacggccccagaagagacatggacagatacggcggcagagacagatacgacgacagaggcagcagagactacgacagaggctacgacagcagaatcggcagcggcagaagagccttcggcagcggctacagaagagacgacgactacagaggcggcggcgacagatacgaggacagatacgacagaagagacgacagaagctggagcagcagagacgactacagcagagacgactacagaagagacgacagaggccccccccagagacccaagctgaacctgaagcccagaagcacccccaaggaggacgacagcagcgccagcaccagccagagcaccagagccgccagcatcttcggcggcgccaagcccgtggacaccgccgccagagagagagaggtggaggagagactgcagaaggagcaggagaagctgcagagacagctggacgagcccaagctggagagaagacccagagagagacaccccagctggagaagcgaggagacccaggagagagagagaagcagaaccggcagcgagagcagccagaccggcaccagcaccaccagcagcagaaacgccagaagaagagagagcgagaagagcctggagaacgagaccctgaacaaggaggaggactgccacagccccaccagcaagccccccaagcccgaccagcccctgaaggtgatgcccgcccccccccccaaggagaacgcctgggtgaagagaagcagcaacccccccgccagaagccagagcagcgacaccgagcagcagagccccaccagcggcggcggcaaggtggcccccgcccagcccagcgaggagggccccggcagaaaggacgagaacaaggtggacggcatgaacgcccccaagggccagaccggcaacagcagcagaggccccggcgacggcggcaacagagaccactggaaggagagcgacagaaaggacggcaagaaggaccaggacagcagaagcgcccccgagcccaagaagcccgaggagaaccccgccagcaagttcagcagcgccagcaagtacgccgccctgagcgtggacggcgaggacgagaacgagggcgaggactacgccgagtag

SEQ ID NO: 10599 - DNA, 1764 bp, Artificial Sequence
  Description of Artificial Sequence: Synthetic coding sequence
atggccgccagcgccaagaagaagaacaagaagggcaagaccatcagcctgaccgacttcctggccgaggacggcggcaccggcggcggcagcacctacgtgagcaagcccgtgagctgggccgacgagaccgacgacctggagggcgacgtgagcaccacctggcacagcaacgacgacgacgtgtacagagccccccccatcgacagaagcatcctgcccaccgcccccagagccgccagagagcccaacatcgacagaagcagactgcccaagagccccccctacaccgccttcctgggcaacctgccctacgacgtgaccgaggagagcatcaaggagttcttcagaggcctgaacatcagcgccgtgagactgcccagagagcccagcaaccccgagagactgaagggcttcggctacgccgagttcgaggacctggacagcctgctgagcgccctgagcctgaacgaggagagcctgggcaacagaagaatcagagtggacgtggccgaccaggcccaggacaaggacagagacgacagaagcttcggcagagacagaaacagagacagcgacaagaccgacaccgactggagagccagacccgccaccgacagcttcgacgactacccccccagaagaggcgacgacagcttcggcgacaagtacagagacagatacggcggcagagacagatacgacgacagaggcagcagagactacgacagaggctacgacagcagaatcggcagcggcagaagagccttcggcagcggctacagaagagacgacgactacagaggcggcggcgacagatacgaggacagatacgacagaagagacgacagaagctggagcagcagagacgactacagcagagacgactacagaagagacgacagaggccccccccagagacccaagctgaacctgaagcccagaagcacccccaaggaggacgacagcagcgccagcaccagccagagcaccagagccgccagcatcttcggcggcgccaagcccgtggacaccgccgccagagagagagaggtggaggagagactgcagaaggagcaggagaagctgcagagacagctggacgagcccaagctggagagaagacccagagagagacaccccagctggagaagcgaggagacccaggagagagagagaagcagaaccggcagcgagagcagccagaccggcaccagcaccaccagcagcagaaacgccagaagaagagagagcgagaagagcctggagaacgagaccctgaacaaggaggaggactgccacagccccaccagcaagccccccaagcccgaccagcccctgaaggtgatgcccgcccccccccccaaggagaacgcctgggtgaagagaagcagcaacccccccgccagaagccagagcagcgacaccgagcagcagagccccaccagcggcggcggcaaggtggcccccgcccagcccagcgaggagggccccggcagaaaggacgagaacaaggtggacggcatgaacgcccccaagggccagaccggcaacagcagcagaggccccggcgacggcggcaacagagaccactggaaggagagcgacagaaaggacggcaagaaggaccaggacagcagaagcgcccccgagcccaagaagcccgaggagaaccccgccagcaagttcagcagcgccagcaagtacgccgccctgagcgtggacggcgaggacgagaacgagggcgaggactacgccgagtag

SEQ ID NO: 10600 - DNA, 714 bp, Artificial Sequence
  Description of Artificial Sequence: Synthetic coding sequence
atgctggacctgaccagcagaggccaggtgggcaccagcagaagaatggccgaggccgcctgcagcgcccacttcctggagaccacccccacccccaacccccccaccaccgaggaggagaagaccgagagcaaccaggaggtggccaaccccgagcactacatcaagcaccccctgcagaacagatgggccctgtggttcttcaagaacgacaagagcaagacctggcaggccaacctgagactgatcagcaagttcgacaccgtggaggacttctgggccctgtacaaccacatccagctgagcagcaacctgatgcccggctgcgactacagcctgttcaaggacggcatcgagcccatgtgggaggacgagaagaacaagagaggcggcagatggctgatcaccctgaacaagcagcagagaagaagcgacctggacagattctggctggagaccctgctgtgcctgatcggcgagagcttcgacgactacagcgacgacgtgtgcggcgccgtggtgaacgtgagagccaagggcgacaagatcgccatctggaccaccgagtgcgagaacagagaggccgtgacccacatcggcagagtgtacaaggagagactgggcctgccccccaagatcgtgatcggctaccagagccacgccgacaccgccaccaagagcggcagcaccaccaagaacagattcgtggtgtag

SEQ ID NO: 10601 - DNA, 654 bp, Artificial Sequence
  Description of Artificial Sequence: Synthetic coding sequence
atggccaccgtggagcccgagaccacccccacccccaacccccccaccaccgaggaggagaagaccgagagcaaccaggaggtggccaaccccgagcactacatcaagcaccccctgcagaacagatgggccctgtggttcttcaagaacgacaagagcaagacctggcaggccaacctgagactgatcagcaagttcgacaccgtggaggacttctgggccctgtacaaccacatccagctgagcagcaacctgatgcccggctgcgactacagcctgttcaaggacggcatcgagcccatgtgggaggacgagaagaacaagagaggcggcagatggctgatcaccctgaacaagcagcagagaagaagcgacctggacagattctggctggagaccctgctgtgcctgatcggcgagagcttcgacgactacagcgacgacgtgtgcggcgccgtggtgaacgtgagagccaagggcgacaagatcgccatctggaccaccgagtgcgagaacagagaggccgtgacccacatcggcagagtgtacaaggagagactgggcctgccccccaagatcgtgatcggctaccagagccacgccgacaccgccaccaagagcggcagcaccaccaagaacagattcgtggtgtag

SEQ ID NO: 10602 - DNA, 747 bp, Artificial Sequence
  Description of Artificial Sequence: Synthetic coding sequence
atggccaccgtggagcccgagaccacccccacccccaacccccccaccaccgaggaggagaagaccgagagcaaccaggaggtggccaaccccgagcactacatcaagcaccccctgcagaacagatgggccctgtggttcttcaagaacgacaagagcaagacctggcaggccaacctgagactgatcagcaagttcgacaccgtggaggacttctgggccctgtacaaccacatccagctgagcagcaacctgatgcccggctgcgactacagcctgttcaaggacggcatcgagcccatgtgggaggacgagaagaacaagagaggcggcagatggctgatcaccctgaacaagcagcagagaagaagcgacctggacagattctggctggagaccagatgggacctggccatgctgcccagactggtgagcaacttctggccccaggtgatcctgcccctgcagccccccaaggtgctggagctgcagctgctgtgcctgatcggcgagagcttcgacgactacagcgacgacgtgtgcggcgccgtggtgaacgtgagagccaagggcgacaagatcgccatctggaccaccgagtgcgagaacagagaggccgtgacccacatcggcagagtgtacaaggagagactgggcctgccccccaagatcgtgatcggctaccagagccacgccgacaccgccaccaagagcggcagcaccaccaagaacagattcgtggtgtag

SEQ ID NO: 10603 - DNA, 357 bp, Artificial Sequence
  Description of Artificial Sequence: Synthetic coding sequence
atgagcggcggcagcagctgcagccagacccccagcagagccatccccgccaccagaagagtggtgctgggcgacggcgtgcagctgccccccggcgactacagcaccacccccggcggcaccctgttcagcaccacccccggcggcaccagaatcatctacgacagaaagttcctgatggagtgcagaaacagccccgtgaccaagaccccccccagagacctgcccaccatccccggcgtgaccagccccagcagcgacgagccccccatggaggccagccagagccacctgagaaacagccccgaggacaagagagccggcggcgaggagagccagttcgagatggacatctag

SEQ ID NO: 10604 - DNA, 1857 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagcagcttcagacaggaccaccccagcagcatgggcgtgtacggccaggagagcggcggcttcagcggccccggcgagaacagaagcatgagcggccccgacaacagaggcagaggcagaggcggcttcgacagaggcggcatgagcagagaccccgacgaggacagcgacaacagcgccatctacgtgcagggcctgaacgacagcgtgaccctggacgacctggccgacttcttcaagcagtgcggcgtggtgaagatgaacaagagaaccggccagcccatgatccacatctacctggacaaggagaccggcaagcccaagggcgacgccaccgtgagctacgaggacccccccaccgccaaggccgccgtggagtggttcgacggcaaggacttccagggcagcaagctgaaggtgagcctggccagaaagaagccccccatgaacagcatgagaggcggcctgccccccagagagggcagaggcatgcccccccccctgagaggcggccccggcggccccggcggccccggcggccccatgggcagaatgggcggcagaggcggcgacagaggcggcttcccccccagaggccccagaggcagcagaggcaaccccagcggcggcggcaacgtgcagcacagagccggcgactggcagtgccccaaccccggctgcggcaaccagaacttcgcctggagaaccgagtgcaaccagtgcaaggcccccaagcccgagggcttcctgcccccccccttccccccccccggcggcgacagaggcagaggcggccccggcggcatgagaggcggcagaggcggcctgatggacagaggcggccccggcggcatgttcagaggcggcagaggcggcgacagaggcggcttcagaggcggcagaggcatggacagaggcggcttcggcggcggcagaagaggcggccccggcggcccccccggccccctgatggagcagatgggcggcagaagaggcggcagaggcggccccggcaagatggacaagggcgagcacagacaggagagaagagacagaccctactag

SEQ ID NO: 10605 - DNA, 1803 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagcagcttcagacaggaccaccccagcagcatgggcgtgtacggccaggagagcggcggcttcagcggccccggcgagaacagaagcatgagcggccccgacaacagaggcagaggcagaggcggcttcgacagaggcggcatgagcagaggcggcagaggcggcggcagaggcggcatgggcagcgccggcgagagaggcggcttcaacaagcccggcggccccatggacgagggccccgacctggacctgggcccccccgtggaccccgacgaggacagcgacaacagcgccatctacgtgcagggcctgaacgacagcgtgaccctggacgacctggccgacttcttcaagcagtgcggcgtggtgaagatgaacaagagaaccggccagcccatgatccacatctacctggacaaggagaccggcaagcccaagggcgacgccaccgtgagctacgaggacccccccaccgccaaggccgccgtggagtggttcgacggcaaggacttccagggcagcaagctgaaggtgagcctggccagaaagaagccccccatgaacagcatgagaggcggcctgccccccagagagggcagaggcatgcccccccccctgagaggcggccccggcggccccggcggccccggcggccccatgggcagaatgggcggcagaggcggcgacagaggcggcttcccccccagaggccccagaggcagcagaggcaaccccagcggcggcggcaacgtgcagcacagagccggcgactggcagtgccccaaccccggctgcggcaaccagaacttcgcctggagaaccgagtgcaaccagtgcaaggcccccaagcccgagggcttcctgcccccccccttccccccccccggcggcgacagaggcagaggcggccccggcggcatgagaggcggcagaggcggcctgatggacagaggcggccccggcggcatgttcagaggcggcagaggcggcgacagaggcggcttcagaggcggcagaggcatggacagaggcggcttcggcggcggcagaagaggcggccccggcggcccccccggccccctgatggagcagatgggcggcagaagaggcggcagaggcggccccggcaagatggacaagggcgagcacagacaggagagaagagacagaccctactag

SEQ ID NO: 10606 - DNA, 1752 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagacccatggacgagggccccgacctggacctgggcccccccgtggaccccgacgaggacagcgacaacagcgccatctacgtgcagggcctgaacgacagcgtgaccctggacgacctggccgacttcttcaagcagtgcggcgtggtgaagatgaacaagagaaccggccagcccatgatccacatctacctggacaaggagaccggcaagcccaagggcgacgccaccgtgagctacgaggacccccccaccgccaaggccgccgtggagtggttcgacggcaaggacttccagggcagcaagctgaaggtgagcctggccagaaagaagccccccatgaacagcatgagaggcggcctgccccccagagagggcagaggcatgcccccccccctgagaggcggccccggcggccccggcggccccggcggccccatgggcagaatgggcggcagaggcggcgacagaggcggcttcccccccagaggccccagaggcagcagaggcaaccccagcggcggcggcaacgtgcagcacagagccggcgactggcagtgccccaaccccggctgcggcaaccagaacttcgcctggagaaccgagtgcaaccagtgcaaggcccccaagcccgagggcttcctgcccccccccttccccccccccggcggcgacagaggcagaggcggccccggcggcatgagaggcggcagaggcggcctgatggacagaggcggccccggcggcatgttcagaggcggcagaggcggcgacagaggcggcttcagaggcggcagaggcatggacagaggcggcttcggcggcggcagaagaggcggccccggcggcccccccggccccctgatggagcagatgggcggcagaagaggcggcagaggcggccccggcaagatggacaagggcgagcacagacaggagagaagagacagaccctactag

SEQ ID NO: 10607 - DNA, 1971 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagcagcttcagacaggaccaccccagcagcatgggcgtgtacggccaggagagcggcggcttcagcggccccggcgagaacagaagcatgagcggccccgacaacagaggcagaggcagaggcggcttcgacagaggcggcatgagcagaggcggcagaggcggcggcagaggcggcatgggcagcgccggcgagagaggcggcttcaacaagcccggcggccccatggacgagggccccgacctggacctgggcccccccgtggaccccgacgaggacagcgacaacagcgccatctacgtgcagggcctgaacgacagcgtgaccctggacgacctggccgacttcttcaagcagtgcggcgtggtgaagatgaacaagagaaccggccagcccatgatccacatctacctggacaaggagaccggcaagcccaagggcgacgccaccgtgagctacgaggacccccccaccgccaaggccgccgtggagtggttcgacggcaaggacttccagggcagcaagctgaaggtgagcctggccagaaagaagccccccatgaacagcatgagaggcggcctgccccccagagagggcagaggcatgcccccccccctgagaggcggccccggcggccccggcggccccggcggccccatgggcagaatgggcggcagaggcggcgacagaggcggcttcccccccagaggccccagaggcagcagaggcaaccccagcggcggcggcaacgtgcagcacagagccggcgactggcagtgccccaaccccggctgcggcaaccagaacttcgcctggagaaccgagtgcaaccagtgcaaggcccccaagcccgagggcttcctgcccccccccttccccccccccggcggcgacagaggcagaggcggccccggcggcatgagaggcggcagaggcggcctgatggacagaggcggccccggcggcatgttcagaggcggcagaggcggcgacagaggcggcttcagaggcggcagaggcatggacagaggcggcttcggcggcggcagaagaggcggccccggcggcccccccggccccctgatggagcagatgggcggcagaagaggcggcagaggcggccccggcaagatggacaagggcgagcacagacaggagagaagagacagaccctactag

SEQ ID NO: 10608 - DNA, 1968 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagcagcttcagacaggaccaccccagcagcatgggcgtgtacggccaggagagcggcggcttcagcggccccggcgagaacagaagcatgagcggccccgacaacagaggcagaggcagaggcggcttcgacagaggcggcatgagcagaggcggcagaggcggcggcagaggcggcatgggcgccggcgagagaggcggcttcaacaagcccggcggccccatggacgagggccccgacctggacctgggcccccccgtggaccccgacgaggacagcgacaacagcgccatctacgtgcagggcctgaacgacagcgtgaccctggacgacctggccgacttcttcaagcagtgcggcgtggtgaagatgaacaagagaaccggccagcccatgatccacatctacctggacaaggagaccggcaagcccaagggcgacgccaccgtgagctacgaggacccccccaccgccaaggccgccgtggagtggttcgacggcaaggacttccagggcagcaagctgaaggtgagcctggccagaaagaagccccccatgaacagcatgagaggcggcctgccccccagagagggcagaggcatgcccccccccctgagaggcggccccggcggccccggcggccccggcggccccatgggcagaatgggcggcagaggcggcgacagaggcggcttcccccccagaggccccagaggcagcagaggcaaccccagcggcggcggcaacgtgcagcacagagccggcgactggcagtgccccaaccccggctgcggcaaccagaacttcgcctggagaaccgagtgcaaccagtgcaaggcccccaagcccgagggcttcctgcccccccccttccccccccccggcggcgacagaggcagaggcggccccggcggcatgagaggcggcagaggcggcctgatggacagaggcggccccggcggcatgttcagaggcggcagaggcggcgacagaggcggcttcagaggcggcagaggcatggacagaggcggcttcggcggcggcagaagaggcggccccggcggcccccccggccccctgatggagcagatgggcggcagaagaggcggcagaggcggccccggcaagatggacaagggcgagcacagacaggagagaagagacagaccctactag

SEQ ID NO: 10609 - DNA, 1986 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccgtggagggcaccagcaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagcagcttcagacaggaccaccccagcagcatgggcgtgtacggccaggagagcggcggcttcagcggccccggcgagaacagaagcatgagcggccccgacaacagaggcagaggcagaggcggcttcgacagaggcggcatgagcagaggcggcagaggcggcggcagaggcggcatgggcgccggcgagagaggcggcttcaacaagcccggcggccccatggacgagggccccgacctggacctgggcccccccgtggaccccgacgaggacagcgacaacagcgccatctacgtgcagggcctgaacgacagcgtgaccctggacgacctggccgacttcttcaagcagtgcggcgtggtgaagatgaacaagagaaccggccagcccatgatccacatctacctggacaaggagaccggcaagcccaagggcgacgccaccgtgagctacgaggacccccccaccgccaaggccgccgtggagtggttcgacggcaaggacttccagggcagcaagctgaaggtgagcctggccagaaagaagccccccatgaacagcatgagaggcggcctgccccccagagagggcagaggcatgcccccccccctgagaggcggccccggcggccccggcggccccggcggccccatgggcagaatgggcggcagaggcggcgacagaggcggcttcccccccagaggccccagaggcagcagaggcaaccccagcggcggcggcaacgtgcagcacagagccggcgactggcagtgccccaaccccggctgcggcaaccagaacttcgcctggagaaccgagtgcaaccagtgcaaggcccccaagcccgagggcttcctgcccccccccttccccccccccggcggcgacagaggcagaggcggccccggcggcatgagaggcggcagaggcggcctgatggacagaggcggccccggcggcatgttcagaggcggcagaggcggcgacagaggcggcttcagaggcggcagaggcatggacagaggcggcttcggcggcggcagaagaggcggccccggcggcccccccggccccctgatggagcagatgggcggcagaagaggcggcagaggcggccccggcaagatggacaagggcgagcacagacaggagagaagagacagaccctactag

SEQ ID NO: 10610 - DNA, 543 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagctag

SEQ ID NO: 10611 - DNA, 1065 bp, Artificial Sequence
  Description of Artificial Sequence: Synthetic coding sequence
atggccagcaccgactacagcacctacagccaggccgccgcccagcagggctacagcgcctacaccgcccagcccacccagggctacgcccagaccacccaggcctacggccagcagagctacggcacctacggccagcccaccgacgtgagctacacccaggcccagaccaccgccacctacggccagaccgcctacgccaccagctacggccagccccccaccggctacaccacccccaccgccccccaggcctacagccagcccgtgcagggctacggcaccggcgcctacgacaccaccaccgccaccgtgaccaccacccaggccagctacgccgcccagagcgcctacggcacccagcccgcctaccccgcctacggccagcagcccgccgccaccgcccccaccagaccccaggacggcaacaagcccaccgagaccagccagccccagagcagcaccggcggctacaaccagcccagcctgggctacggccagagcaactacagctacccccaggtgcccggcagctaccccatgcagcccgtgaccgccccccccagctacccccccaccagctacagcagcacccagcccaccagctacgaccagagcagctacagccagcagaacacctacggccagcccagcagctacggccagcagagcagctacggccagcagagcagctacggccagcagccccccaccagctaccccccccagaccggcagctacagccaggcccccagccagtacagccagcagagcagcagctacggccagcagagcagcttcagacaggaccaccccagcagcatgggcgtgtacggccaggagagcggcggcttcagcggccccggcgagaacagaagcatgagcggccccgacaacagaggcagaggcagaggcggcttcgacagaggcggcatgagcagaggcggcagaggcggcggcagaggcggcatgggcctgcagagcgagagcctggtgtacaccagcatcctgaagaagtacccctacagcgtgctgagcagacagcacaacgagaagtgggactag

SEQ ID NO: 10612 - DNA, 972 bp, Artificial Sequence
  Description of Artificial Sequence: Synthetic coding sequence
atggaccccggcaaggacaaggagggcgtgccccagcccagcggcccccccgccagaaagaagttcgtgatccccctggacgaggacgaggtgccccccggcgtggccaagcccctgttcagaagcacccagagcctgcccaccgtggacaccagcgcccaggccgccccccagacctacgccgagtacgccatcagccagcccctggagggcgccggcgccacctgccccaccggcagcgagcccctggccggcgagacccccaaccaggccctgaagcccggcgccaagagcaacagcatcatcgtgagccccagacagagaggcaaccccgtgctgaagttcgtgagaaacgtgccctgggagttcggcgacgtgatccccgactacgtgctgggccagagcacctgcgccctgttcctgagcctgagataccacaacctgcaccccgactacatccacggcagactgcagagcctgggcaagaacttcgccctgagagtgctgctggtgcaggtggacgtgaaggacccccagcaggccctgaaggagctggccaagatgtgcatcctggccgactgcaccctgatcctggcctggagccccgaggaggccggcagatacctggagacctacaaggcctacgagcagaagcccgccgacctgctgatggagaagctggagcaggacttcgtgagcagagtgaccgagtgcctgaccaccgtgaagagcgtgaacaagaccgacagccagaccctgctgaccaccttcggcagcctggagcagctgatcgccgccagcagagaggacctggccctgtgccccggcctgggcccccagaaggtgagagccctgggcaagaaccccagaagctggggcaaggagagagcccccaacaagcacaacctgagaccccagagcttcaaggtgaagaaggagcccaagaccagacacagcggcttcagactgtag

SEQ ID NO: 10613 - DNA, 894 bp, Artificial Sequence
  Description of Artificial Sequence: Synthetic coding sequence
atggaccccggcaaggacaaggagggcgtgccccagcccagcggcccccccgccagaaagaagttcgtgatccccctggacgaggacgaggtgccccccggcgtggccaagcccctgttcagaagcacccagagcctgcccaccgtggacaccagcgcccaggccgccccccagacctacgccgagtacgccatcagccagcccctggagggcgccggcgccacctgccccaccggcagcgagcccctggccggcgagacccccaaccaggccctgaagcccggcgccaagagcaacagcatcatcgtgagccccagacagagaggcaaccccgtgctgaagttcgtgagaaacgtgccctgggagttcggcgacgtgatccccgactacgtgctgggccagagcacctgcgccctgttcctgagcctgagataccacaacctgcaccccgactacatccacggcagactgcagagcctgggcaagaacttcgccctgagagtgctgctggtgcaggtggacgtgaaggacccccagcaggccctgaaggagctggccaagatgtgcatcctggccgactgcaccctgatcctggcctggagccccgaggaggccggcagatacctggagacctacaaggcctacgagcagaagcccgccgacctgctgatggagaagctggagcaggacttcgtgagcagagtgaccgagtgcctgaccaccgtgaagagcgtgaacaagaccgacagccagaccctgctgaccaccttcggcagcctggagcagctgatcgccgccagcagagaggacctggccctgtgccccggcctgggcccccagaaggccagaagactgttcgacgtgctgcacgagcccttcctgaaggtgccctag

SEQ ID NO: 10614 - DNA, 822 bp, Artificial Sequence
  Description of Artificial Sequence: Synthetic coding sequence
atggaccccggcaaggacaaggagggcgtgccccagcccagcggcccccccgccagaaagaagttcgtgatccccctggacgaggacgaggtgccccccggcgtggccaagcccctgttcagaagcacccagagcctgcccaccgtggacaccagcgcccaggccgccccccagacctacgccgagtacgccatcagccagcccctggagggcgccggcgccacctgccccaccggcagcgagcccctggccggcgagacccccaaccaggccctgaagcccggcgccaagagcaacagcatcatcgtgagccccagacagagaggcaaccccgtgctgaagttcgtgagaaacgtgccctgggagttcggcgacgtgatccccgactacgtgctgggccagagcacctgcgccctgttcctgagcctgagataccacaacctgcaccccgactacatccacggcagactgcagagcctgggcaagaacttcgccctgagagtgctgctggtgcaggtggacgtgaaggacccccagcaggccctgaaggagctggccaagatgtgcatcctggccgactgcaccctgatcctggcctggagccccgaggaggccggcagatacctggagacctacaaggcctacgagcagaagcccgccgacctgctgatggagaagctggagcaggacttcgtgagcagaagcctggagcagctgatcgccgccagcagagaggacctggccctgtgccccggcctgggcccccagaaggccagaagactgttcgacgtgctgcacgagcccttcctgaaggtgccctag

SEQ ID NO: 10615 - DNA, 678 bp, Artificial Sequence
  Description of Artificial Sequence: Synthetic coding sequence
atggaccccggcaaggacaaggagggcgtgccccagcccagcggcccccccgccagaaagaagttcgtgatccccctggacgaggacgaggtgccccccggcgtgagaggcaaccccgtgctgaagttcgtgagaaacgtgccctgggagttcggcgacgtgatccccgactacgtgctgggccagagcacctgcgccctgttcctgagcctgagataccacaacctgcaccccgactacatccacggcagactgcagagcctgggcaagaacttcgccctgagagtgctgctggtgcaggtggacgtgaaggacccccagcaggccctgaaggagctggccaagatgtgcatcctggccgactgcaccctgatcctggcctggagccccgaggaggccggcagatacctggagacctacaaggcctacgagcagaagcccgccgacctgctgatggagaagctggagcaggacttcgtgagcagagtgaccgagtgcctgaccaccgtgaagagcgtgaacaagaccgacagccagaccctgctgaccaccttcggcagcctggagcagctgatcgccgccagcagagaggacctggccctgtgccccggcctgggcccccagaaggccagaagactgttcgacgtgctgcacgagcccttcctgaaggtgccctag

SEQ ID NO: 10616 - DNA, 120 bp, Artificial Sequence
  Description of Artificial Sequence: Synthetic coding sequence
atggaccccggcaaggacaaggagggcgtgccccagcccagcggcccccccgccagaaagaagttcgtgatccccctggacgaggacgaggtgccccccggcgtgagcaagcccctgtag

SEQ ID NO: 10617 - DNA, 726 bp, Artificial Sequence
  Description of Artificial Sequence: Synthetic coding sequence
atggccagcctgagcggcctggccagcgccctggagagctacagaggcagagacagactgatcagagtgctgggctactgctgccagctggtgggcggcgtgctggtggagcagtgccccgccagaagcgaggtgggcaccagactgctggtggtgagcacccagctgagccactgcagaaccatcctgagactgttcgacgacctggccatgttcgtgtacaccaagcagtacggcctgggcgcccaggaggaggacgccttcgtgagatgcgtgagcgtgctgggcaacctggccgaccagctgtactacccctgcgagcacgtggcctgggccgccgacgccagagtgctgcacgtggacagcagcagatggtggaccctgagcaccaccctgtgggccctgagcctgctgctgggcgtggccagaagcctgtggatgctgctgaagctgagacagagactgagaagccccaccgcccccttcaccagccccctgcccagaggcaagagaagagccatggaggcccagatgcagagcgaggccctgagcctgctgagcaacctggccgacctggccaacgccgtgcactggctgcccagaggcgtgctgtgggccggcagattccccccctggctggtgggcctgatgggcaccatcagcagcatcctgagcatgtaccaggccgccagagccggcggccaggccgaggccaccaccccctag

SEQ ID NO: 10618 - DNA, 1218 bp, Artificial Sequence
  Description of Artificial Sequence: Synthetic coding sequence
atgagagagctgaagagaaccctggacgccaagggccacggcgtgctggagatgcccagcggcaccggcaagaccgtgagcctgctggccctgatcatggcctaccagagagcctaccccctggaggtgaccaagctgatctactgcagcagaaccgtgcccgagatcgagaaggtgatcgaggagctgagaaagctgctgaacttctacgagaagcaggagggcgagaagctgcccttcctgggcctggccctgagcagcagaaagaacctgtgcatccaccccgaggtgacccccctgagattcggcaaggacgtggacggcaagtgccacagcctgaccgccagctacgtgagagcccagtaccagcacgacaccagcctgccccactgcagattctacgaggagttcgacgcccacggcagagaggtgcccctgcccgccggcatctacaacctggacgacctgaaggccctgggcagaagacagggctggtgcccctacttcctggccagatacagcatcctgcacgccaacgtggtggtgtacagctaccactacctgctggaccccaagatcgccgacctggtgagcaaggagctggccagaaaggccgtggtggtgttcgacgaggcccacaacatcgacaacgtgtgcatcgacagcatgagcgtgaacctgaccagaagaaccctggacagatgccagggcaacctggagaccctgcagaagaccgtgctgagaatcaaggagaccgacgagcagagactgagagacgagtacagaagactggtggagggcctgagagaggccagcgccgccagagagaccgacgcccacctggccaaccccgtgctgcccgacgaggtgctgcaggaggccgtgcccggcagcatcagaaccgccgagcacttcctgggcttcctgagaagactgctggagtacgtgaagtggagactgagagtgcagcacgtggtgcaggagagcccccccgccttcctgagcggcctggcccagagagtgtgcatccagagaaagcccctgagattctgcgccgagagactgagaagcctgctgcacaccctggagatcaccgacctggccgacttcagccccctgaccctgctggccaacttcgccaccctggtgagcacctacgccaagggccaggcccagcactgcggcagcagcagaaaccagaagagaagccacccctag

SEQ ID NO: 10619 - DNA, 2133 bp, Artificial Sequence
  Description of Artificial Sequence: Synthetic coding sequence
atgagagagctgaagagaaccctggacgccaaggcctaccccctggaggtgaccaagctgatctactgcagcagaaccgtgcccgagatcgagaaggtgatcgaggagctgagaaagctgctgaacttctacgagaagcaggagggcgagaagctgcccttcctgggcctggccctgagcagcagaaagaacctgtgcatccaccccgaggtgacccccctgagattcggcaaggacgtggacggcaagtgccacagcctgaccgccagctacgtgagagcccagtaccagcacgacaccagcctgccccactgcagattctacgaggagttcgacgcccacggcagagaggtgcccctgcccgccggcatctacaacctggacgacctgaaggccctgggcagaagacagggctggtgcccctacttcctggccagatacagcatcctgcacgccaacgtggtggtgtacagctaccactacctgctggaccccaagatcgccgacctggtgagcaaggagctggccagaaaggccgtggtggtgttcgacgaggcccacaacatcgacaacgtgtgcatcgacagcatgagcgtgaacctgaccagaagaaccctggacagatgccagggcaacctggagaccctgcagaagaccgtgctgagaatcaaggagaccgacgagcagagactgagagacgagtacagaagactggtggagggcctgagagaggccagcgccgccagagagaccgacgcccacctggccaaccccgtgctgcccgacgaggtgctgcaggaggccgtgcccggcagcatcagaaccgccgagcacttcctgggcttcctgagaagactgctggagtacgtgaagtggagactgagagtgcagcacgtggtgcaggagagcccccccgccttcctgagcggcctggcccagagagtgtgcatccagagaaagcccctgagattctgcgccgagagactgagaagcctgctgcacaccctggagatcaccgacctggccgacttcagccccctgaccctgctggccaacttcgccaccctggtgagcacctacgccaagggcttcaccatcatcatcgagcccttcgacgacagaacccccaccatcgccaaccccatcctgcacttcagctgcatggacgccagcctggccatcaagcccgtgttcgagagattccagagcgtgatcatcaccagcggcaccctgagccccctggacatctaccccaagatcctggacttccaccccgtgaccatggccaccttcaccatgaccctggccagagtgtgcctgtgccccatgatcatcggcagaggcaacgaccaggtggccatcagcagcaagttcgagaccagagaggacatcgccgtgatcagaaactacggcaacctgctgctggagatgagcgccgtggtgcccgacggcatcgtggccttcttcaccagctaccagtacatggagagcaccgtggccagctggtacgagcagggcatcctggagaacatccagagaaacaagctgctgttcatcgagacccaggacggcgccgagaccagcgtggccctggagaagtaccaggaggcctgcgagaacggcagaggcgccatcctgctgagcgtggccagaggcaaggtgagcgagggcatcgacttcgtgcaccactacggcagagccgtgatcatgttcggcgtgccctacgtgtacacccagagcagaatcctgaaggccagactggagtacctgagagaccagttccagatcagagagaacgacttcctgaccttcgacgccatgagacacgccgcccagtgcgtgggcagagccatcagaggcaagaccgactacggcctgatggtgttcgccgacaagagattcgccagaggcgacaagagaggcaagctgcccagatggatccaggagcacctgaccgacgccaacctgaacctgaccgtggacgagggcgtgcaggtggccaagtacttcctgagacagatggcccagcccttccacagagaggaccagctgggcctgagcctgctgagcctggagcagctggagagcgaggagaccctgaagagaatcgagcagatcgcccagcagctgtag

SEQ ID NO: 10620 - DNA, 2211 bp, Artificial Sequence
  Description of Artificial Sequence: Synthetic coding sequence
atgagagagctgaagagaaccctggacgccaagggccacggcgtgctggagatgcccagcggcaccggcaagaccgtgagcctgctggccctgatcatggcctaccagagagcctaccccctggaggtgaccaagctgatctactgcagcagaaccgtgcccgagatcgagaaggtgatcgaggagctgagaaagctgctgaacttctacgagaagcaggagggcgagaagctgcccttcctgggcctggccctgagcagcagaaagaacctgtgcatccaccccgaggtgacccccctgagattcggcaaggacgtggacggcaagtgccacagcctgaccgccagctacgtgagagcccagtaccagcacgacaccagcctgccccactgcagattctacgaggagttcgacgcccacggcagagaggtgcccctgcccgccggcatctacaacctggacgacctgaaggccctgggcagaagacagggctggtgcccctacttcctggccagatacagcatcctgcacgccaacgtggtggtgtacagctaccactacctgctggaccccaagatcgccgacctggtgagcaaggagctggccagaaaggccgtggtggtgttcgacgaggcccacaacatcgacaacgtgtgcatcgacagcatgagcgtgaacctgaccagaagaaccctggacagatgccagggcaacctggagaccctgcagaagaccgtgctgagaatcaaggagaccgacgagcagagactgagagacgagtacagaagactggtggagggcctgagagaggccagcgccgccagagagaccgacgcccacctggccaaccccgtgctgcccgacgaggtgctgcaggaggccgtgcccggcagcatcagaaccgccgagcacttcctgggcttcctgagaagactgctggagtacgtgaagtggagactgagagtgcagcacgtggtgcaggagagcccccccgccttcctgagcggcctggcccagagagtgtgcatccagagaaagcccctgagattctgcgccgagagactgagaagcctgctgcacaccctggagatcaccgacctggccgacttcagccccctgaccctgctggccaacttcgccaccctggtgagcacctacgccaagggcttcaccatcatcatcgagcccttcgacgacagaacccccaccatcgccaaccccatcctgcacttcagctgcatggacgccagcctggccatcaagcccgtgttcgagagattccagagcgtgatcatcaccagcggcaccctgagccccctggacatctaccccaagatcctggacttccaccccgtgaccatggccaccttcaccatgaccctggccagagtgtgcctgtgccccatgatcatcggcagaggcaacgaccaggtggccatcagcagcaagttcgagaccagagaggacatcgccgtgatcagaaactacggcaacctgctgctggagatgagcgccgtggtgcccgacggcatcgtggccttcttcaccagctaccagtacatggagagcaccgtggccagctggtacgagcagggcatcctggagaacatccagagaaacaagctgctgttcatcgagacccaggacggcgccgagaccagcgtggccctggagaagtaccaggaggcctgcgagaacggcagaggcgccatcctgctgagcgtggccagaggcaaggtgagcgagggcatcgacttcgtgcaccactacggcagagccgtgatcatgttcggcgtgccctacgtgtacacccagagcagaatcctgaaggccagactggagtacctgagagaccagttccagatcagagagaacgacttcctgaccttcgacgccatgagacacgccgcccagtgcgtgggcagagccatcagaggcaagaccgactacggcctgatggtgttcgccgacaagagattcgccagaggcgacaagagaggcaagctgcccagatggatccaggagcacctgaccgacgccaacctgaacctgaccgtggacgagggcgtgcaggtggccaagtacttcctgagacagatggcccagcccttccacagagaggaccagctgggcctgagcctgctgagcctggagcagctggagagcgaggagaccctgaagagaatcgagcagatcgcccagcagctgtag

SEQ ID NO: 10621 - DNA, 2049 bp, Artificial Sequence
  Description of Artificial Sequence: Synthetic coding sequence
atgaagctgaacgtggacggcctgctggtgtacttcccctacgactacatctaccccgagcagttcagctacatgagagagctgaagagaaccctggacgccaagggccacggcgtgctggagatgcccagcggcaccggcaagaccgtgagcctgctggccctgatcatggcctaccagagagcctaccccctggaggtgaccaagctgatctactgcagcagaaccgtgcccgagatcgagaaggtgatcgaggagctgagaaagctgctgaacttctacgagaagcaggagggcgagaagctgcccttcctgggcctggccctgagcagcagaaagaacctgtgcatccaccccgagatcctgcacgccaacgtggtggtgtacagctaccactacctgctggaccccaagatcgccgacctggtgagcaaggagctggccagaaaggccgtggtggtgttcgacgaggcccacaacatcgacaacgtgtgcatcgacagcatgagcgtgaacctgaccagaagaaccctggacagatgccagggcaacctggagaccctgcagaagaccgtgctgagaatcaaggagaccgacgagcagagactgagagacgagtacagaagactggtggagggcctgagagaggccagcgccgccagagagaccgacgcccacctggccaaccccgtgctgcccgacgaggtgctgcaggaggccgtgcccggcagcatcagaaccgccgagcacttcctgggcttcctgagaagactgctggagtacgtgaagtggagactgagagtgcagcacgtggtgcaggagagcccccccgccttcctgagcggcctggcccagagagtgtgcatccagagaaagcccctgagattctgcgccgagagactgagaagcctgctgcacaccctggagatcaccgacctggccgacttcagccccctgaccctgctggccaacttcgccaccctggtgagcacctacgccaagggcttcaccatcatcatcgagcccttcgacgacagaacccccaccatcgccaaccccatcctgcacttcagctgcatggacgccagcctggccatcaagcccgtgttcgagagattccagagcgtgatcatcaccagcggcaccctgagccccctggacatctaccccaagatcctggacttccaccccgtgaccatggccaccttcaccatgaccctggccagagtgtgcctgtgccccatgatcatcggcagaggcaacgaccaggtggccatcagcagcaagttcgagaccagagaggacatcgccgtgatcagaaactacggcaacctgctgctggagatgagcgccgtggtgcccgacggcatcgtggccttcttcaccagctaccagtacatggagagcaccgtggccagctggtacgagcagggcatcctggagaacatccagagaaacaagctgctgttcatcgagacccaggacggcgccgagaccagcgtggccctggagaagtaccaggaggcctgcgagaacggcagaggcgccatcctgctgagcgtggccagaggcaaggtgagcgagggcatcgacttcgtgcaccactacggcagagccgtgatcatgttcggcgtgccctacgtgtacacccagagcagaatcctgaaggccagactggagtacctgagagaccagttccagatcagagagaacgacttcctgaccttcgacgccatgagacacgccgcccagtgcgtgggcagagccatcagaggcaagaccgactacggcctgatggtgttcgccgacaagagattcgccagaggcgacaagagaggcaagctgcccagatggatccaggagcacctgaccgacgccaacctgaacctgaccgtggacgagggcgtgcaggtggccaagtacttcctgagacagatggcccagcccttccacagagaggaccagctgggcctgagcctgctgagcctggagcagctggagagcgaggagaccctgaagagaatcgagcagatcgcccagcagctgtag

SEQ ID NO: 10622 - DNA, 2283 bp, Artificial Sequence
  Description of Artificial Sequence: Synthetic coding sequence
atgaagctgaacgtggacggcctgctggtgtacttcccctacgactacatctaccccgagcagttcagctacatgagagagctgaagagaaccctggacgccaagggccacggcgtgctggagatgcccagcggcaccggcaagaccgtgagcctgctggccctgatcatggcctaccagagagcctaccccctggaggtgaccaagctgatctactgcagcagaaccgtgcccgagatcgagaaggtgatcgaggagctgagaaagctgctgaacttctacgagaagcaggagggcgagaagctgcccttcctgggcctggccctgagcagcagaaagaacctgtgcatccaccccgaggtgacccccctgagattcggcaaggacgtggacggcaagtgccacagcctgaccgccagctacgtgagagcccagtaccagcacgacaccagcctgccccactgcagattctacgaggagttcgacgcccacggcagagaggtgcccctgcccgccggcatctacaacctggacgacctgaaggccctgggcagaagacagggctggtgcccctacttcctggccagatacagcatcctgcacgccaacgtggtggtgtacagctaccactacctgctggaccccaagatcgccgacctggtgagcaaggagctggccagaaaggccgtggtggtgttcgacgaggcccacaacatcgacaacgtgtgcatcgacagcatgagcgtgaacctgaccagaagaaccctggacagatgccagggcaacctggagaccctgcagaagaccgtgctgagaatcaaggagaccgacgagcagagactgagagacgagtacagaagactggtggagggcctgagagaggccagcgccgccagagagaccgacgcccacctggccaaccccgtgctgcccgacgaggtgctgcaggaggccgtgcccggcagcatcagaaccgccgagcacttcctgggcttcctgagaagactgctggagtacgtgaagtggagactgagagtgcagcacgtggtgcaggagagcccccccgccttcctgagcggcctggcccagagagtgtgcatccagagaaagcccctgagattctgcgccgagagactgagaagcctgctgcacaccctggagatcaccgacctggccgacttcagccccctgaccctgctggccaacttcgccaccctggtgagcacctacgccaagggcttcaccatcatcatcgagcccttcgacgacagaacccccaccatcgccaaccccatcctgcacttcagctgcatggacgccagcctggccatcaagcccgtgttcgagagattccagagcgtgatcatcaccagcggcaccctgagccccctggacatctaccccaagatcctggacttccaccccgtgaccatggccaccttcaccatgaccctggccagagtgtgcctgtgccccatgatcatcggcagaggcaacgaccaggtggccatcagcagcaagttcgagaccagagaggacatcgccgtgatcagaaactacggcaacctgctgctggagatgagcgccgtggtgcccgacggcatcgtggccttcttcaccagctaccagtacatggagagcaccgtggccagctggtacgagcagggcatcctggagaacatccagagaaacaagctgctgttcatcgagacccaggacggcgccgagaccagcgtggccctggagaagtaccaggaggcctgcgagaacggcagaggcgccatcctgctgagcgtggccagaggcaaggtgagcgagggcatcgacttcgtgcaccactacggcagagccgtgatcatgttcggcgtgccctacgtgtacacccagagcagaatcctgaaggccagactggagtacctgagagaccagttccagatcagagagaacgacttcctgaccttcgacgccatgagacacgccgcccagtgcgtgggcagagccatcagaggcaagaccgactacggcctgatggtgttcgccgacaagagattcgccagaggcgacaagagaggcaagctgcccagatggatccaggagcacctgaccgacgccaacctgaacctgaccgtggacgagggcgtgcaggtggccaagtacttcctgagacagatggcccagcccttccacagagaggaccagctgggcctgagcctgctgagcctggagcagctggagagcgaggagaccctgaagagaatcgagcagatcgcccagcagctgtag

SEQ ID NO: 10623 - DNA, 2751 bp, Artificial Sequence
  Description of Artificial Sequence: Synthetic coding sequence
atggagagcggccagcccgccagaagaatcgccatggcccccctgctggagtacgagagacagctggtgctggagctgctggacaccgacggcctggtggtgtgcgccagaggcctgggcgccgacagactgctgtaccacttcctgcagctgcactgccaccccgcctgcctggtgctggtgctgaacacccagcccgccgaggaggagtacttcatcaaccagctgaagatcgagggcgtggagcacctgcccagaagagtgaccaacgagatcaccagcaacagcagatacgaggtgtacacccagggcggcgtgatcttcgccaccagcagaatcctggtggtggacttcctgaccgacagaatccccagcgacctgatcaccggcatcctggtgtacagagcccacagaatcatcgagagctgccaggaggccttcatcctgagactgttcagacagaagaacaagagaggcttcatcaaggccttcaccgacaacgccgtggccttcgacaccggcttctgccacgtggagagagtgatgagaaacctgttcgtgagaaagctgtacctgtggcccagattccacgtggccgtgaacagcttcctggagcagcacaagcccgaggtggtggagatccacgtgagcatgacccccaccatgctggccatccagaccgccatcctggacatcctgaacgcctgcctgaaggagctgaagtgccacaaccccagcctggaggtggaggacctgagcctggagaacgccatcggcaagcccttcgacaagaccatcagacactacctggaccccctgtggcaccagctgggcgccaagaccaagagcctggtgcaggacctgaagatcctgagaaccctgctgcagtacctgagccagtacgactgcgtgaccttcctgaacctgctggagagcctgagagccaccgagaaggccttcggccagaacagcggctggctgttcctggacagcagcaccagcatgttcatcaacgccagagccagagtgtaccacctgcccgacgccaagatgagcaagaaggagaagatcagcgagaagatggagatcaaggagggcgaggagaccaagaaggagctggtgctggagagcaaccccaagtgggaggccctgaccgaggtgctgaaggagatcgaggccgagaacaaggagagcgaggccctgggcggccccggccaggtgctgatctgcgccagcgacgacagaacctgcagccagctgagagactacatcaccctgggcgccgaggccttcctgctgagactgtacagaaagaccttcgagaaggacagcaaggccgaggaggtgtggatgaagttcagaaaggaggacagcagcaagagaatcagaaagagccacaagagacccaaggacccccagaacaaggagagagccagcaccaaggagagaaccctgaagaagaagaagagaaagctgaccctgacccagatggtgggcaagcccgaggagctggaggaggagggcgacgtggaggagggctacagaagagagatcagcagcagccccgagagctgccccgaggagatcaagcacgaggagttcgacgtgaacctgagcagcgacgccgccttcggcatcctgaaggagcccctgaccatcatccaccccctgctgggctgcagcgacccctacgccctgaccagagtgctgcacgaggtggagcccagatacgtggtgctgtacgacgccgagctgaccttcgtgagacagctggagatctacagagccagcagacccggcaagcccctgagagtgtacttcctgatctacggcggcagcaccgaggagcagagatacctgaccgccctgagaaaggagaaggaggccttcgagaagctgatcagagagaaggccagcatggtggtgcccgaggagagagagggcagagacgagaccaacctggacctggtgagaggcaccgccagcgccgacgtgagcaccgacaccagaaaggccggcggccaggagcagaacggcacccagcagagcatcgtggtggacatgagagagttcagaagcgagctgcccagcctgatccacagaagaggcatcgacatcgagcccgtgaccctggaggtgggcgactacatcctgacccccgagatgtgcgtggagagaaagagcatcagcgacctgatcggcagcctgaacaacggcagactgtacagccagtgcatcagcatgagcagatactacaagagacccgtgctgctgatcgagttcgaccccagcaagcccttcagcctgaccagcagaggcgccctgttccaggagatcagcagcaacgacatcagcagcaagctgaccctgctgaccctgcacttccccagactgagaatcctgtggtgccccagcccccacgccaccgccgagctgttcgaggagctgaagcagagcaagccccagcccgacgccgccaccgccctggccatcaccgccgacagcgagaccctgcccgagagcgagaagtacaaccccggcccccaggacttcctgctgaagatgcccggcgtgaacgccaagaactgcagaagcctgatgcaccacgtgaagaacatcgccgagctggccgccctgagccaggacgagctgaccagcatcctgggcaacgccgccaacgccaagcagctgtacgacttcatccacaccagcttcgccgaggtggtgagcaagggcaagggcaagaagtag

SEQ ID NO: 10624 - DNA, 2715 bp, Artificial Sequence
  Description of Artificial Sequence: Synthetic coding sequence
atggcccccctgctggagtacgagagacagctggtgctggagctgctggacaccgacggcctggtggtgtgcgccagaggcctgggcgccgacagactgctgtaccacttcctgcagctgcactgccaccccgcctgcctggtgctggtgctgaacacccagcccgccgaggaggagtacttcatcaaccagctgaagatcgagggcgtggagcacctgcccagaagagtgaccaacgagatcaccagcaacagcagatacgaggtgtacacccagggcggcgtgatcttcgccaccagcagaatcctggtggtggacttcctgaccgacagaatccccagcgacctgatcaccggcatcctggtgtacagagcccacagaatcatcgagagctgccaggaggccttcatcctgagactgttcagacagaagaacaagagaggcttcatcaaggccttcaccgacaacgccgtggccttcgacaccggcttctgccacgtggagagagtgatgagaaacctgttcgtgagaaagctgtacctgtggcccagattccacgtggccgtgaacagcttcctggagcagcacaagcccgaggtggtggagatccacgtgagcatgacccccaccatgctggccatccagaccgccatcctggacatcctgaacgcctgcctgaaggagctgaagtgccacaaccccagcctggaggtggaggacctgagcctggagaacgccatcggcaagcccttcgacaagaccatcagacactacctggaccccctgtggcaccagctgggcgccaagaccaagagcctggtgcaggacctgaagatcctgagaaccctgctgcagtacctgagccagtacgactgcgtgaccttcctgaacctgctggagagcctgagagccaccgagaaggccttcggccagaacagcggctggctgttcctggacagcagcaccagcatgttcatcaacgccagagccagagtgtaccacctgcccgacgccaagatgagcaagaaggagaagatcagcgagaagatggagatcaaggagggcgaggagaccaagaaggagctggtgctggagagcaaccccaagtgggaggccctgaccgaggtgctgaaggagatcgaggccgagaacaaggagagcgaggccctgggcggccccggccaggtgctgatctgcgccagcgacgacagaacctgcagccagctgagagactacatcaccctgggcgccgaggccttcctgctgagactgtacagaaagaccttcgagaaggacagcaaggccgaggaggtgtggatgaagttcagaaaggaggacagcagcaagagaatcagaaagagccacaagagacccaaggacccccagaacaaggagagagccagcaccaaggagagaaccctgaagaagaagaagagaaagctgaccctgacccagatggtgggcaagcccgaggagctggaggaggagggcgacgtggaggagggctacagaagagagatcagcagcagccccgagagctgccccgaggagatcaagcacgaggagttcgacgtgaacctgagcagcgacgccgccttcggcatcctgaaggagcccctgaccatcatccaccccctgctgggctgcagcgacccctacgccctgaccagagtgctgcacgaggtggagcccagatacgtggtgctgtacgacgccgagctgaccttcgtgagacagctggagatctacagagccagcagacccggcaagcccctgagatacttcctgatctacggcggcagcaccgaggagcagagatacctgaccgccctgagaaaggagaaggaggccttcgagaagctgatcagagagaaggccagcatggtggtgcccgaggagagagagggcagagacgagaccaacctggacctggtgagaggcaccgccagcgccgacgtgagcaccgacaccagaaaggccggcggccaggagcagaacggcacccagcagagcatcgtggtggacatgagagagttcagaagcgagctgcccagcctgatccacagaagaggcatcgacatcgagcccgtgaccctggaggtgggcgactacatcctgacccccgagatgtgcgtggagagaaagagcatcagcgacctgatcggcagcctgaacaacggcagactgtacagccagtgcatcagcatgagcagatactacaagagacccgtgctgctgatcgagttcgaccccagcaagcccttcagcctgaccagcagaggcgccctgttccaggagatcagcagcaacgacatcagcagcaagctgaccctgctgaccctgcacttccccagactgagaatcctgtggtgccccagcccccacgccaccgccgagctgttcgaggagctgaagcagagcaagccccagcccgacgccgccaccgccctggccatcaccgccgacagcgagaccctgcccgagagcgagaagtacaaccccggcccccaggacttcctgctgaagatgcccggcgtgaacgccaagaactgcagaagcctgatgcaccacgtgaagaacatcgccgagctggccgccctgagccaggacgagctgaccagcatcctgggcaacgccgccaacgccaagcagctgtacgacttcatccacaccagcttcgccgaggtggtgagcaagggcaagggcaagaagtag

SEQ ID NO: 10625 - DNA, 1071 bp, Artificial Sequence
  Description of Artificial Sequence: Synthetic coding sequence
atggcccccctgctggagtacgagagacagctggtgctggagctgctggacaccgacggcctggtggtgtgcgccagaggcctgggcgccgacagactgctgtaccacttcctgcagctgcactgccaccccgcctgcctggtgctggtgctgaacacccagcccgccgaggaggagtacttcatcaaccagctgaagatcgagggcgtggagcacctgcccagaagagtgaccaacgagatcaccagcaacagcagatacgaggtgtacacccagggcggcgtgatcttcgccaccagcagaatcctggtggtggacttcctgaccgacagaatccccagcgacctgatcaccggcatcctggtgtacagagcccacagaatcatcgagagctgccaggaggccttcatcctgagactgttcagacagaagaacaagagaggcttcatcaaggccttcaccgacaacgccgtggccttcgacaccggcttctgccacgtggagagagtgatgagaaacctgttcgtgagaaagctgtacctgtggcccagattccacgtggccgtgaacagcttcctggagcagcacaagcccgaggtggtggagatccacgtgagcatgacccccaccatgctggccatccagaccgccatcctggacatcctgaacgcctgcctgaaggagctgaagtgccacaaccccagcctggaggtggaggacctgagcctggagaacgccatcggcaagcccttcgacaagaccatcagacactacctggaccccctgtggcaccagctgggcgccaagaccaagagcctggtgcaggacctgaagatcctgagaaccctgctgcagtacctgagccagtacgactgcgtgaccttcctgaacctgctggagagcctgagagccaccgagaaggccttcggccagaacagcggctggctgttcctggacagcagcaccagcatgttcatcaacgccagagccagagtgtaccacctgcccgacgccaagatgagcaagaaggagaagatcagcgagaagatcaagaagaagaagaagaagtag

SEQ ID NO: 10626 - DNA, 3561 bp, Artificial Sequence
  Description of Artificial Sequence: Synthetic coding sequence
atgggcgtgcagggcctgtggaagctgctggagtgcagcggcagacaggtgagccccgaggccctggagggcaagatcctggccgtggacatcagcatctggctgaaccaggccctgaagggcgtgagagacagacacggcaacagcatcgagaacccccacctgctgaccctgttccacagactgtgcaagctgctgttcttcagaatcagacccatcttcgtgttcgacggcgacgcccccctgctgaagaagcagaccctggtgaagagaagacagagaaaggacctggccagcagcgacagcagaaagaccaccgagaagctgctgaagaccttcctgaagagacaggccatcaagaccgccttcagaagcaagagagacgaggccctgcccagcctgacccaggtgagaagagagaacgacctgtacgtgctgccccccctgcaggaggaggagaagcacagcagcgaggaggaggacgagaaggagtggcaggagagaatgaaccagaagcaggccctgcaggaggagttcttccacaacccccaggccatcgacatcgagagcgaggacttcagcagcctgccccccgaggtgaagcacgagatcctgaccgacatgaaggagttcaccaagagaagaagaaccctgttcgaggccatgcccgaggagagcgacgacttcagccagtaccagctgaagggcctgctgaagaagaactacctgaaccagcacatcgagcacgtgcagaaggagatgaaccagcagcacagcggccacatcagaagacagtacgaggacgagggcggcttcctgaaggaggtggagagcagaagagtggtgagcgaggacaccagccactacatcctgatcaagggcatccaggccaagaccgtggccgaggtggacagcgagagcctgcccagcagcagcaagatgcacggcatgagcttcgacgtgaagagcagcccctgcgagaagctgaagaccgagaaggagcccgacgccaccccccccagccccagaaccctgctggccatgcaggccgccctgctgggcagcagcagcgaggaggagctggagagcgagaacagaagacaggccagaggcagaaacgcccccgccgccgtggacgagggcagcatcagccccagaaccctgagcgccatcaagagagccctggacgacgacgaggacgtgaaggtgtgcgccggcgacgacgtgcagaccggcggccccggcgccgaggagatgagaatcaacagcagcaccgagaacagcgacgagggcctgaaggtgagagacggcaagggcatccccttcaccgccaccctggccagcagcagcgtgaacagcgccgaggagcacgtggccagcaccaacgagggcagagagcccaccgacagcgtgcccaaggagcagatgagcctggtgcacgtgggcaccgaggccttccccatcagcgacgagagcatgatcaaggacagaaaggacagactgcccctggagagcgccgtggtgagacacagcgacgcccccggcctgcccaacggcagagagctgacccccgccagccccacctgcaccaacagcgtgagcaagaacgagacccacgccgaggtgctggagcagcagaacgagctgtgcccctacgagagcaagttcgacagcagcctgctgagcagcgacgacgagaccaagtgcaagcccaacagcgccagcgaggtgatcggccccgtgagcctgcaggagaccagcagcatcgtgagcgtgcccagcgaggccgtggacaacgtggagaacgtggtgagcttcaacgccaaggagcacgagaacttcctggagaccatccaggagcagcagaccaccgagagcgccggccaggacctgatcagcatccccaaggccgtggagcccatggagatcgacagcgaggagagcgagagcgacggcagcttcatcgaggtgcagagcgtgatcagcgacgaggagctgcaggccgagttccccgagaccagcaagccccccagcgagcagggcgaggaggagctggtgggcaccagagagggcgaggcccccgccgagagcgagagcctgctgagagacaacagcgagagagacgacgtggacggcgagccccaggaggccgagaaggacgccgaggacagcctgcacgagtggcaggacatcaacctggaggagctggagaccctggagagcaacctgctggcccagcagaacagcctgaaggcccagaagcagcagcaggagagaatcgccgccaccgtgaccggccagatgttcctggagagccaggagctgctgagactgttcggcatcccctacatccaggcccccatggaggccgaggcccagtgcgccatcctggacctgaccgaccagaccagcggcaccatcaccgacgacagcgacatctggctgttcggcgccagacacgtgtacagaaacttcttcaacaagaacaagttcgtggagtactaccagtacgtggacttccacaaccagctgggcctggacagaaacaagctgatcaacctggcctacctgctgggcagcgactacaccgagggcatccccaccgtgggctgcgtgaccgccatggagatcctgaacgagttccccggccacggcctggagcccctgctgaagttcagcgagtggtggcacgaggcccagaagaaccccaagatcagacccaacccccacgacaccaaggtgaagaagaagctgagaaccctgcagctgacccccggcttccccaaccccgccgtggccgaggcctacctgaagcccgtggtggacgacagcaagggcagcttcctgtggggcaagcccgacctggacaagatcagagagttctgccagagatacttcggctggaacagaaccaagaccgacgagagcctgttccccgtgctgaagcagctggacgcccagcagacccagctgagaatcgacagcttcttcagactggcccagcaggagaaggaggacgccaagagaatcaagagccagagactgaacagagccgtgacctgcatgctgagaaaggagaaggaggccgccgccagcgagatcgaggccgtgagcgtggccatggagaaggagttcgagctgctggacaaggccaagggcaagacccagaagagaggcatcaccaacaccctggaggagagcagcagcctgaagagaaagagactgagcgacagcaagggcaagaacacctgcggcggcttcctgggcgagacctgcctgagcgagagcagcgacggcagcagcagcgaggacgccgagagcagcagcctgatgaacgtgcagagaagaaccgccgccaaggagcccaagaccagcgccagcgacagccagaacagcgtgaaggaggcccccgtgaagaacggcggcgccaccaccagcagcagcagcgacagcgacgacgacggcggcaaggagaagatggtgctggtgaccgccagaagcgtgttcggcaagaagagaagaaagctgagaagagccagaggcagaaagagaaagacctag

SEQ ID NO: 10627 - DNA, 1260 bp, Artificial Sequence
  Description of Artificial Sequence: Synthetic coding sequence
atgttcctggagagccaggagctgctgagactgttcggcatcccctacatccaggcccccatggaggccgaggcccagtgcgccatcctggacctgaccgaccagaccagcggcaccatcaccgacgacagcgacatctggctgttcggcgccagacacgtgtacagaaacttcttcaacaagaacaagttcgtggagtactaccagtacgtggacttccacaaccagctgggcctggacagaaacaagctgatcaacctggcctacctgctgggcagcgactacaccgagggcatccccaccgtgggctgcgtgaccgccatggagatcctgaacgagttccccggccacggcctggagcccctgctgaagttcagcgagtggtggcacgaggcccagaagaaccccaagatcagacccaacccccacgacaccaaggtgaagaagaagctgagaaccctgcagctgacccccggcttccccaaccccgccgtggccgaggcctacctgaagcccgtggtggacgacagcaagggcagcttcctgtggggcaagcccgacctggacaagatcagagagttctgccagagatacttcggctggaacagaaccaagaccgacgagagcctgttccccgtgctgaagcagctggacgcccagcagacccagctgagaatcgacagcttcttcagactggcccagcaggagaaggaggacgccaagagaatcaagagccagagactgaacagagccgtgacctgcatgctgagaaaggagaaggaggccgccgccagcgagatcgaggccgtgagcgtggccatggagaaggagttcgagctgctggacaaggccaagggcaagacccagaagagaggcatcaccaacaccctggaggagagcagcagcctgaagagaaagagactgagcgacagcaagggcaagaacacctgcggcggcttcctgggcgagacctgcctgagcgagagcagcgacggcagcagcagcgaggacgccgagagcagcagcctgatgaacgtgcagagaagaaccgccgccaaggagcccaagaccagcgccagcgacagccagaacagcgtgaaggaggcccccgtgaagaacggcggcgccaccaccagcagcagcagcgacagcgacgacgacggcggcaaggagaagatggtgctggtgaccgccagaagcgtgttcggcaagaagagaagaaagctgagaagagccagaggcagaaagagaaagacctag

SEQ ID NO: 10628 - DNA, 3057 bp, Artificial Sequence
  Description of Artificial Sequence: Synthetic coding sequence
atgaaccagaagcaggccctgcaggaggagttcttccacaacccccaggccatcgacatcgagagcgaggacttcagcagcctgccccccgaggtgaagcacgagatcctgaccgacatgaaggagttcaccaagagaagaagaaccctgttcgaggccatgcccgaggagagcgacgacttcagccagtaccagctgaagggcctgctgaagaagaactacctgaaccagcacatcgagcacgtgcagaaggagatgaaccagcagcacagcggccacatcagaagacagtacgaggacgagggcggcttcctgaaggaggtggagagcagaagagtggtgagcgaggacaccagccactacatcctgatcaagggcatccaggccaagaccgtggccgaggtggacagcgagagcctgcccagcagcagcaagatgcacggcatgagcttcgacgtgaagagcagcccctgcgagaagctgaagaccgagaaggagcccgacgccaccccccccagccccagaaccctgctggccatgcaggccgccctgctgggcagcagcagcgaggaggagctggagagcgagaacagaagacaggccagaggcagaaacgcccccgccgccgtggacgagggcagcatcagccccagaaccctgagcgccatcaagagagccctggacgacgacgaggacgtgaaggtgtgcgccggcgacgacgtgcagaccggcggccccggcgccgaggagatgagaatcaacagcagcaccgagaacagcgacgagggcctgaaggtgagagacggcaagggcatccccttcaccgccaccctggccagcagcagcgtgaacagcgccgaggagcacgtggccagcaccaacgagggcagagagcccaccgacagcgtgcccaaggagcagatgagcctggtgcacgtgggcaccgaggccttccccatcagcgacgagagcatgatcaaggacagaaaggacagactgcccctggagagcgccgtggtgagacacagcgacgcccccggcctgcccaacggcagagagctgacccccgccagccccacctgcaccaacagcgtgagcaagaacgagacccacgccgaggtgctggagcagcagaacgagctgtgcccctacgagagcaagttcgacagcagcctgctgagcagcgacgacgagaccaagtgcaagcccaacagcgccagcgaggtgatcggccccgtgagcctgcaggagaccagcagcatcgtgagcgtgcccagcgaggccgtggacaacgtggagaacgtggtgagcttcaacgccaaggagcacgagaacttcctggagaccatccaggagcagcagaccaccgagagcgccggccaggacctgatcagcatccccaaggccgtggagcccatggagatcgacagcgaggagagcgagagcgacggcagcttcatcgaggtgcagagcgtgatcagcgacgaggagctgcaggccgagttccccgagaccagcaagccccccagcgagcagggcgaggaggagctggtgggcaccagagagggcgaggcccccgccgagagcgagagcctgctgagagacaacagcgagagagacgacgtggacggcgagccccaggaggccgagaaggacgccgaggacagcctgcacgagtggcaggacatcaacctggaggagctggagaccctggagagcaacctgctggcccagcagaacagcctgaaggcccagaagcagcagcaggagagaatcgccgccaccgtgaccggccagatgttcctggagagccaggagctgctgagactgttcggcatcccctacatccaggcccccatggaggccgaggcccagtgcgccatcctggacctgaccgaccagaccagcggcaccatcaccgacgacagcgacatctggctgttcggcgccagacacgtgtacagaaacttcttcaacaagaacaagttcgtggagtactaccagtacgtggacttccacaaccagctgggcctggacagaaacaagctgatcaacctggcctacctgctgggcagcgactacaccgagggcatccccaccgtgggctgcgtgaccgccatggagatcctgaacgagttccccggccacggcctggagcccctgctgaagttcagcgagtggtggcacgaggcccagaagaaccccaagatcagacccaacccccacgacaccaaggtgaagaagaagctgagaaccctgcagctgacccccggcttccccaaccccgccgtggccgaggcctacctgaagcccgtggtggacgacagcaagggcagcttcctgtggggcaagcccgacctggacaagatcagagagttctgccagagatacttcggctggaacagaaccaagaccgacgagagcctgttccccgtgctgaagcagctggacgcccagcagacccagctgagaatcgacagcttcttcagactggcccagcaggagaaggaggacgccaagagaatcaagagccagagactgaacagagccgtgacctgcatgctgagaaaggagaaggaggccgccgccagcgagatcgaggccgtgagcgtggccatggagaaggagttcgagctgctggacaaggccaagggcaagacccagaagagaggcatcaccaacaccctggaggagagcagcagcctgaagagaaagagactgagcgacagcaagggcaagaacacctgcggcggcttcctgggcgagacctgcctgagcgagagcagcgacggcagcagcagcgaggacgccgagagcagcagcctgatgaacgtgcagagaagaaccgccgccaaggagcccaagaccagcgccagcgacagccagaacagcgtgaaggaggcccccgtgaagaacggcggcgccaccaccagcagcagcagcgacagcgacgacgacggcggcaaggagaagatggtgctggtgaccgccagaagcgtgttcggcaagaagagaagaaagctgagaagagccagaggcagaaagagaaagacctag

SEQ ID NO: 10629 - DNA, 4836 bp, Artificial Sequence
  Description of Artificial Sequence: Synthetic coding sequence
cagggcgccgtgaagagcttctgcaccagcgccagcggcgcccccctgggccccaagggcgacggccactacccctggagctgccccgtgacccacaccagagagaagatctacgccatctgcagcgactacgccttcctgaaccaggccaccagcatctacaagacccccaaccccagcagaagcccctgcctgcccgacagcaccagcctgagcgccggcaacaacagcagcagatacatcggcatccccaccagcaccagcgagatcatctacaacgaggagaacagcctggagaacctgagcaacagcctgggcaagctgcccctggcctgggagatcgacaagagcgagttcgacggcgtgaccaccaacagcaagcacaagagcggcaacgccaagaagcaggtgagcaagagaaagaccagcgacaagaagggcagataccagaaggagtgcccccagcacagccccctggaggacatcaagcagagaaaggtgctggacctgagaagatggtactgcatcagcagaccccagtacaagaccagctgcggcatcagcagcctgatcagctgctggaacttcctgtacagcaccatgggcgccggcaacctgccccccatcacccaggaggaggccctgcacatcctgggcttccagccccccttcgaggacatcagattcggccccttcaccggcaacaccaccctgatgagatggttcagacagatcaacgaccacttccacgtgaagggctgcagctacgtgctgtacaagccccacggcaagaacaagaccgccggcgagaccgccagcggcgccctgagcaagctgaccagaggcctgaaggacgagagcctggcctacatctaccactgccagaaccactacttctgccccatcggcttcgaggccacccccgtgaaggccaacaaggccttcagcagaggccccctgagcccccaggaggtggagtactggatcctgatcggcgagagcagcagaaagcaccccgccatccactgcaagaagtgggccgacatcgtgaccgacctgaacacccagaaccccgagtacctggacatcagacacctggagagaggcctgcagtacagaaagaccaagaaggtgggcggcaacctgcactgcatcatcgccttccagagactgaactggcagagattcggcctgtggaacttccccttcggcaccatcagacaggagagccagccccccacccacgcccagggcatcgccaagagcgagagcgaggacaacatcagcaagaagcagcacggcagactgggcagaagcttcagcgccagcttccaccaggacagcgcctggaagaagatgagcaacatcagcatctggctgaaccaggccctgaagggcgtgagagacagacacggcaacagcatcgagaacccccacctgctgaccctgttccacagactgtgcaagctgctgttcttcagaatcagacccatcttcgtgttcgacggcgacgcccccctgctgaagaagcagaccctggtgaagagaagacagagaaaggacctggccagcagcgacagcagaaagaccaccgagaagctgctgaagaccttcctgaagagacaggccatcaagaccgccttcagaagcaagagagacgaggccctgcccagcctgacccaggtgagaagagagaacgacctgtacgtgctgccccccctgcaggaggaggagaagcacagcagcgaggaggaggacgagaaggagtggcaggagagaatgaaccagaagcaggccctgcaggaggagttcttccacaacccccaggccatcgacatcgagagcgaggacttcagcagcctgccccccgaggtgaagcacgagatcctgaccgacatgaaggagttcaccaagagaagaagaaccctgttcgaggccatgcccgaggagagcgacgacttcagccagtaccagctgaagggcctgctgaagaagaactacctgaaccagcacatcgagcacgtgcagaaggagatgaaccagcagcacagcggccacatcagaagacagtacgaggacgagggcggcttcctgaaggaggtggagagcagaagagtggtgagcgaggacaccagccactacatcctgatcaagggcatccaggccaagaccgtggccgaggtggacagcgagagcctgcccagcagcagcaagatgcacggcatgagcttcgacgtgaagagcagcccctgcgagaagctgaagaccgagaaggagcccgacgccaccccccccagccccagaaccctgctggccatgcaggccgccctgctgggcagcagcagcgaggaggagctggagagcgagaacagaagacaggccagaggcagaaacgcccccgccgccgtggacgagggcagcatcagccccagaaccctgagcgccatcaagagagccctggacgacgacgaggacgtgaaggtgtgcgccggcgacgacgtgcagaccggcggccccggcgccgaggagatgagaatcaacagcagcaccgagaacagcgacgagggcctgaaggtgagagacggcaagggcatccccttcaccgccaccctggccagcagcagcgtgaacagcgccgaggagcacgtggccagcaccaacgagggcagagagcccaccgacagcgtgcccaaggagcagatgagcctggtgcacgtgggcaccgaggccttccccatcagcgacgagagcatgatcaaggacagaaaggacagactgcccctggagagcgccgtggtgagacacagcgacgcccccggcctgcccaacggcagagagctgacccccgccagccccacctgcaccaacagcgtgagcaagaacgagacccacgccgaggtgctggagcagcagaacgagctgtgcccctacgagagcaagttcgacagcagcctgctgagcagcgacgacgagaccaagtgcaagcccaacagcgccagcgaggtgatcggccccgtgagcctgcaggagaccagcagcatcgtgagcgtgcccagcgaggccgtggacaacgtggagaacgtggtgagcttcaacgccaaggagcacgagaacttcctggagaccatccaggagcagcagaccaccgagagcgccggccaggacctgatcagcatccccaaggccgtggagcccatggagatcgacagcgaggagagcgagagcgacggcagcttcatcgaggtgcagagcgtgatcagcgacgaggagctgcaggccgagttccccgagaccagcaagccccccagcgagcagggcgaggaggagctggtgggcaccagagagggcgaggcccccgccgagagcgagagcctgctgagagacaacagcgagagagacgacgtggacggcgagccccaggaggccgagaaggacgccgaggacagcctgcacgagtggcaggacatcaacctggaggagctggagaccctggagagcaacctgctggcccagcagaacagcctgaaggcccagaagcagcagcaggagagaatcgccgccaccgtgaccggccagatgttcctggagagccaggagctgctgagactgttcggcatcccctacatccaggcccccatggaggccgaggcccagtgcgccatcctggacctgaccgaccagaccagcggcaccatcaccgacgacagcgacatctggctgttcggcgccagacacgtgtacagaaacttcttcaacaagaacaagttcgtggagtactaccagtacgtggacttccacaaccagctgggcctggacagaaacaagctgatcaacctggcctacctgctgggcagcgactacaccgagggcatccccaccgtgggctgcgtgaccgccatggagatcctgaacgagttccccggccacggcctggagcccctgctgaagttcagcgagtggtggcacgaggcccagaagaaccccaagatcagacccaacccccacgacaccaaggtgaagaagaagctgagaaccctgcagctgacccccggcttccccaaccccgccgtggccgaggcctacctgaagcccgtggtggacgacagcaagggcagcttcctgtggggcaagcccgacctggacaagatcagagagttctgccagagatacttcggctggaacagaaccaagaccgacgagagcctgttccccgtgctgaagcagctggacgcccagcagacccagctgagaatcgacagcttcttcagactggcccagcaggagaaggaggacgccaagagaatcaagagccagagactgaacagagccgtgacctgcatgctgagaaaggagaaggaggccgccgccagcgagatcgaggccgtgagcgtggccatggagaaggagttcgagctgctggacaaggccaagggcaagacccagaagagaggcatcaccaacaccctggaggagagcagcagcctgaagagaaagagactgagcgacagcaagggcaagaacacctgcggcggcttcctgggcgagacctgcctgagcgagagcagcgacggcagcagcagcgaggacgccgagagcagcagcctgatgaacgtgcagagaagaaccgccgccaaggagcccaagaccagcgccagcgacagccagaacagcgtgaaggaggcccccgtgaagaacggcggcgccaccaccagcagcagcagcgacagcgacgacgacggcggcaaggagaagatggtgctggtgaccgccagaagcgtgttcggcaagaagagaagaaagctgagaagagccagaggcagaaagagaaagacctag

SEQ ID NO: 10630 - DNA, 699 bp, Artificial Sequence
  Description of Artificial Sequence: Synthetic coding sequence
atgggcgtgcagggcctgtggaagctgctggagtgcagcggcagacaggtgagccccgaggccctggagggcaagatcctggccgtggacatcagcatctggctgaaccaggccctgaagggcgtgagagacagacacggcaacagcatcgagaacccccacctgctgaccctgttccacagactgtgcaagctgctgttcttcagaatcagacccatcttcgtgttcgacggcgacgcccccctgctgaagaagcagaccctggtgaagagaagacagagaaaggacctggccagcagcgacagcagaaagaccaccgagaagctgctgaagaccttcctgaagagacaggccatcaagaccgccttcagaagcaagagagacgaggccctgcccagcctgacccaggtgagaagagagaacgacctgtacgtgctgccccccctgcaggaggaggagaagcacagcagcgaggaggaggacgagaaggagtggcaggagagaatgaaccagaagcaggccctgcaggaggagttcttccacaacccccaggccatcgacatcgagagcgaggacttcagcagcctgccccccgaggtgaagcacgagatcctgaccgacatgaaggagttcaccaagagaagaagaaccctgttcgaggccatgcccgaggtgtacctgcccctgctgcagccctag

SEQ ID NO: 10631 - DNA, 4482 bp, Artificial Sequence
  Description of Artificial Sequence: Synthetic coding sequence
atgcccaacgagggcatcccccacagcagccagacccaggagcaggactgcctgcagagccagcccgtgagcaacaacgaggagatggccatcaagcaggagagcggcggcgacggcgaggtggaggagtacctgagcttcagaagcgtgggcgacggcctgagcaccagcgccgtgggctgcgccagcgccgcccccagaagaggccccgccctgctgcacatcgacagacaccagatccaggccgtggagcccagcgcccaggccctggagctgcagggcctgggcgtggacgtgtacgaccaggacgtgctggagcagggcgtgctgcagcaggtggacaacgccatccacgaggccagcagagccagccagctggtggacgtggagaaggagtacagaagcgtgctggacgacctgaccagctgcaccaccagcctgagacagatcaacaagatcatcgagcagctgagcccccaggccgccaccagcagagacatcaacagaaagctggacagcgtgaagagacagaagtacaacaaggagcagcagctgaagaagatcaccgccaagcagaagcacctgcaggccatcctgggcggcgccgaggtgaagatcgagctggaccacgccagcctggaggaggacgccgagcccggccccagcagcctgggcagcatgctgatgcccgtgcaggagaccgcctgggaggagctgatcagaaccggccagatgacccccttcggcacccagatcccccagaagcaggagaagaagcccagaaagatcatgctgaacgaggccagcggcttcgagaagtacctggccgaccaggccaagctgagcttcgagagaaagaagcagggctgcaacaagagagccgccagaaaggcccccgcccccgtgaccccccccgcccccgtgcagaacaagaacaagcccaacaagaaggccagagtgctgagcaagaaggaggagagactgaagaagcacatcaagaagctgcagaagagagccctgcagttccagggcaaggtgggcctgcccaaggccagaagaccctgggagagcgacatgagacccgaggccgagggcgacagcgagggcgaggagagcgagtacttccccaccgaggaggaggaggaggaggaggacgacgaggtggagggcgccgaggccgacctgagcggcgacggcaccgactacgagctgaagcccctgcccaagggcggcaagagacagaagaaggtgcccgtgcaggagatcgacgacgacttcttccccagcagcggcgaggaggccgaggccgccagcgtgggcgagggcggcggcggcggcagaaaggtgggcagatacagagacgacggcgacgaggactactacaagcagagactgagaagatggaacaagctgagactgcaggacaaggagaagagactgaagctggaggacgacagcgaggagagcgacgccgagttcgacgagggcttcaaggtgcccggcttcctgttcaagaagctgttcaagtaccagcagaccggcgtgagatggctgtgggagctgcactgccagcaggccggcggcatcctgggcgacgagatgggcctgggcaagaccatccagatcatcgccttcctggccggcctgagctacagcaagatcagaaccagaggcagcaactacagattcgagggcctgggccccaccgtgatcgtgtgccccaccaccgtgatgcaccagtgggtgaaggagttccacacctggtggccccccttcagagtggccatcctgcacgagaccggcagctacacccacaagaaggagaagctgatcagagacgtggcccactgccacggcatcctgatcaccagctacagctacatcagactgatgcaggacgacatcagcagatacgactggcactacgtgatcctggacgagggccacaagatcagaaaccccaacgccgccgtgaccctggcctgcaagcagttcagaaccccccacagaatcatcctgagcggcagccccatgcagaacaacctgagagagctgtggagcctgttcgacttcatcttccccggcaagctgggcaccctgcccgtgttcatggagcagttcagcgtgcccatcaccatgggcggctacagcaacgccagccccgtgcaggtgaagaccgcctacaagtgcgcctgcgtgctgagagacaccatcaacccctacctgctgagaagaatgaagagcgacgtgaagatgagcctgagcctgcccgacaagaacgagcaggtgctgttctgcagactgaccgacgagcagcacaaggtgtaccagaacttcgtggacagcaaggaggtgtacagaatcctgaacggcgagatgcagatcttcagcggcctgatcgccctgagaaagatctgcaaccaccccgacctgttcagcggcggccccaagaacctgaagggcctgcccgacgacgagctggaggaggaccagttcggctactggaagagaagcggcaagatgatcgtggtggagagcctgctgaagatctggcacaagcagggccagagagtgctgctgttcagccagagcagacagatgctggacatcctggaggtgttcctgagagcccagaagtacacctacctgaagatggacggcaccaccaccatcgccagcagacagcccctgatcaccagatacaacgaggacaccagcatcttcgtgttcctgctgaccaccagagtgggcggcctgggcgtgaacctgaccggcgccaacagagtggtgatctacgaccccgactggaaccccagcaccgacacccaggccagagagagagcctggagaatcggccagaagaagcaggtgaccgtgtacagactgctgaccgccggcaccatcgaggagaagatctaccacagacagatcttcaagcagttcctgaccaacagagtgctgaaggaccccaagcagagaagattcttcaagagcaacgacctgtacgagctgttcaccctgaccagccccgacgccagccagagcaccgagaccagcgccatcttcgccggcaccggcagcgacgtgcagacccccaagtgccacctgaagagaagaatccagcccgccttcggcgccgaccacgacgtgcccaagagaaagaagttccccgccagcaacatcagcgtgaacgacgccaccagcagcgaggagaagagcgaggccaagggcgccgaggtgaacgccgtgaccagcaacagaagcgaccccctgaaggacgacccccacatgagcagcaacgtgaccagcaacgacagactgggcgaggagaccaacgccgtgagcggccccgaggagctgagcgtgatcagcggcaacggcgagtgcagcaacagcagcggcaccggcaagaccagcatgcccagcggcgacgagagcatcgacgagaagctgggcctgagctacaagagagagagacccagccaggcccagaccgaggccttctgggagaacaagcagatggagaacaacttctacaagcacaagagcaagaccaagcaccacagcgtggccgaggaggagaccctggagaagcacctgagacccaagcagaagcccaagaacagcaagcactgcagagacgccaagttcgagggcaccagaatcccccacctggtgaagaagagaagataccagaagcaggacagcgagaacaagagcgaggccaaggagcagagcaacgacgactacgtgctggagaagctgttcaagaagagcgtgggcgtgcacagcgtgatgaagcacgacgccatcatggacggcgccagccccgactacgtgctggtggaggccgaggccaacagagtggcccaggacgccctgaaggccctgagactgagcagacagagatgcctgggcgccgtgagcggcgtgcccacctggaccggccacagaggcatcagcggcgcccccgccggcaagaagagcagattcggcaagaagagaaacagcaacttcagcgtgcagcaccccagcagcaccagccccaccgagaagtgccaggacggcatcatgaagaaggagggcaaggacaacgtgcccgagcacttcagcggcagagccgaggacgccgacagcagcagcggccccctggccagcagcagcctgctggccaagatgagagccagaaaccacctgatcctgcccgagagactggagagcgagagcggccacctgcaggaggccagcgccctgctgcccaccaccgagcacgacgacctgctggtggagatgagaaacttcatcgccttccaggcccacaccgacggccaggccagcaccagagagatcctgcaggagttcgagagcaagctgagcgccagccagagctgcgtgttcagagagctgctgagaaacctgtgcaccttccacagaaccagcggcggcgagggcatctggaagctgaagcccgagtactgctag

SEQ ID NO: 10632 - DNA, 2613 bp, Artificial Sequence
  Description of Artificial Sequence: Synthetic coding sequence
cagcagcccttccacagacacctgctgatgaccaccgccctgcacagcgagaagctgatcagagacgtggcccactgccacggcatcctgatcaccagctacagctacatcagactgatgcaggacgacatcagcagatacgactggcactacgtgatcctggacgagggccacaagatcagaaaccccaacgccgccgtgaccctggcctgcaagcagttcagaaccccccacagaatcatcctgagcggcagccccatgcagaacaacctgagagagctgtggagcctgttcgacttcatcttccccggcaagctgggcaccctgcccgtgttcatggagcagttcagcgtgcccatcaccatgggcggctacagcaacgccagccccgtgcaggtgaagaccgcctacaagtgcgcctgcgtgctgagagacaccatcaacccctacctgctgagaagaatgaagagcgacgtgaagatgagcctgagcctgcccgacaagaacgagcagatcttcagcggcctgatcgccctgagaaagatctgcaaccaccccgacctgttcagcggcggccccaagaacctgaagggcctgcccgacgacgagctggaggaggaccagttcggctactggaagagaagcggcaagatgatcgtggtggagagcctgctgaagatctggcacaagcagggccagagagtgctgctgttcagccagagcagacagatgctggacatcctggaggtgttcctgagagcccagaagtacacctacctgaagatggacggcaccaccaccatcgccagcagacagcccctgatcaccagatacaacgaggacaccagcatcttcgtgttcctgctgaccaccagagtgggcggcctgggcgtgaacctgaccggcgccaacagagtggtgatctacgaccccgactggaaccccagcaccgacacccaggccagagagagagcctggagaatcggccagaagaagcaggtgaccgtgtacagactgctgaccgccggcaccatcgaggagaagatctaccacagacagatcttcaagcagttcctgaccaacagagtgctgaaggaccccaagcagagaagattcttcaagagcaacgacctgtacgagctgttcaccctgaccagccccgacgccagccagagcaccgagaccagcgccatcttcgccggcaccggcagcgacgtgcagacccccaagtgccacctgaagagaagaatccagcccgccttcggcgccgaccacgacgtgcccaagagaaagaagttccccgccagcaacatcagcgtgaacgacgccaccagcagcgaggagaagagcgaggccaagggcgccgaggtgaacgccgtgaccagcaacagaagcgaccccctgaaggacgacccccacatgagcagcaacgtgaccagcaacgacagactgggcgaggagaccaacgccgtgagcggccccgaggagctgagcgtgatcagcggcaacggcgagtgcagcaacagcagcggcaccggcaagaccagcatgcccagcggcgacgagagcatcgacgagaagctgggcctgagctacaagagagagagacccagccaggcccagaccgaggccttctgggagaacaagcagatggagaacaacttctacaagcacaagagcaagaccaagcaccacagcgtggccgaggaggagaccctggagaagcacctgagacccaagcagaagcccaagaacagcaagcactgcagagacgccaagttcgagggcaccagaatcccccacctggtgaagaagagaagataccagaagcaggacagcgagaacaagagcgaggccaaggagcagagcaacgacgactacgtgctggagaagctgttcaagaagagcgtgggcgtgcacagcgtgatgaagcacgacgccatcatggacggcgccagccccgactacgtgctggtggaggccgaggccaacagagtggcccaggacgccctgaaggccctgagactgagcagacagagatgcctgggcgccgtgagcggcgtgcccacctggaccggccacagaggcatcagcggcgcccccgccggcaagaagagcagattcggcaagaagagaaacagcaacttcagcgtgcagcaccccagcagcaccagccccaccgagaagtgccaggacggcatcatgaagaaggagggcaaggacaacgtgcccgagcacttcagcggcagagccgaggacgccgacagcagcagcggccccctggccagcagcagcctgctggccaagatgagagccagaaaccacctgatcctgcccgagagactggagagcgagagcggccacctgcaggaggccagcgccctgctgcccaccaccgagcacgacgacctgctggtggagatgagaaacttcatcgccttccaggcccacaccgacggccaggccagcaccagagagatcctgcaggagttcgagagcaagctgagcgccagccagagctgcgtgttcagagagctgctgagaaacctgtgcaccttccacagaaccagcggcggcgagggcatctggaagctgaagcccgagtactgctag

SEQ ID NO: 10633 - DNA, 540 bp, Artificial Sequence
  Description of Artificial Sequence: Synthetic coding sequence
atgcccaacgagggcatcccccacagcagccagacccaggagcaggactgcctgcagagccagcccgtgagcaacaacgaggagatggccatcaagcaggagagcggcggcgacggcgaggtggaggagtacctgagcttcagaagcgtgggcgacggcctgagcaccagcgccgtgggctgcgccagcgccgcccccagaagaggccccgccctgctgcacatcgacagacaccagatccaggccgtggagcccagcgcccaggccctggagctgcagggcctgggcgtggacgtgtacgaccaggacgtgctggagcagggcgtgctgcagcaggtggacaacgccatccacgaggccagcagagccagccagctggtggacgtggagaaggagtacagaagcgtgctggacgacctgaccagctgcaccaccagcctgagacagatcaacaagatcatcgagcagctgagcccccaggccgccaccagcagagacatcaacagaaagctggacagcgtgaagagacagaagtactag

SEQ ID NO: 10634 - DNA, 318 bp, Artificial Sequence
  Description of Artificial Sequence: Synthetic coding sequence
atgagcctgagcctgcccgacaagaacgagcaggtgctgttctgcagactgaccgacgagcagcacaaggtgtaccagaacttcgtggacagcaaggaggtgtacagaatcctgaacggcgagatgcaggaggtgctgcagagcttcaccagcatccacctgcacgagagccccctgaacttcttcagaagcttccaggtgagaggcagcagaagccactaccccggcaagggcatgcagaccaccctgggcatcgtgaacttcctggtggtgaccctgaagagaaagaagagaaacagattcagccccgacctgtag

SEQ ID NO: 10635 - DNA, 2592 bp, Artificial Sequence
  Description of Artificial Sequence: Synthetic coding sequence
atgcaggacgacatcagcagatacgactggcactacgtgatcctggacgagggccacaagatcagaaaccccaacgccgccgtgaccctggcctgcaagcagttcagaaccccccacagaatcatcctgagcggcagccccatgcagaacaacctgagagagctgtggagcctgttcgacttcatcttccccggcaagctgggcaccctgcccgtgttcatggagcagttcagcgtgcccatcaccatgggcggctacagcaacgccagccccgtgcaggtgaagaccgcctacaagtgcgcctgcgtgctgagagacaccatcaacccctacctgctgagaagaatgaagagcgacgtgaagatgagcctgagcctgcccgacaagaacgagcaggtgctgttctgcagactgaccgacgagcagcacaaggtgtaccagaacttcgtggacagcaaggaggtgtacagaatcctgaacggcgagatgcagatcttcagcggcctgatcgccctgagaaagatctgcaaccaccccgacctgttcagcggcggccccaagaacctgaagggcctgcccgacgacgagctggaggaggaccagttcggctactggaagagaagcggcaagatgatcgtggtggagagcctgctgaagatctggcacaagcagggccagagagtgctgctgttcagccagagcagacagatgctggacatcctggaggtgttcctgagagcccagaagtacacctacctgaagatggacggcaccaccaccatcgccagcagacagcccctgatcaccagatacaacgaggacaccagcatcttcgtgttcctgctgaccaccagagtgggcggcctgggcgtgaacctgaccggcgccaacagagtggtgatctacgaccccgactggaaccccagcaccgacacccaggccagagagagagcctggagaatcggccagaagaagcaggtgaccgtgtacagactgctgaccgccggcaccatcgaggagaagatctaccacagacagatcttcaagcagttcctgaccaacagagtgctgaaggaccccaagcagagaagattcttcaagagcaacgacctgtacgagctgttcaccctgaccagccccgacgccagccagagcaccgagaccagcgccatcttcgccggcaccggcagcgacgtgcagacccccaagtgccacctgaagagaagaatccagcccgccttcggcgccgaccacgacgtgcccaagagaaagaagttccccgccagcaacatcagcgtgaacgacgccaccagcagcgaggagaagagcgaggccaagggcgccgaggtgaacgccgtgaccagcaacagaagcgaccccctgaaggacgacccccacatgagcagcaacgtgaccagcaacgacagactgggcgaggagaccaacgccgtgagcggccccgaggagctgagcgtgatcagcggcaacggcgagtgcagcaacagcagcggcaccggcaagaccagcatgcccagcggcgacgagagcatcgacgagaagctgggcctgagctacaagagagagagacccagccaggcccagaccgaggccttctgggagaacaagcagatggagaacaacttctacaagcacaagagcaagaccaagcaccacagcgtggccgaggaggagaccctggagaagcacctgagacccaagcagaagcccaagaacagcaagcactgcagagacgccaagttcgagggcaccagaatcccccacctggtgaagaagagaagataccagaagcaggacagcgagaacaagagcgaggccaaggagcagagcaacgacgactacgtgctggagaagctgttcaagaagagcgtgggcgtgcacagcgtgatgaagcacgacgccatcatggacggcgccagccccgactacgtgctggtggaggccgaggccaacagagtggcccaggacgccctgaaggccctgagactgagcagacagagatgcctgggcgccgtgagcggcgtgcccacctggaccggccacagaggcatcagcggcgcccccgccggcaagaagagcagattcggcaagaagagaaacagcaacttcagcgtgcagcaccccagcagcaccagccccaccgagaagtgccaggacggcatcatgaagaaggagggcaaggacaacgtgcccgagcacttcagcggcagagccgaggacgccgacagcagcagcggccccctggccagcagcagcctgctggccaagatgagagccagaaaccacctgatcctgcccgagagactggagagcgagagcggccacctgcaggaggccagcgccctgctgcccaccaccgagcacgacgacctgctggtggagatgagaaacttcatcgccttccaggcccacaccgacggccaggccagcaccagagagatcctgcaggagttcgagagcaagctgagcgccagccagagctgcgtgttcagagagctgctgagaaacctgtgcaccttccacagaaccagcggcggcgagggcatctggaagctgaagcccgagtactgctag

SEQ ID NO: 10636 - DNA, 1191 bp, Artificial Sequence
  Description of Artificial Sequence: Synthetic coding sequence
atgctgggcttcctgagcgccagacagaccggcctggaggaccccctgagactgagaagagccgagagcaccagaagagtgctgggcctggagctgaacaaggacagagacgtggagagaatccacggcggcggcatcaacaccctggacatcgagcccgtggagggcagatacatgctgagcggcggcagcgacggcgtgatcgtgctgtacgacctggagaacagcagcagacagagctactacacctgcaaggccgtgtgcagcatcggcagagaccaccccgacgtgcacagatacagcgtggagaccgtgcagtggtacccccacgacaccggcatgttcaccagcagcagcttcgacaagaccctgaaggtgtgggacaccaacaccctgcagaccgccgacgtgttcaacttcgaggagaccgtgtacagccaccacatgagccccgtgagcaccaagcactgcctggtggccgtgggcaccagaggccccaaggtgcagctgtgcgacctgaagagcggcagctgcagccacatcctgcagggccacagacaggagatcctggccgtgagctggagccccagatacgactacatcctggccaccgccagcgccgacagcagagtgaagctgtgggacgtgagaagagccagcggctgcctgatcaccctggaccagcacaacggcaagaagagccaggccgtggagagcgccaacaccgcccacaacggcaaggtgaacggcctgtgcttcaccagcgacggcctgcacctgctgaccgtgggcaccgacaacagaatgagactgtggaacagcagcaacggcgagaacaccctggtgaactacggcaaggtgtgcaacaacagcaagaagggcctgaagttcaccgtgagctgcggctgcagcagcgagttcgtgttcgtgccctacggcagcaccatcgccgtgtacaccgtgtacagcggcgagcagatcaccatgctgaagggccactacaagaccgtggactgctgcgtgttccagagcaacttccaggagctgtacagcggcagcagagactgcaacatcctggcctgggtgcccagcctgtacgagcccgtgcccgacgacgacgagaccaccaccaagagccagctgaaccccgccttcgaggacgcctggagcagcagcgacgaggagggctag

SEQ ID NO: 10637 - DNA, 1017 bp, Artificial Sequence
  Description of Artificial Sequence: Synthetic coding sequence
atgctgagcggcggcagcgacggcgtgatcgtgctgtacgacctggagaacagcagcagacagagctactacacctgcaaggccgtgtgcagcatcggcagagaccaccccgacgtgcacagatacagcgtggagaccgtgcagtggtacccccacgacaccggcatgttcaccagcagcagcttcgacaagaccctgaaggtgtgggacaccaacaccctgcagaccgccgacgtgttcaacttcgaggagaccgtgtacagccaccacatgagccccgtgagcaccaagcactgcctggtggccgtgggcaccagaggccccaaggtgcagctgtgcgacctgaagagcggcagctgcagccacatcctgcagggccacagacaggagatcctggccgtgagctggagccccagatacgactacatcctggccaccgccagcgccgacagcagagtgaagctgtgggacgtgagaagagccagcggctgcctgatcaccctggaccagcacaacggcaagaagagccaggccgtggagagcgccaacaccgcccacaacggcaaggtgaacggcctgtgcttcaccagcgacggcctgcacctgctgaccgtgggcaccgacaacagaatgagactgtggaacagcagcaacggcgagaacaccctggtgaactacggcaaggtgtgcaacaacagcaagaagggcctgaagttcaccgtgagctgcggctgcagcagcgagttcgtgttcgtgccctacggcagcaccatcgccgtgtacaccgtgtacagcggcgagcagatcaccatgctgaagggccactacaagaccgtggactgctgcgtgttccagagcaacttccaggagctgtacagcggcagcagagactgcaacatcctggcctgggtgcccagcctgtacgagcccgtgcccgacgacgacgagaccaccaccaagagccagctgaaccccgccttcgaggacgcctggagcagcagcgacgaggagggctag

SEQ ID NO: 10638 - DNA, 1188 bp, Artificial Sequence
  Description of Artificial Sequence: Synthetic coding sequence
atggccaccagcagcgcccccgccggcgtgagaaccagatacgccggcgtgttcgtgagaacccccaacggcttcggcggccccagcagccccagcgagagcagagtgaacaccgagagcttcggcaccggcatcaacaccctggacatcgagcccgtggagggcagatacatgctgagcggcggcagcgacggcgtgatcgtgctgtacgacctggagaacagcagcagacagagctactacacctgcaaggccgtgtgcagcatcggcagagaccaccccgacgtgcacagatacagcgtggagaccgtgcagtggtacccccacgacaccggcatgttcaccagcagcagcttcgacaagaccctgaaggtgtgggacaccaacaccctgcagaccgccgacgtgttcaacttcgaggagaccgtgtacagccaccacatgagccccgtgagcaccaagcactgcctggtggccgtgggcaccagaggccccaaggtgcagctgtgcgacctgaagagcggcagctgcagccacatcctgcagggccacagacaggagatcctggccgtgagctggagccccagatacgactacatcctggccaccgccagcgccgacagcagagtgaagctgtgggacgtgagaagagccagcggctgcctgatcaccctggaccagcacaacggcaagaagagccaggccgtggagagcgccaacaccgcccacaacggcaaggtgaacggcctgtgcttcaccagcgacggcctgcacctgctgaccgtgggcaccgacaacagaatgagactgtggaacagcagcaacggcgagaacaccctggtgaactacggcaaggtgtgcaacaacagcaagaagggcctgaagttcaccgtgagctgcggctgcagcagcgagttcgtgttcgtgccctacggcagcaccatcgccgtgtacaccgtgtacagcggcgagcagatcaccatgctgaagggccactacaagaccgtggactgctgcgtgttccagagcaacttccaggagctgtacagcggcagcagagactgcaacatcctggcctgggtgcccagcctgtacgagcccgtgcccgacgacgacgagaccaccaccaagagccagctgaaccccgccttcgaggacgcctggagcagcagcgacgaggagggctag

SEQ ID NO: 10639 - DNA, 732 bp, Artificial Sequence
  Description of Artificial Sequence: Synthetic coding sequence
atgggctacaagtacatcaccatcggcaccagaggccccaaggtgcagctgtgcgacctgaagagcggcagctgcagccacatcctgcagggccacagacaggagatcctggccgtgagctggagccccagatacgactacatcctggccaccgccagcgccgacagcagagtgaagctgtgggacgtgagaagagccagcggctgcctgatcaccctggaccagcacaacggcaagaagagccaggccgtggagagcgccaacaccgcccacaacggcaaggtgaacggcctgtgcttcaccagcgacggcctgcacctgctgaccgtgggcaccgacaacagaatgagactgtggaacagcagcaacggcgagaacaccctggtgaactacggcaaggtgtgcaacaacagcaagaagggcctgaagttcaccgtgagctgcggctgcagcagcgagttcgtgttcgtgccctacggcagcaccatcgccgtgtacaccgtgtacagcggcgagcagatcaccatgctgaagggccactacaagaccgtggactgctgcgtgttccagagcaacttccaggagctgtacagcggcagcagagactgcaacatcctggcctgggtgcccagcctgtacgagcccgtgcccgacgacgacgagaccaccaccaagagccagctgaaccccgccttcgaggacgcctggagcagcagcgacgaggagggctag

SEQ ID NO: 10640 - DNA, 2541 bp, Artificial Sequence
  Description of Artificial Sequence: Synthetic coding sequence
atgggcatccagggcctgctgcagttcatcaaggaggccagcgagcccatccacgtgagaaagtacaagggccaggtggtggccgtggacacctactgctggctgcacaagggcgccatcgcctgcgccgagaagctggccaagggcgagcccaccgacagatacgtgggcttctgcatgaagttcgtgaacatgctgctgagccacggcatcaagcccatcctggtgttcgacggctgcaccctgcccagcaagaaggaggtggagagaagcagaagagagagaagacaggccaacctgctgaagggcaagcagctgctgagagagggcaaggtgagcgaggccagagagtgcttcaccagaagcatcaacatcacccacgccatggcccacaaggtgatcaaggccgccagaagccagggcgtggactgcctggtggccccctacgaggccgacgcccagctggcctacctgaacaaggccggcatcgtgcaggccatcatcaccgaggacagcgacctgctggccttcggctgcaagaaggtgatcctgaagatggaccagttcggcaacggcctggagatcgaccaggccagactgggcatgtgcagacagctgggcgacgtgttcaccgaggagaagttcagatacatgtgcatcctgagcggctgcgactacctgagcagcctgagaggcatcggcctggccaaggcctgcaaggtgctgagactggccaacaaccccgacatcgtgaaggtgatcaagaagatcggccactacctgaagatgaacatcaccgtgcccgaggactacatcaacggcttcatcagagccaacaacaccttcctgtaccagctggtgttcgaccccatcaagagaaagctgatccccctgaacgcctacgaggacgacgtggaccccgagaccctgagctacgccggccagtacgtggacgacagcatcgccctgcagatcgccctgggcaacaaggacatcaacaccttcgagcagatcgacgactacaaccccgacaccgccatgcccgcccacagcagaagccacagctgggacgacaagacctgccagaagagcgccaacgtgagcagcatctggcacagaaactacagccccagacccgagagcggcaccgtgagcgacgccccccagctgaaggagaaccccagcaccgtgggcgtggagagagtgatcagcaccaagggcctgaacctgcccagaaagagcagcatcgtgaagagacccagaagcgccgagctgagcgaggacgacctgctgagccagtacagcctgagcttcaccaagaagaccaagaagaacagcagcgagggcaacaagagcctgagcttcagcgaggtgttcgtgcccgacctggtgaacggccccaccaacaagaagagcgtgagcaccccccccagaaccagaaacaagttcgccaccttcctgcagagaaagaacgaggagagcggcgccgtggtggtgcccggcaccagaagcagattcttctgcagcagcgacagcaccgactgcgtgagcaacaaggtgagcatccagcccctggacgagaccgccgtgaccgacaaggagaacaacctgcacgagagcgagtacggcgaccaggagggcaagagactggtggacaccgacgtggccagaaacagcagcgacgacatccccaacaaccacatccccggcgaccacatccccgacaaggccaccgtgttcaccgacgaggagagctacagcttcgagagcagcaagttcaccagaaccatcagcccccccaccctgggcaccctgagaagctgcttcagctggagcggcggcctgggcgacttcagcagaacccccagccccagccccagcaccgccctgcagcagttcagaagaaagagcgacagccccaccagcctgcccgagaacaacatgagcgacgtgagccagctgaagagcgaggagagcagcgacgacgagagccaccccctgagagaggaggcctgcagcagccagagccaggagagcggcgagttcagcctgcagagcagcaacgccagcaagctgagccagtgcagcagcaaggacagcgacagcgaggagagcgactgcaacatcaagctgctggacagccagagcgaccagaccagcaagctgagactgagccacttcagcaagaaggacacccccctgagaaacaaggtgcccggcctgtacaagagcagcagcgccgacagcctgagcaccaccaagatcaagcccctgggccccgccagagccagcggcctgagcaagaagcccgccagcatccagaagagaaagcaccacaacgccgagaacaagcccggcctgcagatcaagctgaacgagctgtggaagaacttcggcttcaagaaggacagcgagaagctgcccccctgcaagaagcccctgagccccgtgagagacaacatccagctgacccccgaggccgaggaggacatcttcaacaagcccgagtgcggcagagtgcagagagccatcttccagtag

SEQ ID NO: 10641 - DNA, 510 bp, Artificial Sequence
  Description of Artificial Sequence: Synthetic coding sequence
atgggcatccagggcctgctgcagttcatcaaggaggccagcgagcccatccacgtgagaaagtacaagggccaggtggtggccgtggacacctactgctggctgcacaagggcgccatcgcctgcgccgagaagctggccaagggcgagcccaccgacagaagaagacaggccaacctgctgaagggcaagcagctgctgagagagggcaaggtgagcgaggccagagagtgcttcaccagaagcatcaacatcacccacgccatggcccacaaggtgatcaaggccgccagaagccagggcgtggactgcctggtggccccctacgaggccgacgcccagctggcctacctgaacaaggccggcatcgtgcaggccatcatcaccgaggacagcgacctgctggccttcggctgcaagaaggtgatcctgaagatggaccagttcggcaacggcctggagatcgaccaggccagactgggcatgtgcagacagctgggcgacgtgtag

SEQ ID NO: 10642 - DNA, 2541 bp, Artificial Sequence; identical to SEQ ID NO: 10640
  Description of Artificial Sequence: Synthetic coding sequence

SEQ ID NO: 10643 - DNA, 408 bp, Artificial Sequence
  Description of Artificial Sequence: Synthetic coding sequence
atgggcatccagggcctgctgcagttcatcaaggaggccagcgagcccatccacgtgagaaagtacaagggccaggtggtggccgtggacacctactgctggctgcacaagggcgccatcgcctgcgccgagaagctggccaagggcgagcccaccgacagatacgtgggcttctgcatgaagttcgtgaacatgctgctgagccacggcatcaagcccatcctggtgttcgacggctgcaccctgcccagcaagaaggaggtggagagaagcagaagagagagaagacaggccaacctgctgaagggcaagcagctgctgagagagggcaaggtgagcgaggccagagagtgcttcaccagaagcatcaacatcacccacgccatggcccacaaggtgatcaagtag

SEQ ID NO: 10644 - DNA, 2412 bp, Artificial Sequence
  Description of Artificial Sequence: Synthetic coding sequence
atgggcatccagggcctgctgcagttcatcaaggaggccagcgagcccatccacgtgagaaagtacaagggccaggtggtggccgtggacacctactgctggctgcacaagggcgccatcgcctgcgccgagaagctggccaagggcgagcccaccgacagatacgtgggcttctgcatgaagttcgtgaacatgctgctgagccacggcatcaagcccatcctggtgttcgacggctgcaccctgcccagcaagaaggaggtggagagaagcagaagagagagaagacaggccaacctgctgaagggcaagcagctgctgagagagggcaaggtgagcgaggccagagagtgcttcaccagaagcatcaacatcacccacgccatggcccacaaggtgatcaaggccgccagaagccagggcgtggactgcctggtggccccctacgaggccgacgcccagctggcctacctgaacaaggccggcatcgtgcaggccatcatcaccgaggacagcgacctgctggccttcggctgcaagaaggtgatcctgaagatggaccagttcggcaacggcctggagatcgaccaggccagactgggcatgtgcagacagctgggcgacgtgttcaccgaggagaagttcagatacatgtgcatcctgagcggctgcgactacctgagcagcctgagaggcatcggcctggccaaggcctgcaaggtgctgagactggccaacaaccccgacatcgtgaaggtgatcaagaagatcggccactacctgaagatgaacatcaccgtgcccgaggactacatcaacggcttcatcagagccaacaacaccttcctgtaccagctggtgttcgaccccatcaagagaaagctgatccccctgaacgcctacgaggacgacgtggaccccgagaccctgagctacgccggccagtacgtggacgacagcatcgccctgcagatcgccctgggcaacaaggacatcaacaccttcgagcagatcgacgactacaaccccgacaccgccatgcccgcccacagcagaagccacagctgggacgacaagacctgccagaagagcgccaacgtgagcagcatctggcacagaaactacagccccagacccgagagcggcaccgtgagcgacgccccccagctgaaggagaaccccagcaccgtgggcgtggagagagtgatcagcaccaagggcctgaacctgcccagaaagagcagcatcgtgaagagacccagaagcgccgagctgagcgaggacgacctgctgagccagtacagcctgagcttcaccaagaagaccaagaagaacagcagcgagggcaacaagagcctgagcttcagcgaggtgttcgtgcccgacctggtgaacggccccaccaacaagaagagcgtgagcaccccccccagaaccagaaacaagttcgccaccttcctgcagagaaagaacgaggagagcggcgccgtggtggtgcccggcaccagaagcagattcttctgcagcagcgacagcaccgactgcgtgagcaacaaggtgagcatccagcccctggacgagaccgccgtgaccgacaaggagaacaacctgcacgagagcgagtacggcgaccaggagggcaagagactggtggacaccgacgtggccagaaacagcagcgacgacatccccaacaaccacatccccggcgaccacatccccgacaaggccaccgtgttcaccgacgaggagagctacagcttcgagagcagcaagttcaccagaaccatcagcccccccaccctgggcaccctgagaagctgcttcagctggagcggcggcctgggcgacttcagcagaacccccagccccagccccagcaccgccctgcagcagttcagaagaaagagcgacagccccaccagcctgcccgagaacaacatgagcgacgtgagccagctgaagagcgaggagagcagcgacgacgagagccaccccctgagagaggaggcctgcagcagccagagccaggagagcggcgagttcagcctgcagagcagcaacgccagcaagctgagccagtgcagcagcaaggacagcgacagcgaggagagcgactgcaacatcaagctgctggacagccagagcgaccagaccagcaagctgagactgagccacttcagcaagaaggacacccccctgagaaacaaggtgcccggcctgtacaagagcagcagcgccgacagcctgagcaccaccaagatcaagcccctgggccccgccagagccagcggcctgagcaagaagcccgccagcatccagaagagaaagcaccacaacgccgagaacaagcccggcctgcagatcaagctgaacgagctgtggaagaacttcggcttcaagaagttctag

SEQ ID NO: 10645 - DNA, 36 bp, Artificial Sequence
  Description of Artificial Sequence: Synthetic coding sequence
atgggcatccagggcctgctgcagttcatcaagtag

SEQ ID NO: 10646 - DNA, 2241 bp, Artificial Sequence
  Description of Artificial Sequence: Synthetic coding sequence
atgcaggccaagaagagatacttcatcctgctgagcgccggcagctgcctggccctgctgttctacttcggcggcctgcagttcagagccagcagaagccacagcagaagagaggagcacagcggcagaaacggcctgcaccaccccagccccgaccacttctggcccagattccccgacgccctgagacccttcgtgccctgggaccagctggagaacgaggacagcagcgtgcacatcagccccagacagaagagagacgccaacagcagcatctacaagggcaagaagtgcagaatggagagctgcttcgacttcaccctgtgcaagaagaacggcttcaaggtgtacgtgtacccccagcagaagggcgagaagatcgccgagagctaccagaacatcctggccgccatcgagggcagcagattctacaccagcgaccccagccaggcctgcctgttcgtgctgagcctggacaccctggacagagaccagctgagcccccagtacgtgcacaacctgagaagcaaggtgcagagcctgcacctgtggaacaacggcagaaaccacctgatcttcaacctgtacagcggcacctggcccgactacaccgaggacgtgggcttcgacatcggccaggccatgctggccaaggccagcatcagcaccgagaacttcagacccaacttcgacgtgagcatccccctgttcagcaaggaccaccccagaaccggcggcgagagaggcttcctgaagttcaacaccatcccccccctgagaaagtacatgctggtgttcaagggcaagagatacctgaccggcatcggcagcgacaccagaaacgccctgtaccacgtgcacaacggcgaggacgtggtgctgctgaccacctgcaagcacggcaaggactggcagaagcacaaggacagcagatgcgacagagacaacaccgagtacgagaagtacgactacagagagatgctgcacaacgccaccttctgcctggtgcccagaggcagaagactgggcagcttcagattcctggaggccctgcaggccgcctgcgtgcccgtgatgctgagcaacggctgggagctgcccttcagcgaggtgatcaactggaaccaggccgccgtgatcggcgacgagagactgctgctgcagatccccagcaccatcagaagcatccaccaggacaagatcctggccctgagacagcagacccagttcctgtgggaggcctacttcagcagcgtggagaagatcgtgctgaccaccctggagatcatccaggacagaatcttcaagcacatcagcagaaacagcctgatctggaacaagcaccccggcggcctgttcgtgctgccccagtacagcagctacctgggcgacttcccctactactacgccaacctgggcctgaagccccccagcaagttcaccgccgtgatccacgccgtgacccccctggtgagccagagccagcccgtgctgaagctgctggtggccgccgccaagagccagtactgcgcccagatcatcgtgctgtggaactgcgacaagcccctgcccgccaagcacagatggcccgccaccgccgtgcccgtggtggtgatcgagggcgagagcaaggtgatgagcagcagattcctgccctacgacaacatcatcaccgacgccgtgctgagcctggacgaggacaccgtgctgagcaccaccgaggtggacttcgccttcaccgtgtggcagagcttccccgagagaatcgtgggctaccccgccagaagccacttctgggacaacagcaaggagagatggggctacaccagcaagtggaccaacgactacagcatggtgctgaccggcgccgccatctaccacaagtactaccactacctgtacagccactacctgcccgccagcctgaagaacatggtggaccagctggccaactgcgaggacatcctgatgaacttcctggtgagcgccgtgaccaagctgccccccatcaaggtgacccagaagaagcagtacaaggagaccatgatgggccagaccagcagagccagcagatgggccgaccccgaccacttcgcccagagacagagctgcatgaacaccttcgccagctggttcggctacatgcccctgatccacagccagatgagactggaccccgtgctgttcaaggaccaggtgagcatcctgagaaagaagtacagagacatcgagagactgtag

SEQ ID NO: 10647 - DNA, 2157 bp, Artificial Sequence
  Description of Artificial Sequence: Synthetic coding sequence
atgtgcgccagcgtgaagtacaacatcagaggccccgccctgatccccagaatgaagaccaagcacagaatctactacatcaccctgttcagcatcgtgctgctgggcctgatcgccaccggcatgttccagttctggccccacagcatcgagagcagcaacgactggaacgtggagaagagaagcatcagagacgtgcccgtggtgagactgcccgccgacagccccatccccgagagaggcgacctgagctgcagaatgcacacctgcttcgacgtgtacagatgcggcttcaaccccaagaacaagatcaaggtgtacatctacgccctgaagaagtacgtggacgacttcggcgtgagcgtgagcaacaccatcagcagagagtacaacgagctgctgatggccatcagcgacagcgactactacaccgacgacatcaacagagcctgcctgttcgtgcccagcatcgacgtgctgaaccagaacaccctgagaatcaaggagaccgcccaggccatggcccagctgagcagatgggacagaggcaccaaccacctgctgttcaacatgctgcccggcggcccccccgactacaacaccgccctggacgtgcccagagacagagccctgctggccggcggcggcttcagcacctggacctacagacagggctacgacgtgagcatccccgtgtacagccccctgagcgccgaggtggacctgcccgagaagggccccggccccagacagtacttcctgctgagcagccaggtgggcctgcaccccgagtacagagaggacctggaggccctgcaggtgaagcacggcgagagcgtgctggtgctggacaagtgcaccaacctgagcgagggcgtgctgagcgtgagaaagagatgccacaagcaccaggtgttcgactacccccaggtgctgcaggaggccaccttctgcgtggtgctgagaggcgccagactgggccaggccgtgctgagcgacgtgctgcaggccggctgcgtgcccgtggtgatcgccgacagctacatcctgcccttcagcgaggtgctggactggaagagagccagcgtggtggtgcccgaggagaagatgagcgacgtgtacagcatcctgcagagcatcccccagagacagatcgaggagatgcagagacaggccagatggttctgggaggcctacttccagagcatcaaggccatcgccctggccaccctgcagatcatcaacgacagaatctacccctacgccgccatcagctacgaggagtggaacgacccccccgccgtgaagtggggcagcgtgagcaaccccctgttcctgcccctgatccccccccagagccagggcttcaccgccatcgtgctgacctacgacagagtggagagcctgttcagagtgatcaccgaggtgagcaaggtgcccagcctgagcaagctgctggtggtgtggaacaaccagaacaagaacccccccgaggacagcctgtggcccaagatcagagtgcccctgaaggtggtgagaaccgccgagaacaagctgagcaacagattcttcccctacgacgagatcgagaccgaggccgtgctggccatcgacgacgacatcatcatgctgaccagcgacgagctgcagttcggctacgaggtgtggagagagttccccgacagactggtgggctaccccggcagactgcacctgtgggaccacgagatgaacaagtggaagtacgagagcgagtggaccaacgaggtgagcatggtgctgaccggcgccgccttctaccacaagtacttcaactacctgtacacctacaagatgcccggcgacatcaagaactgggtggacgcccacatgaactgcgaggacatcgccatgaacttcctggtggccaacgtgaccggcaaggccgtgatcaaggtgacccccagaaagaagttcaagtgccccgagtgcaccgccatcgacggcctgagcctggaccagacccacatggtggagagaagcgagtgcatcaacaagttcgccagcgtgttcggcaccatgcccctgaaggtggtggagcacagagccgaccccgtgctgtacaaggacgacttccccgagaagctgaagagcttccccaacatcggcagcctgtag

SEQ ID NO: 10648 - DNA, 2187 bp, Artificial Sequence
  Description of Artificial Sequence: Synthetic coding sequence
atgtgcgccagcgtgaagtacaacatcagaggccccgccctgatccccagaatgaagaccaagcacagaatctactacatcaccctgttcagcatcgtgctgctgggcctgatcgccaccggcatgttccagttctggccccacagcatcgagagcagcaacgactggaacgtggagaagagaagcatcagagacgtgcccgtggtgagactgcccgccgacagccccatccccgagagaggcgacctgagctgcagaatgcacacctgcttcgacgtgtacagatgcggcttcaaccccaagaacaagatcaaggtgtacatctacgccctgaagaagtacgtggacgacttcggcgtgagcgtgagcaacaccatcagcagagagtacaacgagctgctgatggccatcagcgacagcgactactacaccgacgacatcaacagagcctgcctgttcgtgcccagcatcgacgtgctgaaccagaacaccctgagaatcaaggagaccgcccaggccatggcccagctgagcagatgggacagaggcaccaaccacctgctgttcaacatgctgcccggcggcccccccgactacaacaccgccctggacgtgcccagagacagagccctgctggccggcggcggcttcagcacctggacctacagacagggctacgacgtgagcatccccgtgtacagccccctgagcgccgaggtggacctgcccgagaagggccccggccccagacagtacttcctgctgagcagccaggtgggcctgcaccccgagtacagagaggacctggaggccctgcaggtgaagcacggcgagagcgtgctggtgctggacaagtgcaccaacctgagcgagggcgtgctgagcgtgagaaagagatgccacaagcaccaggtgttcgactacccccaggtgctgcaggaggccaccttctgcgtggtgctgagaggcgccagactgggccaggccgtgctgagcgacgtgctgcaggccggctgcgtgcccgtggtgatcgccgacagctacatcctgcccttcagcgaggtgctggactggaagagagccagcgtggtggtgcccgaggagaagatgagcgacgtgtacagcatcctgcagagcatcccccagagacagatcgaggagatgcagagacagctgttcatggagcccgccagaagagagaactggagcgccgccaaccaccagatgaacagcctgatctggcccagagagcagtgggacagccagatcatcaacgacagaatctacccctacgccgccatcagctacgaggagtggaacgacccccccgccgtgaagtggggcagcgtgagcaaccccctgttcctgcccctgatccccccccagagccagggcttcaccgccatcgtgctgacctacgacagagtggagagcctgttcagagtgatcaccgaggtgagcaaggtgcccagcctgagcaagctgctggtggtgtggaacaaccagaacaagaacccccccgaggacagcctgtggcccaagatcagagtgcccctgaaggtggtgagaaccgccgagaacaagctgagcaacagattcttcccctacgacgagatcgagaccgaggccgtgctggccatcgacgacgacatcatcatgctgaccagcgacgagctgcagttcggctacgaggtgtggagagagttccccgacagactggtgggctaccccggcagactgcacctgtgggaccacgagatgaacaagtggaagtacgagagcgagtggaccaacgaggtgagcatggtgctgaccggcgccgccttctaccacaagtacttcaactacctgtacacctacaagatgcccggcgacatcaagaactgggtggacgcccacatgaactgcgaggacatcgccatgaacttcctggtggccaacgtgaccggcaaggccgtgatcaaggtgacccccagaaagaagttcaagtgccccgagtgcaccgccatcgacggcctgagcctggaccagacccacatggtggagagaagcgagtgcatcaacaagttcgccagcgtgttcggcaccatgcccctgaaggtggtggagcacagagccgaccccgtgctgtacaaggacgacttccccgagaagctgaagagcttccccaacatcggcagcctgtag

SEQ ID NO: 10649 - DNA, 2256 bp, Artificial Sequence
  Description of Artificial Sequence: Synthetic coding sequence
atgagctgcgccagcggcagcggcggcggcctgagacaccccctgagatgccagaagccctgggacgaggagtgcgaggaggaggccgtgtgcgtgatcatgtgcgccagcgtgaagtacaacatcagaggccccgccctgatccccagaatgaagaccaagcacagaatctactacatcaccctgttcagcatcgtgctgctgggcctgatcgccaccggcatgttccagttctggccccacagcatcgagagcagcaacgactggaacgtggagaagagaagcatcagagacgtgcccgtggtgagactgcccgccgacagccccatccccgagagaggcgacctgagctgcagaatgcacacctgcttcgacgtgtacagatgcggcttcaaccccaagaacaagatcaaggtgtacatctacgccctgaagaagtacgtggacgacttcggcgtgagcgtgagcaacaccatcagcagagagtacaacgagctgctgatggccatcagcgacagcgactactacaccgacgacatcaacagagcctgcctgttcgtgcccagcatcgacgtgctgaaccagaacaccctgagaatcaaggagaccgcccaggccatggcccagctgagcagatgggacagaggcaccaaccacctgctgttcaacatgctgcccggcggcccccccgactacaacaccgccctggacgtgcccagagacagagccctgctggccggcggcggcttcagcacctggacctacagacagggctacgacgtgagcatccccgtgtacagccccctgagcgccgaggtggacctgcccgagaagggccccggccccagacagtacttcctgctgagcagccaggtgggcctgcaccccgagtacagagaggacctggaggccctgcaggtgaagcacggcgagagcgtgctggtgctggacaagtgcaccaacctgagcgagggcgtgctgagcgtgagaaagagatgccacaagcaccaggtgttcgactacccccaggtgctgcaggaggccaccttctgcgtggtgctgagaggcgccagactgggccaggccgtgctgagcgacgtgctgcaggccggctgcgtgcccgtggtgatcgccgacagctacatcctgcccttcagcgaggtgctggactggaagagagccagcgtggtggtgcccgaggagaagatgagcgacgtgtacagcatcctgcagagcatcccccagagacagatcgaggagatgcagagacaggccagatggttctgggaggcctacttccagagcatcaaggccatcgccctggccaccctgcagatcatcaacgacagaatctacccctacgccgccatcagctacgaggagtggaacgacccccccgccgtgaagtggggcagcgtgagcaaccccctgttcctgcccctgatccccccccagagccagggcttcaccgccatcgtgctgacctacgacagagtggagagcctgttcagagtgatcaccgaggtgagcaaggtgcccagcctgagcaagctgctggtggtgtggaacaaccagaacaagaacccccccgaggacagcctgtggcccaagatcagagtgcccctgaaggtggtgagaaccgccgagaacaagctgagcaacagattcttcccctacgacgagatcgagaccgaggccgtgctggccatcgacgacgacatcatcatgctgaccagcgacgagctgcagttcggctacgaggtgtggagagagttccccgacagactggtgggctaccccggcagactgcacctgtgggaccacgagatgaacaagtggaagtacgagagcgagtggaccaacgaggtgagcatggtgctgaccggcgccgccttctaccacaagtacttcaactacctgtacacctacaagatgcccggcgacatcaagaactgggtggacgcccacatgaactgcgaggacatcgccatgaacttcctggtggccaacgtgaccggcaaggccgtgatcaaggtgacccccagaaagaagttcaagtgccccgagtgcaccgccatcgacggcctgagcctggaccagacccacatggtggagagaagcgagtgcatcaacaagttcgccagcgtgttcggcaccatgcccctgaaggtggtggagcacagagccgaccccgtgctgtacaaggacgacttccccgagaagctgaagagcttccccaacatcggcagcctgtag

SEQ ID NO: 10650 - DNA, 339 bp, Artificial Sequence
  Description of Artificial Sequence: Synthetic coding sequence
atgtgcgccagcgtgaagtacaacatcagaggccccgccctgatccccagaatgaagaccaagcacagaatctactacatcaccctgttcagcatcgtgctgctgggcctgatcgccaccggcatgttccagttctggccccacagcatcgagagcagcaacgactggaacgtggagaagagaagcatcagagacgtgcccgtggtgagactgcccgccgacagccccatccccgagagaggcgacctgagctgcagaatgcacacctgcttcgacgtgtacagatgcggcttcaaccccaagaacaagatcaaggtgtacatctacgccctgaagtag

SEQ ID NO: 10651 - DNA, 150 bp, Artificial Sequence
  Description of Artificial Sequence: Synthetic coding sequence
atgtgcgccagcgtgaagtacaacatcagaggccccgccctgatccccagaatgaagaccaagcacagaatctactacatcaccctgttcagcatcgtgctgctgggcctgatcgccaccggcatgttccagttctggccccacagctag

SEQ ID NO: 10652 - DNA, 2157 bp, Artificial Sequence; identical to SEQ ID NO: 10647
  Description of Artificial Sequence: Synthetic coding sequence

SEQ ID NO: 10653 - DNA, 1761 bp, Artificial Sequence
  Description of Artificial Sequence: Synthetic coding sequence
atgcccaagcccatcaacgtgagagtgaccaccatggacgccgagctggagttcgccatccagcccaacaccaccggcaagcagctgttcgaccaggtggtgaagaccatcggcctgagagaggtgtggtacttcggcctgcactacgtggacaacaagggcttccccacctggctgaagctggacaagaaggtgagcgcccaggaggtgagaaaggagaaccccctgcagttcaagttcagagccaagttctaccccgaggacgtggccgaggagctgatccaggacatcacccagaagctgttcttcctgcaggtgaaggagggcatcctgagcgacgagatctactgcccccccgagaccgccgtgctgctgggcagctacgccgtgcaggccaagttcggcgactacaacaaggaggtgcacaagagcggctacctgagcagcgagagactgatcccccagagagtgatggaccagcacaagctgaccagagaccagtgggaggacagaatccaggtgtggcacgccgagcacagaggcatgctgaaggacaacgccatgctggagtacctgaagatcgcccaggacctggagatgtacggcatcaactacttcgagatcaagaacaagaagggcaccgacctgtggctgggcgtggacgccctgggcctgaacatctacgagaaggacgacaagctgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctgcagctgtgcatgggcaaccacgagctgtacatgagaagaagaaagcccgacaccatcgaggtgcagcagatgaaggcccaggccagagaggagaagcaccagaagcagctggagagacagcagctggagaccgagaagaagagaagagagaccgtggagagagagaaggagcagatgatgagagagaaggaggagctgatgctgagactgcaggactacgaggagaagaccaagaaggccgagagagagctgagcgagcagatccagagagccctgcagctggaggaggagagaaagagagcccaggaggaggccgagagactggaggccgacagaatggccgccctgagagccaaggaggagctggagagacaggccgtggaccagatcaagagccaggagcagctggccgccgagctggccgagtacaccgccaagatcgccctgctggaggaggccagaagaagaaaggaggacgaggtggaggagtggcagcacagagccaaggaggcccaggacgacctggtgaagaccaaggaggagctgcacctggtgatgaccgcccccccccccccccccccccccgtgtacgagcccgtgagctaccacgtgcaggagagcctgcaggacgagggcgccgagcccaccggctacagcgccgagctgagcagcgagggcatcagagacgacagaaacgaggagaagagaatcaccgaggccgagaagaacgagagagtgcagagacagctgctgaccctgagcagcgagctgagccaggccagagacgagaacaagagaacccacaacgacatcatccacaacgagaacatgagacagggcagagacaagtacaagaccctgagacagatcagacagggcaacaccaagcagagaatcgacgagttcgaggccctgtag

SEQ ID NO: 10654 - DNA, 1761 bp, Artificial Sequence; identical to SEQ ID NO: 10653
  Description of Artificial Sequence: Synthetic coding sequence

SEQ ID NO: 10655 - DNA, 1665 bp, Artificial Sequence
  Description of Artificial Sequence: Synthetic coding sequence
atgcccaagcccatcaacgtgagagtgaccaccatggacgccgagctggagttcgccatccagcccaacaccaccggcaagcagctgttcgaccaggtgagcgcccaggaggtgagaaaggagaaccccctgcagttcaagttcagagccaagttctaccccgaggacgtggccgaggagctgatccaggacatcacccagaagctgttcttcctgcaggtgaaggagggcatcctgagcgacgagatctactgcccccccgagaccgccgtgctgctgggcagctacgccgtgcaggccaagttcggcgactacaacaaggaggtgcacaagagcggctacctgagcagcgagagactgatcccccagagagtgatggaccagcacaagctgaccagagaccagtgggaggacagaatccaggtgtggcacgccgagcacagaggcatgctgaaggacaacgccatgctggagtacctgaagatcgcccaggacctggagatgtacggcatcaactacttcgagatcaagaacaagaagggcaccgacctgtggctgggcgtggacgccctgggcctgaacatctacgagaaggacgacaagctgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctgcagctgtgcatgggcaaccacgagctgtacatgagaagaagaaagcccgacaccatcgaggtgcagcagatgaaggcccaggccagagaggagaagcaccagaagcagctggagagacagcagctggagaccgagaagaagagaagagagaccgtggagagagagaaggagcagatgatgagagagaaggaggagctgatgctgagactgcaggactacgaggagaagaccaagaaggccgagagagagctgagcgagcagatccagagagccctgcagctggaggaggagagaaagagagcccaggaggaggccgagagactggaggccgacagaatggccgccctgagagccaaggaggagctggagagacaggccgtggaccagatcaagagccaggagcagctggccgccgagctggccgagtacaccgccaagatcgccctgctggaggaggccagaagaagaaaggaggacgaggtggaggagtggcagcacagagccaaggaggcccaggacgacctggtgaagaccaaggaggagctgcacctggtgatgaccgcccccccccccccccccccccccgtgtacgagcccgtgagctaccacgtgcaggagagcctgcaggacgagggcgccgagcccaccggctacagcgccgagctgagcagcgagggcatcagagacgacagaaacgaggagaagagaatcaccgaggccgagaagaacgagagagtgcagagacagctgctgaccctgagcagcgagctgagccaggccagagacgagaacaagagaacccacaacgacatcatccacaacgagaacatgagacagggcagagacaagtacaagaccctgagacagatcagacagggcaacaccaagcagagaatcgacgagttcgaggccctgtag

SEQ ID NO: 10656 - DNA, 900 bp, Artificial Sequence
  Description of Artificial Sequence: Synthetic coding sequence
atgggcaccaaggcccaggtggagagaaagctgctgtgcctgttcatcctggccatcctgctgtgcagcctggccctgggcagcgtgaccgtgcacagcagcgagcccgaggtgagaatccccgagaacaaccccgtgaagctgagctgcgcctacagcggcttcagcagccccagagtggagtggaagttcgaccagggcgacaccaccagactggtgtgctacaacaacaagatcaccgccagctacgaggacagagtgaccttcctgcccaccggcatcaccttcaagagcgtgaccagagaggacaccggcacctacacctgcatggtgagcgaggagggcggcaacagctacggcgaggtgaaggtgaagctgatcgtgctggtgccccccagcaagcccaccgtgaacatccccagcagcgccaccatcggcaacagagccgtgctgacctgcagcgagcaggacggcagcccccccagcgagtacacctggttcaaggacggcatcgtgatgcccaccaaccccaagagcaccagagccttcagcaacagcagctacgtgctgaaccccaccaccggcgagctggtgttcgaccccctgagcgccagcgacaccggcgagtacagctgcgaggccagaaacggctacggcacccccatgaccagcaacgccgtgagaatggaggccgtggagagaaacgtgggcgtgatcgtggccgccgtgctggtgaccctgatcctgctgggcatcctggtgttcggcatctggttcgcctacagcagaggccacttcgacagaaccaagaagggcaccagcagcaagaaggtgatctacagccagcccagcgccagaagcgagggcgagttcaagcagaccagcagcttcctggtgtag

SEQ ID NO: 10657 - DNA, 900 bp, Artificial Sequence; identical to SEQ ID NO: 10656
  Description of Artificial Sequence: Synthetic coding sequence

SEQ ID NO: 10658 - DNA, 900 bp, Artificial Sequence; identical to SEQ ID NO: 10656
  Description of Artificial Sequence: Synthetic coding sequence

SEQ ID NO: 10659 - DNA, 912 bp, Artificial Sequence
  Description of Artificial Sequence: Synthetic coding sequence
atgctgcaggcccccagaggcagagccagagccgccctgagaagactggccgtggccaccagaaccatggccggcggcagcctggccctgggcagcgtgaccgtgcacagcagcgagcccgaggtgagaatccccgagaacaaccccgtgaagctgagctgcgcctacagcggcttcagcagccccagagtggagtggaagttcgaccagggcgacaccaccagactggtgtgctacaacaacaagatcaccgccagctacgaggacagagtgaccttcctgcccaccggcatcaccttcaagagcgtgaccagagaggacaccggcacctacacctgcatggtgagcgaggagggcggcaacagctacggcgaggtgaaggtgaagctgatcgtgctggtgccccccagcaagcccaccgtgaacatccccagcagcgccaccatcggcaacagagccgtgctgacctgcagcgagcaggacggcagcccccccagcgagtacacctggttcaaggacggcatcgtgatgcccaccaaccccaagagcaccagagccttcagcaacagcagctacgtgctgaaccccaccaccggcgagctggtgttcgaccccctgagcgccagcgacaccggcgagtacagctgcgaggccagaaacggctacggcacccccatgaccagcaacgccgtgagaatggaggccgtggagagaaacgtgggcgtgatcgtggccgccgtgctggtgaccctgatcctgctgggcatcctggtgttcggcatctggttcgcctacagcagaggccacttcgacagaaccaagaagggcaccagcagcaagaaggtgatctacagccagcccagcgccagaagcgagggcgagttcaagcagaccagcagcttcctggtgtag

SEQ ID NO: 10660 - DNA, 753 bp, Artificial Sequence
  Description of Artificial Sequence: Synthetic coding sequence
atgggcaccaaggcccaggtggagagaaagctgctgtgcctgttcatcctggccatcctgctgtgcagcctggccctgggcagcgtgaccgtgcacagcagcgagcccgaggtgagaatccccgagaacaaccccgtgaagctgagctgcgcctacagcggcttcagcagccccagagtggagtggaagttcgaccagggcgacaccaccagactggtgtgctacaacaacaagatcaccgtgccccccagcaagcccaccgtgaacatccccagcagcgccaccatcggcaacagagccgtgctgacctgcagcgagcaggacggcagcccccccagcgagtacacctggttcaaggacggcatcgtgatgcccaccaaccccaagagcaccagagccttcagcaacagcagctacgtgctgaaccccaccaccggcgagctggtgttcgaccccctgagcgccagcgacaccggcgagtacagctgcgaggccagaaacggctacggcacccccatgaccagcaacgccgtgagaatggaggccgtggagagaaacgtgggcgtgatcgtggccgccgtgctggtgaccctgatcctgctgggcatcctggtgttcggcatctggttcgcctacagcagaggccacttcgacagaaccaagaagggcaccagcagcaagaaggtgatctacagccagcccagcgccagaagcgagggcgagttcaagcagaccagcagcttcctggtgtag

SEQ ID NO: 10661 - DNA, 3357 bp, Artificial Sequence
  Description of Artificial Sequence: Synthetic coding sequence
atgggcgtgcagggcttccaggactacatcgagaagcactgccccagcgccgtggtgcccgtggagctgcagaagctggccagaggcagcctggtgggcggcggcagacagagacccccccagacccccctgagactgctggtggacgccgacaactgcctgcacagactgtacggcggcttctacaccgactgggtgagcggcggccagtggaaccacatgctgggctacctggccgccctggccaaggcctgcttcggcggcaacatcgagctgttcgtgttcttcaacggcgccctggagaaggccagactgcacgagtgggtgaagagacagggcaacgagagacagaccgcccagcagatcgtgagccacgtgcagaacaagggcacccccccccccaaggtgtggttcctgccccccgtgtgcatggcccactgcatcagactggccctgatcagattccacgtgaaggtggcccagagcatcgaggaccaccaccaggaggtgatcggcttctgcagagagaacggcttccacggcctggtggcctacgacagcgactacgccctgtgcaacatcccctactacttcagcgcccacgccctgaagctgagcagaaacggcaagagcctgaccaccagccagtacctgatgcacgaggtggccaagcagctggacctgaaccccaacagattccccatcttcgccgccctgctgggcaaccacatcctgcccgacgaggacctggccagcttccactggagcctgctgggccccgagcaccccctggccagcctgaaggtgagagcccaccagctggtgctgcccccctgcgacgtggtgatcaaggccgtggccgactacgtgagaaacatccaggacaccagcgacctggacgccatcgccaaggacgtgttccagcacagccagagcagaaccgacgacaaggtgatcagattcaagagagccatcggctactacagcgccaccagcaagcccatgagcttccaccccccccactacctggccgccagacccggccccttcggcatgcccggcatggtgcccccccacgtgcccccccagatgctgaacatcccccagaccagcctgcaggccaagcccgtggccccccaggtgcccagccccggcggcgcccccggccagggcccctacccctacagcctgagcgagcccgcccccctgaccctggacaccagcggcaagaacctgaccgagcagaacagctacagcaacatcccccacgagggcaagcacacccccctgtacgagagaagcagccccatcaaccccgcccagagcggcagccccaaccacgtggacagcgcctacttccccggcagcagcaccagcagcagcagcgacaacgacgagggcagcggcggcgccaccaaccacatcagcggcaacaagatcggctgggagaagaccggcagccacagcgagccccaggccagaggcgaccccggcgaccagaccaaggccgagggcagcagcaccgccagcagcggcagccagctggccgagggcaagggcagccagatgggcaccgtgcagcccatcccctgcctgctgagcatgcccaccagaaaccacatggacatcaccaccccccccctgccccccgtggcccccgaggtgctgagagtggccgagcacagacacaagaagggcctgatgtacccctacatcttccacgtgctgaccaagggcgagatcaagatcgccgtgagcatcgaggacgaggccaacaaggacctgccccccgccgccctgctgtacagacccgtgagacagtacgtgtacggcgtgctgttcagcctggccgagagcagaaagaagaccgagagactggccttcagaaagaacagactgccccccgagttcagccccgtgatcatcaaggagtgggccgcctacaagggcaagagcccccagacccccgagctggtggaggccctggccttcagagagtggacctgccccaacctgaagagactgtggctgggcaaggccgtggaggacaagaacagaagaatgagagccttcctggcctgcatgagaagcgacacccccgccatgctgaaccccgccaacgtgcccacccacctgatggtgctgtgctgcgtgctgagatacatggtgcagtggcccggcgccagaatcctgagaagacaggagctggacgccttcctggcccaggccctgagccccaagctgtacgagcccgaccagctgcaggagctgaagatcgagaacctggaccccagaggcatccagctgagcgccctgttcatgagcggcgtggacatggccctgttcgccaacgacgcctgcggccagcccatcccctgggagcactgctgcccctggatgtacttcgacggcaagctgttccagagcaagctgctgaaggccagcagagagaagacccccctgatcgacctgtgcgacggccaggccgaccaggccgccaaggtggagaagatgagacagagcgtgctggagggcctgagcttcagcagacagagccacaccctgcccttcccccccccccccgccctgcccttctaccccgccagcgcctaccccagacacttcggccccgtgccccccagccagggcagaggcagaggcttcgccggcgtgtgcggcttcggcggcccctacggcgagaccgtggccaccggcccctacagagccttcagagtggccgccgccagcggccactgcggcgccttcagcggcagcgacagcagcagaaccagcaagagccagggcggcgtgcagcccatccccagccagggcggcaagctggagatcgccggcaccgtggtgggccactgggccggcagcagaagaggcagaggcggcagaggccccttccccctgcaggtggtgagcgtgggcggccccgccagaggcagacccagaggcgtgatcagcacccccgtgatcagaaccttcggcagaggcggcagatactacggcagaggctacaagaaccaggccgccatccagggcagacccccctacgccgccagcgccgaggaggtggccaaggagctgaagagcaagagcggcgagagcaagagcagcgccatgagcagcgacggcagcctggccgagaacggcgtgatggccgaggagaagcccgccccccagatgaacggcagcaccggcgacgccagagcccccagccacagcgagagcgccctgaacaacgacagcaagacctgcaacaccaacccccacctgaacgccctgagcaccgacagcgcctgcagaagagaggccgccctggaggccgccgtgctgaacaaggaggagtag

SEQ ID NO: 10662 - DNA, 3441 bp, Artificial Sequence
  Description of Artificial Sequence: Synthetic coding sequence
atgggcgtgcagggcttccaggactacatcgagaagcactgccccagcgccgtggtgcccgtggagctgcagaagctggccagaggcagcctggtgggcggcggcagacagagacccccccagacccccctgagactgctggtggacgccgacaactgcctgcacagactgtacggcggcttctacaccgactgggtgagcggcggccagtggaaccacatgctgggctacctggccgccctggccaaggcctgcttcggcggcaacatcgagctgttcgtgttcttcaacggcgccctggagaaggccagactgcacgagtgggtgaagagacagggcaacgagagacagaccgcccagcagatcgtgagccacgtgcagaacaagggcacccccccccccaaggtgtggttcctgccccccgtgtgcatggcccactgcatcagactggccctgatcagattccacgtgaaggtggcccagagcatcgaggaccaccaccaggaggtgatcggcttctgcagagagaacggcttccacggcctggtggcctacgacagcgactacgccctgtgcaacatcccctactacttcagcgcccacgccctgaagctgagcagaaacggcaagagcctgaccaccagccagtacctgatgcacgaggtggccaagcagctggacctgaaccccaacagattccccatcttcgccgccctgctgggcaaccacatcctgcccgacgaggacctggccagcttccactggagcctgctgggccccgagcaccccctggccagcctgaaggtgagagcccaccagctggtgctgcccccctgcgacgtggtgatcaaggccgtggccgactacgtgagaaacatccaggacaccagcgacctggacgccatcgccaaggacgtgttccagcacagccagagcagaaccgacgacaaggtgatcagattcaagagagccatcggctactacagcgccaccagcaagcccatgagcttccaccccccccactacctggccgccagacccggccccttcggcatgcccggcatggtgcccccccacgtgcccccccagatgctgaacatcccccagaccagcctgcaggccaagcccgtggccccccaggtgcccagccccggcggcgcccccggccagggcccctacccctacagcctgagcgagcccgcccccctgaccctggacaccagcggcaagaacctgaccgagcagaacagctacagcaacatcccccacgagggcaagcacacccccctgtacgagagaagcagccccatcaaccccgcccagagcggcagccccaaccacgtggacagcgcctacttccccggcagcagcaccagcagcagcagcgacaacgacgagggcagcggcggcgccaccaagcccttccagctgtacctgcagaagaacttcgtgttccacaaggagaacagcatcgtgctgtgcagcagaatcctgagacacggccacatcagcggcaacaagatcggctgggagaagaccggcagccacagcgagccccaggccagaggcgaccccggcgaccagaccaaggccgagggcagcagcaccgccagcagcggcagccagctggccgagggcaagggcagccagatgggcaccgtgcagcccatcccctgcctgctgagcatgcccaccagaaaccacatggacatcaccaccccccccctgccccccgtggcccccgaggtgctgagagtggccgagcacagacacaagaagggcctgatgtacccctacatcttccacgtgctgaccaagggcgagatcaagatcgccgtgagcatcgaggacgaggccaacaaggacctgccccccgccgccctgctgtacagacccgtgagacagtacgtgtacggcgtgctgttcagcctggccgagagcagaaagaagaccgagagactggccttcagaaagaacagactgccccccgagttcagccccgtgatcatcaaggagtgggccgcctacaagggcaagagcccccagacccccgagctggtggaggccctggccttcagagagtggacctgccccaacctgaagagactgtggctgggcaaggccgtggaggacaagaacagaagaatgagagccttcctggcctgcatgagaagcgacacccccgccatgctgaaccccgccaacgtgcccacccacctgatggtgctgtgctgcgtgctgagatacatggtgcagtggcccggcgccagaatcctgagaagacaggagctggacgccttcctggcccaggccctgagccccaagctgtacgagcccgaccagctgcaggagctgaagatcgagaacctggaccccagaggcatccagctgagcgccctgttcatgagcggcgtggacatggccctgttcgccaacgacgcctgcggccagcccatcccctgggagcactgctgcccctggatgtacttcgacggcaagctgttccagagcaagctgctgaaggccagcagagagaagacccccctgatcgacctgtgcgacggccaggccgaccaggccgccaaggtggagaagatgagacagagcgtgctggagggcctgagcttcagcagacagagccacaccctgcccttcccccccccccccgccctgcccttctaccccgccagcgcctaccccagacacttcggccccgtgccccccagccagggcagaggcagaggcttcgccggcgtgtgcggcttcggcggcccctacggcgagaccgtggccaccggcccctacagagccttcagagtggccgccgccagcggccactgcggcgccttcagcggcagcgacagcagcagaaccagcaagagccagggcggcgtgcagcccatccccagccagggcggcaagctggagatcgccggcaccgtggtgggccactgggccggcagcagaagaggcagaggcggcagaggccccttccccctgcaggtggtgagcgtgggcggccccgccagaggcagacccagaggcgtgatcagcacccccgtgatcagaaccttcggcagaggcggcagatactacggcagaggctacaagaaccaggccgccatccagggcagacccccctacgccgccagcgccgaggaggtggccaaggagctgaagagcaagagcggcgagagcaagagcagcgccatgagcagcgacggcagcctggccgagaacggcgtgatggccgaggagaagcccgccccccagatgaacggcagcaccggcgacgccagagcccccagccacagcgagagcgccctgaacaacgacagcaagacctgcaacaccaacccccacctgaacgccctgagcaccgacagcgcctgcagaagagaggccgccctggaggccgccgtgctgaacaaggaggagtag

SEQ ID NO: 10663 - DNA, 3219 bp, Artificial Sequence
  Description of Artificial Sequence: Synthetic coding sequence
atgggcgtgcagggcttccaggactacatcgagaagcactgccccagcgccgtggtgcccgtggagctgcagaagctggccagaggcagcctggtgggcggcggcagacagagacccccccagacccccctgagactgctggtggacgccgacaactgcctgcacagactgtacggcggcttctacaccgactgggtgagcggcggccagtggaaccacatgctgggctacctggccgccctggccaaggcctgcttcggcggcaacatcgagctgttcgtgttcttcaacggcgccctggagaaggccagactgcacgagtgggtgaagagacagggcaacgagagacagaccgcccagcagatcgtgagccacgtgcagaacaagggcacccccccccccaaggtgtggttcctgccccccgtgtgcatggcccactgcatcagactggccctgatcagattccacgtgaaggtggcccagagcatcgaggaccaccaccaggaggtgatcggcttctgcagagagaacggcttccacggcctggtggcctacgacagcgactacgccctgtgcaacatcccctactacttcagcgcccacgccctgaagctgagcagaaacggcaagagcctgaccaccagccagtacctgatgcacgaggtggccaagcagctggacctgaaccccaacagattccccatcttcgccgccctgctgggcaaccacatcctgcccgacgaggacctggccagcttccactggagcctgctgggccccgagcaccccctggccagcctgaaggtgagagcccaccagctggtgctgcccccctgcgacgtggtgatcaaggccgtggccgactacgtgagaaacatccaggacaccagcgacctggacgccatcgccaaggacgtgttccagcacagccagagcagaaccgacgacaaggtgatcagattcaagagagccatcggctactacagcgccaccagcaagcccatgagcttccaccccccccactacctggccgccagacccggccccttcggcatgcccggcatggtgcccccccacgtgcccccccagatgctgaacatcccccagaccagcctgcaggccaagcccgtggccccccaggtgcccagccccggcggcgcccccggccagggcccctacccctacagcctgagcgagcccgcccccctgaccctggacaccagcggcaagaacctgaccgagcagaacagctacagcaacatcccccacgagggcaagcacacccccctgtacgagagaagcagccccatcaaccccgcccagagcggcagccccaaccacgtggacagcgcctacttccccggcagcagcaccagcagcagcagcgacaacgacgagggcagcggcggcgccaccaaccacatcagcggcaacaagatcggctgggagaagaccggcagccacagcgagccccaggccagaggcgaccccggcgaccagaccaaggccgagggcagcagcaccgccagcagcggcagccagctggccgagggcaagggcagccagatgggcaccgtgcagcccatcccctgcctgctgagcatgcccaccagaaaccacatggacatcaccaccccccccctgccccccgtggcccccgaggtgctgagagtggccgagcacagacacaagaagggcctgatgtacccctacatcttccacgtgctgaccaagggcgagatcaagatcgccgtgagcatcgaggacgaggccaacaaggacctgccccccgccgccctgctgtacagacccgtgagacagtacgtgtacggcgtgctgttcagcctggccgagagcagaaagaagaccgagagactggccttcagaaagaacagactgccccccgagttcagccccgtgatcatcaaggagtgggccgcctacaagggcaagagcccccagacccccgagctggtggaggccctggccttcagagagtggacctgccccaacctgaagagactgtggctgggcaaggccgtggaggacaagaacagaagaatgagagccttcctggcctgcatgagaagcgacacccccgccatgctgaaccccgccaacgtgcccacccacctgatggtgctgtgctgcgtgctgagatacatggtgcagtggcccggcgccagaatcctgagaagacaggagctggacgccttcctggcccaggccctgagccccaagctgtacgagcccgaccagctgcaggagctgaagatcgagaacctggaccccagaggcatccagctgagcgccctgttcatgagcggcgtggacatggccctgttcgccaacgacgcctgcggccagcccatcccctgggagcactgctgcccctggatgtacttcgacggcaagctgttccagagcaagctgctgaaggccagcagagagaagacccccctgatcgacctgtgcgacggccaggccgaccaggccgccaaggtggagaagatgagacagagcgtgctggagggcctgagcttcagcagacagagccacaccctgcccttcccccccccccccgccctgcccttctaccccgccagcgcctaccccagacacttcggccccgtgccccccagccagggcagaggcagaggcttcgccggcgtgcagcccatccccagccagggcggcaagctggagatcgccggcaccgtggtgggccactgggccggcagcagaagaggcagaggcggcagaggccccttccccctgcaggtggtgagcgtgggcggccccgccagaggcagacccagaggcgtgatcagcacccccgtgatcagaaccttcggcagaggcggcagatactacggcagaggctacaagaaccaggccgccatccagggcagacccccctacgccgccagcgccgaggaggtggccaaggagctgaagagcaagagcggcgagagcaagagcagcgccatgagcagcgacggcagcctggccgagaacggcgtgatggccgaggagaagcccgccccccagatgaacggcagcaccggcgacgccagagcccccagccacagcgagagcgccctgaacaacgacagcaagacctgcaacaccaacccccacctgaacgccctgagcaccgacagcgcctgcagaagagaggccgccctggaggccgccgtgctgaacaaggaggagtag

SEQ ID NO: 10664 - DNA, 1887 bp, Artificial Sequence
  Description of Artificial Sequence: Synthetic coding sequence
atgggcgtgcagggcttccaggactacatcgagaagcactgccccagcgccgtggtgcccgtggagctgcagaagctggccagaggcagcctggtgggcggcggcagacagagacccccccagacccccctgagactgctggtggacgccgacaactgcctgcacagactgtacggcggcttctacaccgactgggtgagcggcggccagtggaaccacatgctgggctacctggccgccctggccaaggcctgcttcggcggcaacatcgagctgttcgtgttcttcaacggcgccctggagaaggccagactgcacgagtgggtgaagagacagggcaacgagagacagaccgcccagcagatcgtgagccacgtgcagaacaagggcacccccccccccaaggtgtggttcctgccccccgtgtgcatggcccactgcatcagactggccctgatcagattccacgtgaaggtggcccagagcatcgaggaccaccaccaggaggtgatcggcttctgcagagagaacggcttccacggcctggtggcctacgacagcgactacgccctgtgcaacatcccctactacttcagcgcccacgccctgaagctgagcagaaacggcaagagcctgaccaccagccagtacctgatgcacgaggtggccaagcagctggacctgaaccccaacagattccccatcttcgccgccctgctgggcaaccacatcctgcccgacgaggacctggccagcttccactggagcctgctgggccccgagcaccccctggccagcctgaaggtgagagcccaccagctggtgctgcccccctgcgacgtggtgatcaaggccgtggccgactacgtgagaaacatccaggacaccagcgacctggacgccatcgccaaggacgtgttccagcacagccagagcagaaccgacgacaaggtgatcagattcaagagagccatcggctactacagcgccaccagcaagcccatgagcttccaccccccccactacctggccgccagacccggccccttcggcatgcccggcatggtgcccccccacgtgcccccccagatgctgaacatcccccagaccagcctgcaggccaagcccgtggccccccaggtgcccagccccggcggcgcccccggccagggcccctacccctacagcctgagcgagcccgcccccctgaccctggacaccagcggcaagaacctgaccgagcagaacagctacagcaacatcccccacgagggcaagcacacccccctgtacgagagaagcagccccatcaaccccgcccagagcggcagccccaaccacgtggacagcgcctacttccccggcagcagcaccagcagcagcagcgacaacgacgagggcagcggcggcgccaccaaccacatcagcggcaacaagatcggctgggagaagaccggcagccacagcgagccccaggccagaggcgaccccggcgaccagaccaaggccgagggcagcagcaccgccagcagcggcagccagctggccgagggcaagggcagccagatgggcaccgtgcagcccatcccctgcctgctgagcatgcccaccagaaaccacatggacatcaccaccccccccctgccccccgtggcccccgaggtgctgagagtggccgagcacagacacaagaagggcctgatgtacccctacatcttccacgtgctgaccaaggtgctgagcaagggcccctggagcggcttctgctacctgatgagcggccacagctacggctgcttcgtgctgctgagcttcttcgagcccttcttctgcctgaccaacctgctggagaccaagttcaccttccccttcctgaacatcgagtag

SEQ ID NO: 10665 - DNA, 1485 bp, Artificial Sequence
  Description of Artificial Sequence: Synthetic coding sequence
ggcgagatcaagatcgccgtgagcatcgaggacgaggccaacaaggacctgccccccgccgccctgctgtacagacccgtgagacagtacgtgtacggcgtgctgttcagcctggccgagagcagaaagaagaccgagagactggccttcagaaagaacagactgccccccgagttcagccccgtgatcatcaaggagtgggccgcctacaagggcaagagcccccagacccccgagctggtggaggccctggccttcagagagtggacctgccccaacctgaagagactgtggctgggcaaggccgtggaggacaagaacagaagaatgagagccttcctggcctgcatgagaagcgacacccccgccatgctgaaccccgccaacgtgcccacccacctgatggtgctgtgctgcgtgctgagatacatggtgcagtggcccggcgccagaatcctgagaagacaggagctggacgccttcctggcccaggccctgagccccaagctgtacgagcccgaccagctgcaggagctgaagatcgagaacctggaccccagaggcatccagctgagcgccctgttcatgagcggcgtggacatggccctgttcgccaacgacgcctgcggccagcccatcccctgggagcactgctgcccctggatgtacttcgacggcaagctgttccagagcaagctgctgaaggccagcagagagaagacccccctgatcgacctgtgcgacggccaggccgaccaggccgccaaggtggagaagatgagacagagcgtgctggagggcctgagcttcagcagacagagccacaccctgcccttcccccccccccccgccctgcccttctaccccgccagcgcctaccccagacacttcggccccgtgccccccagccagggcagaggcagaggcttcgccggcgtgcagcccatccccagccagggcggcaagctggagatcgccggcaccgtggtgggccactgggccggcagcagaagaggcagaggcggcagaggccccttccccctgcaggtggtgagcgtgggcggccccgccagaggcagacccagaggcgtgatcagcacccccgtgatcagaaccttcggcagaggcggcagatactacggcagaggctacaagaaccaggccgccatccagggcagacccccctacgccgccagcgccgaggaggtggccaaggagctgaagagcaagagcggcgagagcaagagcagcgccatgagcagcgacggcagcctggccgagaacggcgtgatggccgaggagaagcccgccccccagatgaacggcagcaccggcgacgccagagcccccagccacagcgagagcgccctgaacaacgacagcaagacctgcaacaccaacccccacctgaacgccctgagcaccgacagcgcctgcagaagagaggccgccctggaggccgccgtgctgaacaaggaggagtag

SEQ ID NO: 10666 - DNA, 1485 bp, Artificial Sequence
  Description of Artificial Sequence: Synthetic coding sequence
tgagtggcccagagcatcgaggaccaccaccaggaggtgatcggcttctgcagagagaacggcttccacggcctggtggcctacgacagcgactacgccctgtgcaacatcccctactacttcagcgcccacgccctgaagctgagcagaaacggcaagagcctgaccaccagccagtacctgatgcacgaggtggccaagcagctggacctgaaccccaacagattccccatcttcgccgccctgctgggcaaccacatcctgcccgacgaggacctggccagcttccactggagcctgctgggccccgagcaccccctggccagcctgaaggtgagagcccaccagctggtgctgcccccctgcgacgtggtgatcaaggccgtggccgactacgtgagaaacatccaggacaccagcgacctggacgccatcgccaaggacgtgttccagcacagccagagcagaaccgacgacaaggtgatcagattcaagagagccatcggctactacagcgccaccagcaagcccatgagcttccaccccccccactacctggccgccagacccggccccttcggcatgcccggcatggtgcccccccacgtgcccccccagatgctgaacatcccccagaccagcctgcaggccaagcccgtggccccccaggtgcccagccccggcggcgcccccggccagggcccctacccctacagcctgagcgagcccgcccccctgaccctggacaccagcggcaagaacctgaccgagcagaacagctacagcaacatcccccacgagggcaagcacacccccctgtacgagagaagcagccccatcaaccccgcccagagcggcagccccaaccacgtggacagcgcctacttccccggcagcagcaccagcagcagcagcgacaacgacgagggcagcggcggcgccaccaaccacatcagcggcaacaagatcggctgggagaagaccggcagccacagcgagccccaggccagaggcgaccccggcgaccagaccaaggccgagggcagcagcaccgccagcagcggcagccagctggccgagggcaagggcagccagatgggcaccgtgcagcccatcccctgcctgctgagcatgcccaccagaaaccacatggacatcaccaccccccccctgccccccgtggcccccgaggtgctgagagtggccgagcacagacacaagaagggcctgatgtacccctacatcttccacgtgctgaccaagggcgagatcaagatcgccgtgagcatcgaggacgaggccaacaaggacctgccccccgccgccctgctgtacagacccgtgagacagtacgtgtacggcgtgctgttcagcctggccgagagcagaaagaagaccgagagactggccttcagaaagaacagactgccccccgagtgcatgtactgcaacaaccccctgttcgtgttcctgggcaccagctag

SEQ ID NO: 10667 - DNA, 969 bp, Artificial Sequence
  Description of Artificial Sequence: Synthetic coding sequence
atggtggccgacctggagctgcagcaggacctgatcgtgcccctgggccacacccccagccaggagcacttcctgttcgagatcttcagaagaagactgcaggccctgaccagcggctggagcgtggccgccagcctgcagagacagagagagctgctgatgtacaagagaatcctgctgagactgcccagcagcgtgctgtgcggcagcagcttccaggccgagcagcccatcaccgccagatgcgagcagttcttccacctggtgaacagcgagatgagaaacttctgcagccacggcggcgccctgacccaggacatcaccgcccacttcttcagaggcctgctgaacgcctgcctgagaagcagagaccccagcctgatggtggacttcatcctggccaagtgccagaccaagtgccccctgatcctgaccagcgccctggtgtggtggcccagcctggagcccgtgctgctgtgcagatggagaagacactgccagagccccctgcccagagagctgcagaagctgcaggagggcagacagttcgccagcgacttcctgagccccgaggccgccagccccgcccccaaccccgactggctgagcgccgccgccctgcacttcgccatccagcaggtgagagaggagaacatcagaaagcagctgaagaagctggactgcgagagagaggagctgctggtgttcctgttcttcttcagcctgatgggcctgctgagcagccacctgaccagcaacagcaccaccgacctgcccaaggccttccacgtgtgcgccgccatcctggagtgcctggagaagagaaagatcagctggctggccctgttccagctgaccgagagcggcaagaagcacgccgccgaggcccagatgagaagagccgccctgttcagaggcatcctgcagatggtgaagaacgagcccagcctgagattcctggccaagtag

SEQ ID NO: 10668 - DNA, 4368 bp, Artificial Sequence
  Description of Artificial Sequence: Synthetic coding sequence
atgagcgacagctgggtgcccaacagcgccagcggccaggaccccggcggcagaagaagagcctgggccgagctgctggccggcagagtgaagagagagaagtacaaccccgagagagcccagaagctgaaggagagcgccgtgagactgctgagaagccaccaggacctgaacgccctgctgctggaggtggagggccccctgtgcaagaagctgagcctgagcaaggtgatcgactgcgacagcagcgaggcctacgccaaccacagcagcagcttcatcggcagcgccctgcaggaccaggccagcagactgggcgtgcccgtgggcatcctgagcgccggcatggtggccagcagcgtgggccagatctgcaccgcccccgccgagaccagccaccccgtgctgctgaccgtggagcagagaaagaagctgagcagcctgctggagttcgcccagtacctgctggcccacagcatgttcagcagactgagcttctgccaggagctgtggaagatccagagcagcctgctgctggaggccgtgtggcacctgcacgtgcagggcatcgtgagcctgcaggagctgctggagagccaccccgacatgcacgccgtgggcagctggctgttcagaaacctgtgctgcctgtgcgagcagatggaggccagctgccagcacgccgacgtggccagagccatgctgagcgacttcgtgcagatgttcgtgctgagaggcttccagaagaacagcgacctgagaagaaccgtggagcccgagaagatgccccaggtgaccgtggacgtgctgcagagaatgctgatcttcgccctggacgccctggccgccggcgtgcaggaggagagcagcacccacaagatcgtgagatgctggttcggcgtgttcagcggccacaccctgggcagcgtgatcagcaccgaccccctgaagagattcttcagccacaccctgacccagatcctgacccacagccccgtgctgaaggccagcgacgccgtgcagatgcagagagagtggagcttcgccagaacccaccccctgctgaccagcctgtacagaagactgttcgtgatgctgagcgccgaggagctggtgggccacctgcaggaggtgctggagacccaggaggtgcactggcagagagtgctgagcttcgtgagcgccctggtggtgtgcttccccgaggcccagcagctgctggaggactgggtggccagactgatggcccaggccttcgagagctgccagctggacagcatggtgaccgccttcctggtggtgagacaggccgccctggagggccccagcgccttcctgagctacgccgactggttcaaggccagcttcggcagcaccagaggctaccacggctgcagcaagaaggccctggtgttcctgttcaccttcctgagcgagctggtgcccttcgagagccccagatacctgcaggtgcacatcctgcacccccccctggtgcccggcaagtacagaagcctgctgaccgactacatcagcctggccaagaccagactggccgacctgaaggtgagcatcgagaacatgggcctgtacgaggacctgagcagcgccggcgacatcaccgagccccacagccaggccctgcaggacgtggagaaggccatcatggtgttcgagcacaccggcaacatccccgtgaccgtgatggaggccagcatcttcagaagaccctactacgtgagccacttcctgcccgccctgctgacccccagagtgctgcccaaggtgcccgacagcagagtggccttcatcgagagcctgaagagagccgacaagatcccccccagcctgtacagcacctactgccaggcctgcagcgccgccgaggagaagcccgaggacgccgccctgggcgtgagagccgagcccaacagcgccgaggagcccctgggccagctgaccgccgccctgggcgagctgagagccagcatgaccgaccccagccagagagacgtgatcagcgcccaggtggccgtgatcagcgagagactgagagccgtgctgggccacaacgaggacgacagcagcgtggagatcagcaagatccagctgagcatcaacacccccagactggagcccagagagcacatggccgtggacctgctgctgaccagcttctgccagaacctgatggccgccagcagcgtggccccccccgagagacagggcccctgggccgccctgttcgtgagaaccatgtgcggcagagtgctgcccgccgtgctgaccagactgtgccagctgctgagacaccagggccccagcctgagcgccccccacgtgctgggcctggccgccctggccgtgcacctgggcgagagcagaagcgccctgcccgaggtggacgtgggcccccccgcccccggcgccggcctgcccgtgcccgccctgttcgacagcctgctgacctgcagaaccagagacagcctgttcttctgcctgaagttctgcaccgccgccatcagctacagcctgtgcaagttcagcagccagagcagagacaccctgtgcagctgcctgagccccggcctgatcaagaagttccagttcctgatgttcagactgttcagcgaggccagacagcccctgagcgaggaggacgtggccagcctgagctggagacccctgcacctgcccagcgccgactggcagagagccgccctgagcctgtggacccacagaaccttcagagaggtgctgaaggaggaggacgtgcacctgacctaccaggactggctgcacctggagctggagatccagcccgaggccgacgccctgagcgacaccgagagacaggacttccaccagtgggccatccacgagcacttcctgcccgagagcagcgccagcggcggctgcgacggcgacctgcaggccgcctgcaccatcctggtgaacgccctgatggacttccaccagagcagcagaagctacgaccacagcgagaacagcgacctggtgttcggcggcagaaccggcaacgaggacatcatcagcagactgcaggagatggtggccgacctggagctgcagcaggacctgatcgtgcccctgggccacacccccagccaggagcacttcctgttcgagatcttcagaagaagactgcaggccctgaccagcggctggagcgtggccgccagcctgcagagacagagagagctgctgatgtacaagagaatcctgctgagactgcccagcagcgtgctgtgcggcagcagcttccaggccgagcagcccatcaccgccagatgcgagcagttcttccacctggtgaacagcgagatgagaaacttctgcagccacggcggcgccctgacccaggacatcaccgcccacttcttcagaggcctgctgaacgcctgcctgagaagcagagaccccagcctgatggtggacttcatcctggccaagtgccagaccaagtgccccctgatcctgaccagcgccctggtgtggtggcccagcctggagcccgtgctgctgtgcagatggagaagacactgccagagccccctgcccagagagctgcagaagctgcaggagggcagacagttcgccagcgacttcctgagccccgaggccgccagccccgcccccaaccccgactggctgagcgccgccgccctgcacttcgccatccagcaggtgagagaggagaacatcagaaagcagctgaagaagctggactgcgagagagaggagctgctggtgttcctgttcttcttcagcctgatgggcctgctgagcagccacctgaccagcaacagcaccaccgacctgcccaaggccttccacgtgtgcgccgccatcctggagtgcctggagaagagaaagatcagctggctggccctgttccagctgaccgagagcgacctgagactgggcagactgctgctgagagtggcccccgaccagcacaccagactgctgcccttcgccttctacagcctgctgagctacttccacgaggacgccgccatcagagaggaggccttcctgcacgtggccgtggacatgtacctgaagctggtgcagctgttcgtggccggcgacaccagcaccgtgagcccccccgccggcagaagcctggagctgaagggccagggcaaccccgtggagctgatcaccaaggccagactgttcctgctgcagctgatccccagatgccccaagaagagcttcagccacgtggccgagctgctggccgacagaggcgactgcgaccccgaggtgagcgccgccctgcagagcagacagcaggccgcccccgacgccgacctgagccaggagccccacctgttctag

SEQ ID NO: 10669 - DNA, 894 bp, Artificial Sequence
  Description of Artificial Sequence: Synthetic coding sequence
atgagcgacagctgggtgcccaacagcgccagcggccaggaccccggcggcagaagaagagcctgggccgagctgctggccggcagagtgaagagagagaagtacaaccccgagagagcccagaagctgaaggagagcgccgtgagactgctgagaagccaccaggacctgaacgccctgctgctggaggtggagggccccctgtgcaagaagctgagcctgagcaaggtgatcgactgcgacagcagcgaggcctacgccaaccacagcagcagcttcatcggcagcgccctgcaggaccaggccagcagactgggcgtgcccgtgggcatcctgagcgccggcatggtggccagcagcgtgggccagatctgcaccgcccccgccgagaccagccaccccgtgctgctgaccgtggagcagagaaagaagctgagcagcctgctggagttcgcccagtacctgctggcccacagcatgttcagcagactgagcttctgccaggagctgtggaagatccagagcagcctgctgctggaggccgtgtggcacctgcacgtgcagggcatcgtgagcctgcaggagctgctggagagccaccccgacatgcacgccgtgggcagctggctgttcagaaacctgtgctgcctgtgcgagcagatggaggccagctgccagcacgccgacgtggccagagccatgctgagcgacttcgtgcagatgttcgtgctgagaggcttccagaagaacagcgacctgagaagaaccgtggagcccgagaagatgccccaggtgaccgtggacgtgctgcagagaatgctgatcttcgccctggacgccctggccgccggcgtgcaggaggagagcagcacccacaagatcgtgagatgctag

SEQ ID NO: 10670 - DNA, 909 bp, Artificial Sequence
  Description of Artificial Sequence: Synthetic coding sequence
atgagcgacagctgggtgcccaacagcgccagcggccaggaccccggcggcagaagaagagcctgggccgagctgctggccggcagagtgaagagagagaagtacaaccccgagagagcccagaagctgaaggagagcgccgtgagactgctgagaagccaccaggacctgaacgccctgctgctggaggtggagggccccctgtgcaagaagctgagcctgagcaaggtgatcgactgcgacagcagcgaggcctacgccaaccacagcagcagcttcatcggcagcgccctgcaggaccaggccagcagactgggcgtgcccgtgggcatcctgagcgccggcatggtggccagcagcgtgggccagatctgcaccgcccccgccgagaccagccaccccgtgctgctgaccgtggagcagagaaagaagctgagcagcctgctggagttcgcccagtacctgctggcccacagcatgttcagcagactgagcttctgccaggagctgtggaagatccagagcagcctgctgctggaggccgtgtggcacctgcacgtgcagggcatcgtgagcctgcaggagctgctggagagccaccccgacatgcacgccgtgggcagctggctgttcagaaacctgtgctgcctgtgcgagcagatggaggccagctgccagcacgccgacgtggccagagccatgctgagcgacttcgtgcagatgttcgtgctgagaggcttccagaagaacagcgacctgagaagaaccgtggagcccgagaagatgccccaggtgaccgtggacgtgctgcagagaatgctgatcttcgccctggacgccctggccgccggcgtgcaggaggagagcagcacccacaagatcgtgagagccagcgccgccagaagctag

SEQ ID NO: 10671 - DNA, 798 bp, Artificial Sequence
  Description of Artificial Sequence: Synthetic coding sequence
atgagcgacagctgggtgcccaacagcgccagcggccaggaccccggcggcagaagaagagcctgggccgagctgctggccggcagagtgaagagagagaagtacaaccccgagagagcccagaagctgaaggagagcgccgtgagactgctgagaagccaccaggacctgaacgccctgctgctggaggtggagggccccctgtgcaagaagctgagcctgagcaaggtgatcgactgcgacagcagcgaggcctacgccaaccacagcagcagcttcatcggcagcgccctgcaggaccaggccagcagactgggcgtgcccgtgggcatcctgagcgccggcatggtggccagcagcgtgggccagatctgcaccgcccccgccgagaccagccaccccgtgctgctgaccgtggagcagagaagcagcctgctgctggaggccgtgtggcacctgcacgtgcagggcatcgtgagcctgcaggagctgctggagagccaccccgacatgcacgccgtgggcagctggctgttcagaaacctgtgctgcctgtgcgagcagatggaggccagctgccagcacgccgacgtggccagagccatgctgagcgacttcgtgcagatgttcgtgctgagaggcttccagaagaacagcgacctgagaagaaccgtggagcccgagaagatgccccaggtgaccgtggacgtgctgcagagaatgctgatcttcgccctggacgccctggccgccggcgtgcaggaggagagcagcacccacaagatcgtgagatgctag

SEQ ID NO: 10672 - DNA, 1869 bp, Artificial Sequence
  Description of Artificial Sequence: Synthetic coding sequence
atgagcagacagaccaccagcgtgggcagcagctgcctggacctgtggagagagaagaacgacagactggtgagacaggccaaggtggcccagaacagcggcctgaccctgagaagacagcagctggcccaggacgccctggagggcctgagaggcctgctgcacagcctgcagggcctgcccgccgccgtgcccgtgctgcccctggagctgaccgtgacctgcaacttcatcatcctgagagccagcctggcccagggcttcaccgaggaccaggcccaggacatccagagaagcctggagagagtgctggagacccaggagcagcagggccccagactggagcagggcctgagagagctgtgggacagcgtgctgagagccagctgcctgctgcccgagctgctgagcgccctgcacagactggtgggcctgcaggccgccctgtggctgagcgccgacagactgggcgacctggccctgctgctggagaccctgaacggcagccagagcggcgccagcaaggacctgctgctgctgctgaagacctggagcccccccgccgaggagctggacgcccccctgaccctgcaggacgcccagggcctgaaggacgtgctgctgaccgccttcgcctacagacagggcctgcaggagctgatcaccggcaaccccgacaaggccctgagcagcctgcacgaggccgccagcggcctgtgccccagacccgtgctggtgcaggtgtacaccgccctgggcagctgccacagaaagatgggcaacccccagagagccctgctgtacctggtggccgccctgaaggagggcagcgcctggggcccccccctgctggaggccagcagactgtaccagcagctgggcgacaccaccgccgagctggagagcctggagctgctggtggaggccctgaacgtgccctgcagcagcaaggccccccagttcctgatcgaggtggagctgctgctgcccccccccgacctggccagccccctgcactgcggcacccagagccagaccaagcacatcctggccagcagatgcctgcagaccggcagagccggcgacgccgccgagcactacctggacctgctggccctgctgctggacagcagcgagcccagattcagccccccccccagcccccccggcccctgcatgcccgaggtgttcctggaggccgccgtggccctgatccaggccggcagagcccaggacgccctgaccctgtgcgaggagctgctgagcagaaccagcagcctgctgcccaagatgagcagactgtgggaggacgccagaaagggcaccaaggagctgccctactgccccctgtgggtgagcgccacccacctgctgcagggccaggcctgggtgcagctgggcgcccagaaggtggccatcagcgagttcagcagatgcctggagctgctgttcagagccacccccgaggagaaggagcagggcgccgccttcaactgcgagcagggctgcaagagcgacgccgccctgcagcagctgagagccgccgccctgatcagcagaggcctggagtgggtggccagcggccaggacaccaaggccctgcaggacttcctgctgagcgtgcagatgtgccccggcaacagagacacctacttccacctgctgcagaccctgaagagactggacagaagagacgaggccaccgccctgtggtggagactggaggcccagaccaagggcagccacgaggacgccctgtggagcctgcccctgtacctggagagctacctgagctggatcagacccagcgacagagacgccttcctggaggagttcagaaccagcctgcccaagagctgcgacctgtag

SEQ ID NO: 10673 - DNA, 648 bp, Artificial Sequence
  Description of Artificial Sequence: Synthetic coding sequence
atgagcagacagaccaccagcgtgggcagcagctgcctggacctgtggagagagaagaacgacagactggtgagacaggccaaggtggcccagaacagcggcctgaccctgagaagacagcagctggcccaggacgccctggagggcctgagaggcctgctgcacagcctgcagggcctgcccgccgccgtgcccgtgctgcccctggagctgaccgtgacctgcaacttcatcatcctgagagccagcctggcccagggcttcaccgaggaccaggcccaggacatccagagaagcctggagagagtgctggagacccaggagcagcagggccccagactggagcagggcctgagagagctgtgggacagcgtgctgagagccagctgcctgctgcccgagctgctgagcgccctgcacagactggtgggcctgcaggccgccctgtggctgagcgccgacagactgggcgacctggccctgctgctggagaccctgaacggcagccagagcggcgccagcaaggacctgctgctgctgctgaagacctggagcccccccgccgaggagctggacgcccccctgaccctgcaggacgcccagggcctgaaggacgtgctgctgaccgccttcgcctacagacagtag

SEQ ID NO: 10674 - DNA, 1347 bp, Artificial Sequence
  Description of Artificial Sequence: Synthetic coding sequence
atgagcagacagaccaccagcgtgggcagcagctgcctggacctgtggagagagaagaacgacagactggtgagacaggccaaggtggcccagaacagcggcctgaccctgagaagacagcagctggcccaggacgccctggagggcctgagaggcctgctgcacagcctgcagggcctgcccgccgccgtgcccgtgctgcccctggagctgaccgtgacctgcaacttcatcatcctgagagccagcctggcccagggcttcaccgaggaccaggcccaggacatccagagaagcctggagagagtgctggagacccaggagcagcagggccccagactggagcagggcctgagagagctgtgggacagcgtgctgagagccagctgcctgctgcccgagctgctgagcgccctgcacagactggtgggcctgcaggccgccctgtggctgagcgccgacagactgggcgacctggccctgctgctggagaccctgaacggcagccagagcggcgccagcaaggacctgctgctgctgctgaagacctggagcccccccgccgaggagctggacgcccccctgaccctgcaggacgcccagggcctgaaggacgtgctgctgaccgccttcgcctacagacagggcctgcaggagctgatcaccggcaaccccgacaaggccctgagcagcctgcacgaggccgccagcggcctgtgccccagacccgtgctggtgcaggtgtacaccgccctgggcagctgccacagaaagatgggcaacccccagagagccctgctgtacctggtggccgccctgaaggagggcagcgcctggggcccccccctgctggaggccagcagactgtaccagcagctgggcgacaccaccgccgagctggagagcctggagctgctggtggaggccctgaacgtgccctgcagcagcaaggccccccagttcctgatcgaggtggagctgctgctgcccccccccgacctggccagccccctgcactgcggcacccagagccagaccaagcacatcctggccagcagatgcctgcagaccggcagagccggcgacgccgccgagcactacctggacctgctggccctgctgctggacagcagcgagcccagattcagccccccccccagcccccccggcccctgcatgcccgaggtgttcctggaggccgccgtggccctgatccaggccggcagagcccaggacgccctgaccctgtgcgaggagctgctgagcagaaccagcagcctgctgcccaagatgagcagactgtgggaggacgccagaaagagaaccagaggcagcttccagctgtag

SEQ ID NO: 10675 - DNA, 663 bp, Artificial Sequence
  Description of Artificial Sequence: Synthetic coding sequence
atgctgggcatctggaccctgctgcccctggtgctgaccagcgtggccagactgagcagcaagagcgtgaacgcccaggtgaccgacatcaacagcaagggcctggagctgagaaagaccgtgaccaccgtggagacccagaacctggagggcctgcaccacgacggccagttctgccacaagccctgcccccccggcgagagaaaggccagagactgcaccgtgaacggcgacgagcccgactgcgtgccctgccaggagggcaaggagtacaccgacaaggcccacttcagcagcaagtgcagaagatgcagactgtgcgacgagggccacggcctggaggtggagatcaactgcaccagaacccagaacaccaagtgcagatgcaagcccaacttcttctgcaacagcaccgtgtgcgagcactgcgacccctgcaccaagtgcgagcacggcatcatcaaggagtgcaccctgaccagcaacaccaagtgcaaggaggagggcagcagaagcaacctgggctggctgtgcctgctgctgctgcccatccccctgatcgtgtgggtgaagagaaaggaggtgcagaagacctgcagaaagcacagaaaggagaaccagggcagccacgagagccccaccctgaaccccatgctgacctag

SEQ ID NO: 10676 - DNA, 1008 bp, Artificial Sequence
  Description of Artificial Sequence: Synthetic coding sequence
atgctgggcatctggaccctgctgcccctggtgctgaccagcgtggccagactgagcagcaagagcgtgaacgcccaggtgaccgacatcaacagcaagggcctggagctgagaaagaccgtgaccaccgtggagacccagaacctggagggcctgcaccacgacggccagttctgccacaagccctgcccccccggcgagagaaaggccagagactgcaccgtgaacggcgacgagcccgactgcgtgccctgccaggagggcaaggagtacaccgacaaggcccacttcagcagcaagtgcagaagatgcagactgtgcgacgagggccacggcctggaggtggagatcaactgcaccagaacccagaacaccaagtgcagatgcaagcccaacttcttctgcaacagcaccgtgtgcgagcactgcgacccctgcaccaagtgcgagcacggcatcatcaaggagtgcaccctgaccagcaacaccaagtgcaaggaggagggcagcagaagcaacctgggctggctgtgcctgctgctgctgcccatccccctgatcgtgtgggtgaagagaaaggaggtgcagaagacctgcagaaagcacagaaaggagaaccagggcagccacgagagccccaccctgaaccccgagaccgtggccatcaacctgagcgacgtggacctgagcaagtacatcaccaccatcgccggcgtgatgaccctgagccaggtgaagggcttcgtgagaaagaacggcgtgaacgaggccaagatcgacgagatcaagaacgacaacgtgcaggacaccgccgagcagaaggtgcagctgctgagaaactggcaccagctgcacggcaagaaggaggcctacgacaccctgatcaaggacctgaagaaggccaacctgtgcaccctggccgagaagatccagaccatcatcctgaaggacatcaccagcgacagcgagaacagcaacttcagaaacgagatccagagcctggtgtag

SEQ ID NO: 10677 - DNA, 945 bp, Artificial Sequence
  Description of Artificial Sequence: Synthetic coding sequence
atgctgggcatctggaccctgctgcccctggtgctgaccagcgtggccagactgagcagcaagagcgtgaacgcccaggtgaccgacatcaacagcaagggcctggagctgagaaagaccgtgaccaccgtggagacccagaacctggagggcctgcaccacgacggccagttctgccacaagccctgcccccccggcgagagaaaggccagagactgcaccgtgaacggcgacgagcccgactgcgtgccctgccaggagggcaaggagtacaccgacaaggcccacttcagcagcaagtgcagaagatgcagactgtgcgacgagggccacggcctggaggtggagatcaactgcaccagaacccagaacaccaagtgcagatgcaagcccaacttcttctgcaacagcaccgtgtgcgagcactgcgacccctgcaccaagtgcgagcacggcatcatcaaggagtgcaccctgaccagcaacaccaagtgcaaggaggaggtgaagagaaaggaggtgcagaagacctgcagaaagcacagaaaggagaaccagggcagccacgagagccccaccctgaaccccgagaccgtggccatcaacctgagcgacgtggacctgagcaagtacatcaccaccatcgccggcgtgatgaccctgagccaggtgaagggcttcgtgagaaagaacggcgtgaacgaggccaagatcgacgagatcaagaacgacaacgtgcaggacaccgccgagcagaaggtgcagctgctgagaaactggcaccagctgcacggcaagaaggaggcctacgacaccctgatcaaggacctgaagaaggccaacctgtgcaccctggccgagaagatccagaccatcatcctgaaggacatcaccagcgacagcgagaacagcaacttcagaaacgagatccagagcctggtgtag

SEQ ID NO: 10678 - DNA, 735 bp, Artificial Sequence
  Description of Artificial Sequence: Synthetic coding sequence
atgctgggcatctggaccctgctgcccctggtgctgaccagcgtggccagactgagcagcaagagcgtgaacgcccaggtgaccgacatcaacagcaagggcctggagctgagaaagaccgtgaccaccgtggagacccagaacctggagggcctgcaccacgacggccagttctgccacaagccctgcccccccggcgagagaaaggccagagactgcaccgtgaacggcgacgagcccgactgcgtgccctgccaggagggcaaggagtacaccgacaaggcccacttcagcagcaagtgcagaagatgcagactgtgcgacgagggccacggcctggaggtggagatcaactgcaccagaacccagaacaccaagtgcagatgcaagcccaacttcttctgcaacagcaccgtgtgcgagcactgcgacccctgcaccaagtgcgagcacggcatcatcaaggagtgcaccctgaccagcaacaccaagtgcaaggaggagggcagcagaagcaacctgggctggctgtgcctgctgctgctgcccatccccctgatcgtgtgggtgaagagaaaggaggtgcagaagacctgcagaaagcacagaaaggagaaccagggcagccacgagagccccaccctgaaccccgagaccgtggccatcaacctgagcgacgtggacctgagcaagtaccaccactactgctggagccacgacaccaagagcagctag

SEQ ID NO: 10679 - DNA, 1089 bp, Artificial Sequence
  Description of Artificial Sequence: Synthetic coding sequence
atgctgagagtgtgcgcccagggctggcacgcccagggcctgccccacggcaccaacagcctgctgaagggcggcaccgagaccagcctgagcacccccaccagactggtggtgctgaccagcgtggccagactgagcagcaagagcgtgaacgcccaggtgaccgacatcaacagcaagggcctggagctgagaaagaccgtgaccaccgtggagacccagaacctggagggcctgcaccacgacggccagttctgccacaagccctgcccccccggcgagagaaaggccagagactgcaccgtgaacggcgacgagcccgactgcgtgccctgccaggagggcaaggagtacaccgacaaggcccacttcagcagcaagtgcagaagatgcagactgtgcgacgagggccacggcctggaggtggagatcaactgcaccagaacccagaacaccaagtgcagatgcaagcccaacttcttctgcaacagcaccgtgtgcgagcactgcgacccctgcaccaagtgcgagcacggcatcatcaaggagtgcaccctgaccagcaacaccaagtgcaaggaggagggcagcagaagcaacctgggctggctgtgcctgctgctgctgcccatccccctgatcgtgtgggtgaagagaaaggaggtgcagaagacctgcagaaagcacagaaaggagaaccagggcagccacgagagccccaccctgaaccccgtgggcatcgagatcgacttcagcgacgtggacctgagcaagtacatcaccaccatcgccggcgtgatgaccctgagccaggtgaagggcttcgtgagaaagaacggcgtgaacgaggccaagatcgacgagatcaagaacgacaacgtgcaggacaccgccgagcagaaggtgcagctgctgagaaactggcaccagctgcacggcaagaaggaggcctacgacaccctgatcaaggacctgaagaaggccaacctgtgcaccctggccgagaagatccagaccatcatcctgaaggacatcaccagcgacagcgagaacagcaacttcagaaacgagatccagagcctggtgtag

SEQ ID NO: 10680 - DNA, 627 bp, Artificial Sequence
  Description of Artificial Sequence: Synthetic coding sequence
atggaccccttcctggtgctgctgcacagcgtgagcagcagcctgagcagcagcgagctgaccgagctgaagttcctgtgcctgggcagagtgggcaagagaaagctggagagagtgcagagcggcctggacctgttcagcatgctgctggagcagaacgacctggagcccggccacaccgagctgctgagagagctgctggccagcctgagaagacacgacctgctgagaagagtggacgacttcgaggccggcgccgccgccggcgccgcccccggcgaggaggacctgtgcgccgccttcaacgtgatctgcgacaacgtgggcaaggactggagaagactggccagacagctgaaggtgagcgacaccaagatcgacagcatcgaggacagataccccagaaacctgaccgagagagtgagagagagcctgagaatctggaagaacaccgagaaggagaacgccaccgtggcccacctggtgggcgccctgagaagctgccagatgaacctggtggccgacctggtgcaggaggtgcagcaggccagagacctgcagaacagaagcggcgccatgagccccatgagctggaacagcgacgccagcaccagcgaggccagctag

SEQ ID NO: 10681 - DNA, 384 bp, Artificial Sequence
  Description of Artificial Sequence: Synthetic coding sequence
atgcagcagcccttcaactacccctacccccagatctactgggtggacagcagcgccagcagcccctgggccccccccggcaccgtgctgccctgccccaccagcgtgcccagaagacccggccagagaagacccccccccccccccccccccccccccctgccccccccccccccccccccccccctgccccccctgcccctgccccccctgaagaagagaggcaaccacagcaccggcctgtgcctgctggtgatgttcttcatggtgctggtggccctggtgggcctgggcctgggcatgttccagctgttccacctgcagaaggagctggccgagctgagagaggccacccccgtgcaccccctgaagaagagaagctag

SEQ ID NO: 10682 - DNA, 846 bp, Artificial Sequence
  Description of Artificial Sequence: Synthetic coding sequence
atgcagcagcccttcaactacccctacccccagatctactgggtggacagcagcgccagcagcccctgggccccccccggcaccgtgctgccctgccccaccagcgtgcccagaagacccggccagagaagacccccccccccccccccccccccccccctgccccccccccccccccccccccccctgccccccctgcccctgccccccctgaagaagagaggcaaccacagcaccggcctgtgcctgctggtgatgttcttcatggtgctggtggccctggtgggcctgggcctgggcatgttccagctgttccacctgcagaaggagctggccgagctgagagagagcaccagccagatgcacaccgccagcagcctggagaagcagatcggccaccccagccccccccccgagaagaaggagctgagaaaggtggcccacctgaccggcaagagcaacagcagaagcatgcccctggagtgggaggacacctacggcatcgtgctgctgagcggcgtgaagtacaagaagggcggcctggtgatcaacgagaccggcctgtacttcgtgtacagcaaggtgtacttcagaggccagagctgcaacaacctgcccctgagccacaaggtgtacatgagaaacagcaagtacccccaggacctggtgatgatggagggcaagatgatgagctactgcaccaccggccagatgtgggccagaagcagctacctgggcgccgtgttcaacctgaccagcgccgaccacctgtacgtgaacgtgagcgagctgagcctggtgaacttcgaggagagccagaccttcttcggcctgtacaagctgtag

SEQ ID NO: 10683 - DNA, 13773 bp, Artificial Sequence
  Description of Artificial Sequence: Synthetic coding sequence
atgggcagacacctggccctgctgctgctgctgctgctgctgttccagcacttcggcgacagcgacggcagccagagactggagcagacccccctgcagttcacccacctggagtacaacgtgaccgtgcaggagaacagcgccgccaagacctacgtgggccaccccgtgaagatgggcgtgtacatcacccaccccgcctgggaggtgagatacaagatcgtgagcggcgacagcgagaacctgttcaaggccgaggagtacatcctgggcgacttctgcttcctgagaatcagaaccaagggcggcaacaccgccatcctgaacagagaggtgaaggaccactacaccctgatcgtgaaggccctggagaagaacaccaacgtggaggccagaaccaaggtgagagtgcaggtgctggacaccaacgacctgagacccctgttcagccccaccagctacagcgtgagcctgcccgagaacaccgccatcagaaccagcatcgccagagtgagcgccaccgacgccgacatcggcaccaacggcgagttctactacagcttcaaggacagaaccgacatgttcgccatccaccccaccagcggcgtgatcgtgctgaccggcagactggactacctggagaccaagctgtacgagatggagatcctggccgccgacagaggcatgaagctgtacggcagcagcggcatcagcagcatggccaagctgaccgtgcacatcgagcaggccaacgagtgcgcccccgtgatcaccgccgtgaccctgagccccagcgagctggacagagaccccgcctacgccatcgtgaccgtggacgactgcgaccagggcgccaacggcgacatcgccagcctgagcatcgtggccggcgacctgctgcagcagttcagaaccgtgagaagcttccccggcagcaaggagtacaaggtgaaggccatcggcggcatcgactgggacagccaccccttcggctacaacctgaccctgcaggccaaggacaagggcacccccccccagttcagcagcgtgaaggtgatccacgtgaccagcccccagttcaaggccggccccgtgaagttcgagaaggacgtgtacagagccgagatcagcgagttcgccccccccaacacccccgtggtgatggtgaaggccatccccgcctacagccacctgagatacgtgttcaagagcacccccggcaaggccaagttcagcctgaactacaacaccggcctgatcagcatcctggagcccgtgaagagacagcaggccgcccacttcgagctggaggtgaccaccagcgacagaaaggccagcaccaaggtgctggtgaaggtgctgggcgccaacagcaacccccccgagttcacccagaccgcctacaaggccgccttcgacgagaacgtgcccatcggcaccaccgtgatgagcctgagcgccgtggaccccgacgagggcgagaacggctacgtgacctacagcatcgccaacctgaaccacgtgcccttcgccatcgaccacttcaccggcgccgtgagcaccagcgagaacctggactacgagctgatgcccagagtgtacaccctgagaatcagagccagcgactggggcctgccctacagaagagaggtggaggtgctggccaccatcaccctgaacaacctgaacgacaacacccccctgttcgagaagatcaactgcgagggcaccatccccagagacctgggcgtgggcgagcagatcaccaccgtgagcgccatcgacgccgacgagctgcagctggtgcagtaccagatcgaggccggcaacgagctggacttcttcagcctgaaccccaacagcggcgtgctgagcctgaagagaagcctgatggacggcctgggcgccaaggtgagcttccacagcctgagaatcaccgccaccgacggcgagaacttcgccacccccctgtacatcaacatcaccgtggccgccagccacaagctggtgaacctgcagtgcgaggagaccggcgtggccaagatgctggccgagaagctgctgcaggccaacaagctgcacaaccagggcgaggtggaggacatcttcttcgacagccacagcgtgaacgcccacatcccccagttcagaagcaccctgcccaccggcatccaggtgaaggagaaccagcccgtgggcagcagcgtgatcttcatgaacagcaccgacctggacaccggcttcaacggcaagctggtgtacgccgtgagcggcggcaacgaggacagctgcttcatgatcgacatggagaccggcatgctgaagatcctgagccccctggacagagagaccaccgacaagtacaccctgaacatcaccgtgtacgacctgggcatcccccagaaggccgcctggagactgctgcacgtggtggtggtggacgccaacgacaacccccccgagttcctgcaggagagctacttcgtggaggtgagcgaggacaaggaggtgcacagcgagatcatccaggtggaggccaccgacaaggacctgggccccaacggccacgtgacctacagcatcgtgaccgacaccgacaccttcagcatcgacagcgtgaccggcgtggtgaacatcgccagacccctggacagagagctgcagcacgagcacagcctgaagatcgaggccagagaccaggccagagaggagccccagctgttcagcaccgtggtggtgaaggtgagcctggaggacgtgaacgacaacccccccaccttcatcccccccaactacagagtgaaggtgagagaggacctgcccgagggcaccgtgatcatgtggctggaggcccacgaccccgacctgggccagagcggccaggtgagatacagcctgctggaccacggcgagggcaacttcgacgtggacaagctgagcggcgccgtgagaatcgtgcagcagctggacttcgagaagaagcaggtgtacaacctgaccgtgagagccaaggacaagggcaagcccgtgagcctgagcagcacctgctacgtggaggtggaggtggtggacgtgaacgagaacctgcacccccccgtgttcagcagcttcgtggagaagggcaccgtgaaggaggacgcccccgtgggcagcctggtgatgaccgtgagcgcccacgacgaggacgccagaagagacggcgagatcagatacagcatcagagacggcagcggcgtgggcgtgttcaagatcggcgaggagaccggcgtgatcgagaccagcgacagactggacagagagagcaccagccactactggctgaccgtgttcgccaccgaccagggcgtggtgcccctgagcagcttcatcgagatctacatcgaggtggaggacgtgaacgacaacgccccccagaccagcgagcccgtgtactaccccgagatcatggagaacagccccaaggacgtgagcgtggtgcagatcgaggccttcgaccccgacagcagcagcaacgacaagctgatgtacaagatcaccagcggcaacccccagggcttcttcagcatccaccccaagaccggcctgatcaccaccaccagcagaaagctggacagagagcagcaggacgagcacatcctggaggtgaccgtgaccgacaacggcagcccccccaagagcaccatcgccagagtgatcgtgaagatcctggacgagaacgacaacaagccccagttcctgcagaagttctacaagatcagactgcccgagagagagaagcccgacagagagagaaacgccagaagagagcccctgtaccacgtgatcgccaccgacaaggacgagggccccaacgccgagatcagctacagcatcgaggacggcaacgagcacggcaagttcttcatcgagcccaagaccggcgtggtgagcagcaagagattcagcgccgccggcgagtacgacatcctgagcatcaaggccgtggacaacggcagaccccagaagagcagcaccaccagactgcacatcgagtggatcagcaagcccaagcccagcctggagcccatcagcttcgaggagagcttcttcaccttcaccgtgatggagagcgaccccgtggcccacatgatcggcgtgatcagcgtggagccccccggcatccccctgtggttcgacatcaccggcggcaactacgacagccacttcgacgtggacaagggcaccggcaccatcatcgtggccaagcccctggacgccgagcagaagagcaactacaacctgaccgtggaggccaccgacggcaccaccaccatcctgacccaggtgttcatcaaggtgatcgacaccaacgaccacagaccccagttcagcaccagcaagtacgaggtggtgatccccgaggacaccgcccccgagaccgagatcctgcagatcagcgccgtggaccaggacgagaagaacaagctgatctacaccctgcagagcagcagagaccccctgagcctgaagaagttcagactggaccccgccaccggcagcctgtacaccagcgagaagctggaccacgaggccgtgcccgcccacctgaccgtgatggtgagagaccaggacgtgcccgtgaagagaaacttcgccagaatcgtggtgaacgtgagcgacaccaacgaccacgccccctggttcaccgccagcagctacaagggcagagtgtacgagagcgccgccgtgggcagcgtggtgctgcaggtgaccgccctggacaaggacaagggcaagaacgccgaggtgctgtacagcatcgagagcggcaccttcggcaacatcggcaacagcttcatgatcgaccccgtgctgggcagcatcaagaccgccaaggagctggacagaagcaaccaggccgagtacgacctgatggtgaaggccaccgacaagggcagcccccccatgagcgagatcaccagcgtgagaatcttcgtgaccatcgccgacaacgccagccccaagttcaccagcaaggagtacagcgtggagctgagcgagaccgtgagcatcggcagcttcgtgggcatggtgaccgcccacagccagagcagcgtggtgtacgagatcaaggacggcaacaccggcgacgccttcgacatcaacccccacagcggcaccatcatcacccagaaggccctggacttcgagaccctgcccatctacaccctgatcatccagggcaccaacatggccggcctgagcaccaacaccaccgtgctggtgcacctgcaggacgagaacgacaacgcccccgtgttcatgcaggccgagtacaccggcctgatcagcgagagcgccagcatcaacagcgtggtgctgaccgacagaaacgtgcccctggtgatcagagccgccgacgccgacaaggacagcaacgccctgctggtgtaccacatcgtggagcccagcgtgcacacctacttcgccatcgacagcagcaccggcgccatccacaccgtgctgagcctggactacgaggagaccagcatcttccacttcaccgtgcaggtgcacgacatgggcacccccagactgttcgccgagtacgccgccaacgtgaccgtgcacgtgatcgacatcaacgactgcccccccgtgttcgccaagcccctgtacgaggccagcctgctgctgcccacctacaagggcgtgaaggtgatcaccgtgaacgccaccgacgccgacagcagcgccttcagccagctgatctacagcatcaccgagggcaacatcggcgagaagttcagcatggactacaagaccggcgccctgaccgtgcagaacaccacccagctgagaagcagatacgagctgaccgtgagagccagcgacggcagattcgccggcctgaccagcgtgaagatcaacgtgaaggagagcaaggagagccacctgaagttcacccaggacgtgtacagcgccgtggtgaaggagaacagcaccgaggccgagaccctggccgtgatcaccgccatcggcaaccccatcaacgagcccctgttctaccacatcctgaaccccgacagaagattcaagatcagcagaaccagcggcgtgctgagcaccaccggcacccccttcgacagagagcagcaggaggccttcgacgtggtggtggaggtgaccgaggagcacaagcccagcgccgtggcccacgtggtggtgaaggtgatcgtggaggaccagaacgacaacgcccccgtgttcgtgaacctgccctactacgccgtggtgaaggtggacaccgaggtgggccacgtgatcagatacgtgaccgccgtggacagagacagcggcagaaacggcgaggtgcactactacctgaaggagcaccacgagcacttccagatcggccccctgggcgagatcagcctgaagaagcagttcgagctggacaccctgaacaaggagtacctggtgaccgtggtggccaaggacggcggcaaccccgccttcagcgccgaggtgatcgtgcccatcaccgtgatgaacaaggccatgcccgtgttcgagaagcccttctacagcgccgagatcgccgagagcatccaggtgcacagccccgtggtgcacgtgcaggccaacagccccgagggcctgaaggtgttctacagcatcaccgacggcgaccccttcagccagttcaccatcaacttcaacaccggcgtgatcaacgtgatcgcccccctggacttcgaggcccaccccgcctacaagctgagcatcagagccaccgacagcctgaccggcgcccacgccgaggtgttcgtggacatcatcgtggacgacatcaacgacaacccccccgtgttcgcccagcagagctacgccgtgaccctgagcgaggccagcgtgatcggcaccagcgtggtgcaggtgagagccaccgacagcgacagcgagcccaacagaggcatcagctaccagatgttcggcaaccacagcaagagccacgaccacttccacgtggacagcagcaccggcctgatcagcctgctgagaaccctggactacgagcagagcagacagcacaccatcttcgtgagagccgtggacggcggcatgcccaccctgagcagcgacgtgatcgtgaccgtggacgtgaccgacctgaacgacaacccccccctgttcgagcagcagatctacgaggccagaatcagcgagcacgccccccacggccacttcgtgacctgcgtgaaggcctacgacgccgacagcagcgacatcgacaagctgcagtacagcatcctgagcggcaacgaccacaagcacttcgtgatcgacagcgccaccggcatcatcaccctgagcaacctgcacagacacgccctgaagcccttctacagcctgaacctgagcgtgagcgacggcgtgttcagaagcagcacccaggtgcacgtgaccgtgatcggcggcaacctgcacagccccgccttcctgcagaacgagtacgaggtggagctggccgagaacgcccccctgcacaccctggtgatggaggtgaagaccaccgacggcgacagcggcatctacggccacgtgacctaccacatcgtgaacgacttcgccaaggacagattctacatcaacgagagaggccagatcttcaccctggagaagctggacagagagacccccgccgagaaggtgatcagcgtgagactgatggccaaggacgccggcggcaaggtggccttctgcaccgtgaacgtgatcctgaccgacgacaacgacaacgccccccagttcagagccaccaagtacgaggtgaacatcggcagcagcgccgccaagggcaccagcgtggtgaaggtgctggccagcgacgccgacgagggcagcaacgccgacatcacctacgccatcgaggccgacagcgagagcgtgaaggagaacctggagatcaacaagctgagcggcgtgatcaccaccaaggagagcctgatcggcctggagaacgagttcttcaccttcttcgtgagagccgtggacaacggcagccccagcaaggagagcgtggtgctggtgtacgtgaagatcctgccccccgagatgcagctgcccaagttcagcgagcccttctacaccttcaccgtgagcgaggacgtgcccatcggcaccgagatcgacctgatcagagccgagcacagcggcaccgtgctgtacagcctggtgaagggcaacacccccgagagcaacagagacgagagcttcgtgatcgacagacagagcggcagactgaagctggagaagagcctggaccacgagaccaccaagtggtaccagttcagcatcctggccagatgcacccaggacgaccacgagatggtggccagcgtggacgtgagcatccaggtgaaggacgccaacgacaacagccccgtgttcgagagcagcccctacgaggccttcatcgtggagaacctgcccggcggcagcagagtgatccagatcagagccagcgacgccgacagcggcaccaacggccaggtgatgtacagcctggaccagagccagagcgtggaggtgatcgagagcttcgccatcaacatggagaccggctggatcaccaccctgaaggagctggaccacgagaagagagacaactaccagatcaaggtggtggccagcgaccacggcgagaagatccagctgagcagcaccgccatcgtggacgtgaccgtgaccgacgtgaacgacagcccccccagattcaccgccgagatctacaagggcaccgtgagcgaggacgacccccagggcggcgtgatcgccatcctgagcaccaccgacgccgacagcgaggagatcaacagacaggtgacctacttcatcaccggcggcgaccccctgggccagttcgccgtggagaccatccagaacgagtggaaggtgtacgtgaagaagcccctggacagagagaagagagacaactacctgctgaccatcaccgccaccgacggcaccttcagcagcaaggccatcgtggaggtgaaggtgctggacgccaacgacaacagccccgtgtgcgagaagaccctgtacagcgacaccatccccgaggacgtgctgcccggcaagctgatcatgcagatcagcgccaccgacgccgacatcagaagcaacgccgagatcacctacaccctgctgggcagcggcgccgagaagttcaagctgaaccccgacaccggcgagctgaagaccagcacccccctggacagagaggagcaggccgtgtaccacctgctggtgagagccaccgacggcggcggcagattctgccaggccagcatcgtgctgaccctggaggacgtgaacgacaacgcccccgagttcagcgccgacccctacgccatcaccgtgttcgagaacaccgagcccggcaccctgctgaccagagtgcaggccaccgacgccgacgccggcctgaacagaaagatcctgtacagcctgatcgacagcgccgacggccagttcagcatcaacgagctgagcggcatcatccagctggagaagcccctggacagagagctgcaggccgtgtacaccctgagcctgaaggccgtggaccagggcctgcccagaagactgaccgccaccggcaccgtgatcgtgagcgtgctggacatcaacgacaacccccccgtgttcgagtacagagagtacggcgccaccgtgagcgaggacatcctggtgggcaccgaggtgctgcaggtgtacgccgccagcagagacatcgaggccaacgccgagatcacctacagcatcatcagcggcaacgagcacggcaagttcagcatcgacagcaagaccggcgccgtgttcatcatcgagaacctggactacgagagcagccacgagtactacctgaccgtggaggccaccgacggcggcacccccagcctgagcgacgtggccaccgtgaacgtgaacgtgaccgacatcaacgacaacacccccgtgttcagccaggacacctacaccaccgtgatcagcgaggacgccgtgctggagcagagcgtgatcaccgtgatggccgacgacgccgacggccccagcaacagccacatccactacagcatcatcgacggcaaccagggcagcagcttcaccatcgaccccgtgagaggcgaggtgaaggtgaccaagctgctggacagagagaccatcagcggctacaccctgaccgtgcaggccagcgacaacggcagcccccccagagtgaacaccaccaccgtgaacatcgacgtgagcgacgtgaacgacaacgcccccgtgttcagcagaggcaactacagcgtgatcatccaggagaacaagcccgtgggcttcagcgtgctgcagctggtggtgaccgacgaggacagcagccacaacggcccccccttcttcttcaccatcgtgaccggcaacgacgagaaggccttcgaggtgaacccccagggcgtgctgctgaccagcagcgccatcaagagaaaggagaaggaccactacctgctgcaggtgaaggtggccgacaacggcaagccccagctgagcagcctgacctacatcgacatcagagtgatcgaggagagcatctacccccccgccatcctgcccctggagatcttcatcaccagcagcggcgaggagtacagcggcggcgtgatcggcaagatccacgccaccgaccaggacgtgtacgacaccctgacctacagcctggacccccagatggacaacctgttcagcgtgagcagcaccggcggcaagctgatcgcccacaagaagctggacatcggccagtacctgctgaacgtgagcgtgaccgacggcaagttcaccaccgtggccgacatcaccgtgcacatcagacaggtgacccaggagatgctgaaccacaccatcgccatcagattcgccaacctgacccccgaggagttcgtgggcgactactggagaaacttccagagagccctgagaaacatcctgggcgtgagaagaaacgacatccagatcgtgagcctgcagagcagcgagccccacccccacctggacgtgctgctgttcgtggagaagcccggcagcgcccagatcagcaccaagcagctgctgcacaagatcaacagcagcgtgaccgacatcgaggagatcatcggcgtgagaatcctgaacgtgttccagaagctgtgcgccggcctggactgcccctggaagttctgcgacgagaaggtgagcgtggacgagagcgtgatgagcacccacagcaccgccagactgagcttcgtgacccccagacaccacagagccgccgtgtgcctgtgcaaggagggcagatgcccccccgtgcaccacggctgcgaggacgacccctgccccgagggcagcgagtgcgtgagcgacccctgggaggagaagcacacctgcgtgtgccccagcggcagattcggccagtgccccggcagcagcagcatgaccctgaccggcaacagctacgtgaagtacagactgaccgagaacgagaacaagctggagatgaagctgaccatgagactgagaacctacagcacccacgccgtggtgatgtacgccagaggcaccgactacagcatcctggagatccaccacggcagactgcagtacaagttcgactgcggcagcggccccggcatcgtgagcgtgcagagcatccaggtgaacgacggccagtggcacgccgtggccctggaggtgaacggcaactacgccagactggtgctggaccaggtgcacaccgccagcggcaccgcccccggcaccctgaagaccctgaacctggacaactacgtgttcttcggcggccacatcagacagcagggcaccagacacggcagaagcccccaggtgggcaacggcttcagaggctgcatggacagcatctacctgaacggccaggagctgcccctgaacagcaagcccagaagctacgcccacatcgaggagagcgtggacgtgagccccggctgcttcctgaccgccaccgaggactgcgccagcaacccctgccagaacggcggcgtgtgcaaccccagccccgccggcggctactactgcaagtgcagcgccctgtacatcggcacccactgcgagatcagcgtgaacccctgcagcagcaagccctgcctgtacggcggcacctgcgtggtggacaacggcggcttcgtgtgccagtgcagaggcctgtacaccggccagagatgccagctgagcccctactgcaaggacgagccctgcaagaacggcggcacctgcttcgacagcctggacggcgccgtgtgccagtgcgacagcggcttcagaggcgagagatgccagagcgacatcgacgagtgcagcggcaacccctgcctgcacggcgccctgtgcgagaacacccacggcagctaccactgcaactgcagccacgagtacagaggcagacactgcgaggacgccgcccccaaccagtacgtgagcaccccctggaacatcggcctggccgagggcatcggcatcgtggtgttcgtggccggcatcttcctgctggtggtggtgttcgtgctgtgcagaaagatgatcagcagaaagaagaagcaccaggccgagcccaaggacaagcacctgggccccgccaccgccttcctgcagagaccctacttcgacagcaagctgaacaagaacatctacagcgacatccccccccaggtgcccgtgagacccatcagctacacccccagcatccccagcgacagcagaaacaacctggacagaaacagcttcgagggcagcgccatccccgagcaccccgagttcagcaccttcaaccccgagagcgtgcacggccacagaaaggccgtggccgtgtgcagcgtggcccccaacctgcccccccccccccccagcaacagccccagcgacagcgacagcatccagaagcccagctgggacttcgactacgacaccaaggtggtggacctggacccctgcctgagcaagaagcccctggaggagaagcccagccagccctacagcgccagagagagcctgagcgaggtgcagagcctgagcagcttccagagcgagagctgcgacgacaacggctaccactgggacaccagcgactggatgcccagcgtgcccctgcccgacatccaggagttccccaactacgaggtgatcgacgagcagacccccctgtacagcgccgaccccaacgccatcgacaccgactactaccccggcggctacgacatcgagagcgacttcccccccccccccgaggacttccccgccgccgacgagctgccccccctgccccccgagttcagcaaccagttcgagagcatccacccccccagagacatgcccgccgccggcagcctgggcagcagcagcagaaacagacagagattcaacctgaaccagtacctgcccaacttctaccccctggacatgagcgagccccagaccaagggcaccggcgagaacagcacctgcagagagccccacgccccctacccccccggctaccagagacacttcgaggcccccgccgtggagagcatgcccatgagcgtgtacgccagcaccgccagctgcagcgacgtgagcgcctgctgcgaggtggagagcgaggtgatgatgagcgactacgagagcggcgacgacggccacttcgaggaggtgaccatcccccccctggacagccagcagcacaccgaggtgtag

SEQ ID NO: 10684 - DNA, 13767 bp, Artificial Sequence
  Description of Artificial Sequence: Synthetic coding sequence
atgggcagacacctggccctgctgctgctgctgctgctgctgttccagcacttcggcgacagcgacggcagccagagactggagcagacccccctgcagttcacccacctggagtacaacgtgaccgtgcaggagaacagcgccgccaagacctacgtgggccaccccgtgaagatgggcgtgtacatcacccaccccgcctgggaggtgagatacaagatcgtgagcggcgacagcgagaacctgttcaaggccgaggagtacatcctgggcgacttctgcttcctgagaatcagaaccaagggcggcaacaccgccatcctgaacagagaggtgaaggaccactacaccctgatcgtgaaggccctggagaagaacaccaacgtggaggccagaaccaaggtgagagtgcaggtgctggacaccaacgacctgagacccctgttcagccccaccagctacagcgtgagcctgcccgagaacaccgccatcagaaccagcatcgccagagtgagcgccaccgacgccgacatcggcaccaacggcgagttctactacagcttcaaggacagaaccgacatgttcgccatccaccccaccagcggcgtgatcgtgctgaccggcagactggactacctggagaccaagctgtacgagatggagatcctggccgccgacagaggcatgaagctgtacggcagcagcggcatcagcagcatggccaagctgaccgtgcacatcgagcaggccaacgagtgcgcccccgtgatcaccgccgtgaccctgagccccagcgagctggacagagaccccgcctacgccatcgtgaccgtggacgactgcgaccagggcgccaacggcgacatcgccagcctgagcatcgtggccggcgacctgctgcagcagttcagaaccgtgagaagcttccccggcagcaaggagtacaaggtgaaggccatcggcggcatcgactgggacagccaccccttcggctacaacctgaccctgcaggccaaggacaagggcacccccccccagttcagcagcgtgaaggtgatccacgtgaccagcccccagttcaaggccggccccgtgaagttcgagaaggacgtgtacagagccgagatcagcgagttcgccccccccaacacccccgtggtgatggtgaaggccatccccgcctacagccacctgagatacgtgttcaagagcacccccggcaaggccaagttcagcctgaactacaacaccggcctgatcagcatcctggagcccgtgaagagacagcaggccgcccacttcgagctggaggtgaccaccagcgacagaaaggccagcaccaaggtgctggtgaaggtgctgggcgccaacagcaacccccccgagttcacccagaccgcctacaaggccgccttcgacgagaacgtgcccatcggcaccaccgtgatgagcctgagcgccgtggaccccgacgagggcgagaacggctacgtgacctacagcatcgccaacctgaaccacgtgcccttcgccatcgaccacttcaccggcgccgtgagcaccagcgagaacctggactacgagctgatgcccagagtgtacaccctgagaatcagagccagcgactggggcctgccctacagaagagaggtggaggtgctggccaccatcaccctgaacaacctgaacgacaacacccccctgttcgagaagatcaactgcgagggcaccatccccagagacctgggcgtgggcgagcagatcaccaccgtgagcgccatcgacgccgacgagctgcagctggtgcagtaccagatcgaggccggcaacgagctggacttcttcagcctgaaccccaacagcggcgtgctgagcctgaagagaagcctgatggacggcctgggcgccaaggtgagcttccacagcctgagaatcaccgccaccgacggcgagaacttcgccacccccctgtacatcaacatcaccgtggccgccagccacaagctggtgaacctgcagtgcgaggagaccggcgtggccaagatgctggccgagaagctgctgcaggccaacaagctgcacaaccagggcgaggtggaggacatcttcttcgacagccacagcgtgaacgcccacatcccccagttcagaagcaccctgcccaccggcatccaggtgaaggagaaccagcccgtgggcagcagcgtgatcttcatgaacagcaccgacctggacaccggcttcaacggcaagctggtgtacgccgtgagcggcggcaacgaggacagctgcttcatgatcgacatggagaccggcatgctgaagatcctgagccccctggacagagagaccaccgacaagtacaccctgaacatcaccgtgtacgacctgggcatcccccagaaggccgcctggagactgctgcacgtggtggtggtggacgccaacgacaacccccccgagttcctgcaggagagctacttcgtggaggtgagcgaggacaaggaggtgcacagcgagatcatccaggtggaggccaccgacaaggacctgggccccaacggccacgtgacctacagcatcgtgaccgacaccgacaccttcagcatcgacagcgtgaccggcgtggtgaacatcgccagacccctggacagagagctgcagcacgagcacagcctgaagatcgaggccagagaccaggccagagaggagccccagctgttcagcaccgtggtggtgaaggtgagcctggaggacgtgaacgacaacccccccaccttcatcccccccaactacagagtgaaggtgagagaggacctgcccgagggcaccgtgatcatgtggctggaggcccacgaccccgacctgggccagagcggccaggtgagatacagcctgctggaccacggcgagggcaacttcgacgtggacaagctgagcggcgccgtgagaatcgtgcagcagctggacttcgagaagaagcaggtgtacaacctgaccgtgagagccaaggacaagggcaagcccgtgagcctgagcagcacctgctacgtggaggtggaggtggtggacgtgaacgagaacctgcacccccccgtgttcagcagcttcgtggagaagggcaccgtgaaggaggacgcccccgtgggcagcctggtgatgaccgtgagcgcccacgacgaggacgccagaagagacggcgagatcagatacagcatcagagacggcagcggcgtgggcgtgttcaagatcggcgaggagaccggcgtgatcgagaccagcgacagactggacagagagagcaccagccactactggctgaccgtgttcgccaccgaccagggcgtggtgcccctgagcagcttcatcgagatctacatcgaggtggaggacgtgaacgacaacgccccccagaccagcgagcccgtgtactaccccgagatcatggagaacagccccaaggacgtgagcgtggtgcagatcgaggccttcgaccccgacagcagcagcaacgacaagctgatgtacaagatcaccagcggcaacccccagggcttcttcagcatccaccccaagaccggcctgatcaccaccaccagcagaaagctggacagagagcagcaggacgagcacatcctggaggtgaccgtgaccgacaacggcagcccccccaagagcaccatcgccagagtgatcgtgaagatcctggacgagaacgacaacaagccccagttcctgcagaagttctacaagatcagactgcccgagagagagaagcccgacagagagagaaacgccagaagagagcccctgtaccacgtgatcgccaccgacaaggacgagggccccaacgccgagatcagctacagcatcgaggacggcaacgagcacggcaagttcttcatcgagcccaagaccggcgtggtgagcagcaagagattcagcgccgccggcgagtacgacatcctgagcatcaaggccgtggacaacggcagaccccagaagagcagcaccaccagactgcacatcgagtggatcagcaagcccaagcccagcctggagcccatcagcttcgaggagagcttcttcaccttcaccgtgatggagagcgaccccgtggcccacatgatcggcgtgatcagcgtggagccccccggcatccccctgtggttcgacatcaccggcggcaactacgacagccacttcgacgtggacaagggcaccggcaccatcatcgtggccaagcccctggacgccgagcagaagagcaactacaacctgaccgtggaggccaccgacggcaccaccaccatcctgacccaggtgttcatcaaggtgatcgacaccaacgaccacagaccccagttcagcaccagcaagtacgaggtggtgatccccgaggacaccgcccccgagaccgagatcctgcagatcagcgccgtggaccaggacgagaagaacaagctgatctacaccctgcagagcagcagagaccccctgagcctgaagaagttcagactggaccccgccaccggcagcctgtacaccagcgagaagctggaccacgaggccgtgcaccagcacaccctgaccgtgatggtgagagaccaggacgtgcccgtgaagagaaacttcgccagaatcgtggtgaacgtgagcgacaccaacgaccacgccccctggttcaccgccagcagctacaagggcagagtgtacgagagcgccgccgtgggcagcgtggtgctgcaggtgaccgccctggacaaggacaagggcaagaacgccgaggtgctgtacagcatcgagagcggcaacatcggcaacagcttcatgatcgaccccgtgctgggcagcatcaagaccgccaaggagctggacagaagcaaccaggccgagtacgacctgatggtgaaggccaccgacaagggcagcccccccatgagcgagatcaccagcgtgagaatcttcgtgaccatcgccgacaacgccagccccaagttcaccagcaaggagtacagcgtggagctgagcgagaccgtgagcatcggcagcttcgtgggcatggtgaccgcccacagccagagcagcgtggtgtacgagatcaaggacggcaacaccggcgacgccttcgacatcaacccccacagcggcaccatcatcacccagaaggccctggacttcgagaccctgcccatctacaccctgatcatccagggcaccaacatggccggcctgagcaccaacaccaccgtgctggtgcacctgcaggacgagaacgacaacgcccccgtgttcatgcaggccgagtacaccggcctgatcagcgagagcgccagcatcaacagcgtggtgctgaccgacagaaacgtgcccctggtgatcagagccgccgacgccgacaaggacagcaacgccctgctggtgtaccacatcgtggagcccagcgtgcacacctacttcgccatcgacagcagcaccggcgccatccacaccgtgctgagcctggactacgaggagaccagcatcttccacttcaccgtgcaggtgcacgacatgggcacccccagactgttcgccgagtacgccgccaacgtgaccgtgcacgtgatcgacatcaacgactgcccccccgtgttcgccaagcccctgtacgaggccagcctgctgctgcccacctacaagggcgtgaaggtgatcaccgtgaacgccaccgacgccgacagcagcgccttcagccagctgatctacagcatcaccgagggcaacatcggcgagaagttcagcatggactacaagaccggcgccctgaccgtgcagaacaccacccagctgagaagcagatacgagctgaccgtgagagccagcgacggcagattcgccggcctgaccagcgtgaagatcaacgtgaaggagagcaaggagagccacctgaagttcacccaggacgtgtacagcgccgtggtgaaggagaacagcaccgaggccgagaccctggccgtgatcaccgccatcggcaaccccatcaacgagcccctgttctaccacatcctgaaccccgacagaagattcaagatcagcagaaccagcggcgtgctgagcaccaccggcacccccttcgacagagagcagcaggaggccttcgacgtggtggtggaggtgaccgaggagcacaagcccagcgccgtggcccacgtggtggtgaaggtgatcgtggaggaccagaacgacaacgcccccgtgttcgtgaacctgccctactacgccgtggtgaaggtggacaccgaggtgggccacgtgatcagatacgtgaccgccgtggacagagacagcggcagaaacggcgaggtgcactactacctgaaggagcaccacgagcacttccagatcggccccctgggcgagatcagcctgaagaagcagttcgagctggacaccctgaacaaggagtacctggtgaccgtggtggccaaggacggcggcaaccccgccttcagcgccgaggtgatcgtgcccatcaccgtgatgaacaaggccatgcccgtgttcgagaagcccttctacagcgccgagatcgccgagagcatccaggtgcacagccccgtggtgcacgtgcaggccaacagccccgagggcctgaaggtgttctacagcatcaccgacggcgaccccttcagccagttcaccatcaacttcaacaccggcgtgatcaacgtgatcgcccccctggacttcgaggcccaccccgcctacaagctgagcatcagagccaccgacagcctgaccggcgcccacgccgaggtgttcgtggacatcatcgtggacgacatcaacgacaacccccccgtgttcgcccagcagagctacgccgtgaccctgagcgaggccagcgtgatcggcaccagcgtggtgcaggtgagagccaccgacagcgacagcgagcccaacagaggcatcagctaccagatgttcggcaaccacagcaagagccacgaccacttccacgtggacagcagcaccggcctgatcagcctgctgagaaccctggactacgagcagagcagacagcacaccatcttcgtgagagccgtggacggcggcatgcccaccctgagcagcgacgtgatcgtgaccgtggacgtgaccgacctgaacgacaacccccccctgttcgagcagcagatctacgaggccagaatcagcgagcacgccccccacggccacttcgtgacctgcgtgaaggcctacgacgccgacagcagcgacatcgacaagctgcagtacagcatcctgagcggcaacgaccacaagcacttcgtgatcgacagcgccaccggcatcatcaccctgagcaacctgcacagacacgccctgaagcccttctacagcctgaacctgagcgtgagcgacggcgtgttcagaagcagcacccaggtgcacgtgaccgtgatcggcggcaacctgcacagccccgccttcctgcagaacgagtacgaggtggagctggccgagaacgcccccctgcacaccctggtgatggaggtgaagaccaccgacggcgacagcggcatctacggccacgtgacctaccacatcgtgaacgacttcgccaaggacagattctacatcaacgagagaggccagatcttcaccctggagaagctggacagagagacccccgccgagaaggtgatcagcgtgagactgatggccaaggacgccggcggcaaggtggccttctgcaccgtgaacgtgatcctgaccgacgacaacgacaacgccccccagttcagagccaccaagtacgaggtgaacatcggcagcagcgccgccaagggcaccagcgtggtgaaggtgctggccagcgacgccgacgagggcagcaacgccgacatcacctacgccatcgaggccgacagcgagagcgtgaaggagaacctggagatcaacaagctgagcggcgtgatcaccaccaaggagagcctgatcggcctggagaacgagttcttcaccttcttcgtgagagccgtggacaacggcagccccagcaaggagagcgtggtgctggtgtacgtgaagatcctgccccccgagatgcagctgcccaagttcagcgagcccttctacaccttcaccgtgagcgaggacgtgcccatcggcaccgagatcgacctgatcagagccgagcacagcggcaccgtgctgtacagcctggtgaagggcaacacccccgagagcaacagagacgagagcttcgtgatcgacagacagagcggcagactgaagctggagaagagcctggaccacgagaccaccaagtggtaccagttcagcatcctggccagatgcacccaggacgaccacgagatggtggccagcgtggacgtgagcatccaggtgaaggacgccaacgacaacagccccgtgttcgagagcagcccctacgaggccttcatcgtggagaacctgcccggcggcagcagagtgatccagatcagagccagcgacgccgacagcggcaccaacggccaggtgatgtacagcctggaccagagccagagcgtggaggtgatcgagagcttcgccatcaacatggagaccggctggatcaccaccctgaaggagctggaccacgagaagagagacaactaccagatcaaggtggtggccagcgaccacggcgagaagatccagctgagcagcaccgccatcgtggacgtgaccgtgaccgacgtgaacgacagcccccccagattcaccgccgagatctacaagggcaccgtgagcgaggacgacccccagggcggcgtgatcgccatcctgagcaccaccgacgccgacagcgaggagatcaacagacaggtgacctacttcatcaccggcggcgaccccctgggccagttcgccgtggagaccatccagaacgagtggaaggtgtacgtgaagaagcccctggacagagagaagagagacaactacctgctgaccatcaccgccaccgacggcaccttcagcagcaaggccatcgtggaggtgaaggtgctggacgccaacgacaacagccccgtgtgcgagaagaccctgtacagcgacaccatccccgaggacgtgctgcccggcaagctgatcatgcagatcagcgccaccgacgccgacatcagaagcaacgccgagatcacctacaccctgctgggcagcggcgccgagaagttcaagctgaaccccgacaccggcgagctgaagaccagcacccccctggacagagaggagcaggccgtgtaccacctgctggtgagagccaccgacggcggcggcagattctgccaggccagcatcgtgctgaccctggaggacgtgaacgacaacgcccccgagttcagcgccgacccctacgccatcaccgtgttcgagaacaccgagcccggcaccctgctgaccagagtgcaggccaccgacgccgacgccggcctgaacagaaagatcctgtacagcctgatcgacagcgccgacggccagttcagcatcaacgagctgagcggcatcatccagctggagaagcccctggacagagagctgcaggccgtgtacaccctgagcctgaaggccgtggaccagggcctgcccagaagactgaccgccaccggcaccgtgatcgtgagcgtgctggacatcaacgacaacccccccgtgttcgagtacagagagtacggcgccaccgtgagcgaggacatcctggtgggcaccgaggtgctgcaggtgtacgccgccagcagagacatcgaggccaacgccgagatcacctacagcatcatcagcggcaacgagcacggcaagttcagcatcgacagcaagaccggcgccgtgttcatcatcgagaacctggactacgagagcagccacgagtactacctgaccgtggaggccaccgacggcggcacccccagcctgagcgacgtggccaccgtgaacgtgaacgtgaccgacatcaacgacaacacccccgtgttcagccaggacacctacaccaccgtgatcagcgaggacgccgtgctggagcagagcgtgatcaccgtgatggccgacgacgccgacggccccagcaacagccacatccactacagcatcatcgacggcaaccagggcagcagcttcaccatcgaccccgtgagaggcgaggtgaaggtgaccaagctgctggacagagagaccatcagcggctacaccctgaccgtgcaggccagcgacaacggcagcccccccagagtgaacaccaccaccgtgaacatcgacgtgagcgacgtgaacgacaacgcccccgtgttcagcagaggcaactacagcgtgatcatccaggagaacaagcccgtgggcttcagcgtgctgcagctggtggtgaccgacgaggacagcagccacaacggcccccccttcttcttcaccatcgtgaccggcaacgacgagaaggccttcgaggtgaacccccagggcgtgctgctgaccagcagcgccatcaagagaaaggagaaggaccactacctgctgcaggtgaaggtggccgacaacggcaagccccagctgagcagcctgacctacatcgacatcagagtgatcgaggagagcatctacccccccgccatcctgcccctggagatcttcatcaccagcagcggcgaggagtacagcggcggcgtgatcggcaagatccacgccaccgaccaggacgtgtacgacaccctgacctacagcctggacccccagatggacaacctgttcagcgtgagcagcaccggcggcaagctgatcgcccacaagaagctggacatcggccagtacctgctgaacgtgagcgtgaccgacggcaagttcaccaccgtggccgacatcaccgtgcacatcagacaggtgacccaggagatgctgaaccacaccatcgccatcagattcgccaacctgacccccgaggagttcgtgggcgactactggagaaacttccagagagccctgagaaacatcctgggcgtgagaagaaacgacatccagatcgtgagcctgcagagcagcgagccccacccccacctggacgtgctgctgttcgtggagaagcccggcagcgcccagatcagcaccaagcagctgctgcacaagatcaacagcagcgtgaccgacatcgaggagatcatcggcgtgagaatcctgaacgtgttccagaagctgtgcgccggcctggactgcccctggaagttctgcgacgagaaggtgagcgtggacgagagcgtgatgagcacccacagcaccgccagactgagcttcgtgacccccagacaccacagagccgccgtgtgcctgtgcaaggagggcagatgcccccccgtgcaccacggctgcgaggacgacccctgccccgagggcagcgagtgcgtgagcgacccctgggaggagaagcacacctgcgtgtgccccagcggcagattcggccagtgccccggcagcagcagcatgaccctgaccggcaacagctacgtgaagtacagactgaccgagaacgagaacaagctggagatgaagctgaccatgagactgagaacctacagcacccacgccgtggtgatgtacgccagaggcaccgactacagcatcctggagatccaccacggcagactgcagtacaagttcgactgcggcagcggccccggcatcgtgagcgtgcagagcatccaggtgaacgacggccagtggcacgccgtggccctggaggtgaacggcaactacgccagactggtgctggaccaggtgcacaccgccagcggcaccgcccccggcaccctgaagaccctgaacctggacaactacgtgttcttcggcggccacatcagacagcagggcaccagacacggcagaagcccccaggtgggcaacggcttcagaggctgcatggacagcatctacctgaacggccaggagctgcccctgaacagcaagcccagaagctacgcccacatcgaggagagcgtggacgtgagccccggctgcttcctgaccgccaccgaggactgcgccagcaacccctgccagaacggcggcgtgtgcaaccccagccccgccggcggctactactgcaagtgcagcgccctgtacatcggcacccactgcgagatcagcgtgaacccctgcagcagcaagccctgcctgtacggcggcacctgcgtggtggacaacggcggcttcgtgtgccagtgcagaggcctgtacaccggccagagatgccagctgagcccctactgcaaggacgagccctgcaagaacggcggcacctgcttcgacagcctggacggcgccgtgtgccagtgcgacagcggcttcagaggcgagagatgccagagcgacatcgacgagtgcagcggcaacccctgcctgcacggcgccctgtgcgagaacacccacggcagctaccactgcaactgcagccacgagtacagaggcagacactgcgaggacgccgcccccaaccagtacgtgagcaccccctggaacatcggcctggccgagggcatcggcatcgtggtgttcgtggccggcatcttcctgctggtggtggtgttcgtgctgtgcagaaagatgatcagcagaaagaagaagcaccaggccgagcccaaggacaagcacctgggccccgccaccgccttcctgcagagaccctacttcgacagcaagctgaacaagaacatctacagcgacatccccccccaggtgcccgtgagacccatcagctacacccccagcatccccagcgacagcagaaacaacctggacagaaacagcttcgagggcagcgccatccccgagcaccccgagttcagcaccttcaaccccgagagcgtgcacggccacagaaaggccgtggccgtgtgcagcgtggcccccaacctgcccccccccccccccagcaacagccccagcgacagcgacagcatccagaagcccagctgggacttcgactacgacaccaaggtggtggacctggacccctgcctgagcaagaagcccctggaggagaagcccagccagccctacagcgccagagagagcctgagcgaggtgcagagcctgagcagcttccagagcgagagctgcgacgacaacggctaccactgggacaccagcgactggatgcccagcgtgcccctgcccgacatccaggagttccccaactacgaggtgatcgacgagcagacccccctgtacagcgccgaccccaacgccatcgacaccgactactaccccggcggctacgacatcgagagcgacttcccccccccccccgaggacttccccgccgccgacgagctgccccccctgccccccgagttcagcaaccagttcgagagcatccacccccccagagacatgcccgccgccggcagcctgggcagcagcagcagaaacagacagagattcaacctgaaccagtacctgcccaacttctaccccctggacatgagcgagccccagaccaagggcaccggcgagaacagcacctgcagagagccccacgccccctacccccccggctaccagagacacttcgaggcccccgccgtggagagcatgcccatgagcgtgtacgccagcaccgccagctgcagcgacgtgagcgcctgctgcgaggtggagagcgaggtgatgatgagcgactacgagagcggcgacgacggccacttcgaggaggtgaccatcccccccctggacagccagcagcacaccgaggtgtag

SEQ ID NO: 10685 - DNA, 1467 bp, Artificial Sequence
  Description of Artificial Sequence: Synthetic coding sequence
atgggcagacacctggccctgctgctgctgctgctgctgctgttccagcacttcggcgacagcgacggcagccagagactggagcagacccccctgcagttcacccacctggagtacaacgtgaccgtgcaggagaacagcgccgccaagacctacgtgggccaccccgtgaagatgggcgtgtacatcacccaccccgcctgggaggtgagatacaagatcgtgagcggcgacagcgagaacctgttcaaggccgaggagtacatcctgggcgacttctgcttcctgagaatcagaaccaagggcggcaacaccgccatcctgaacagagaggtgaaggaccactacaccctgatcgtgaaggccctggagaagaacaccaacgtggaggccagaaccaaggtgagagtgcaggtgctggacaccaacgacctgagacccctgttcagccccaccagctacagcgtgagcctgcccgagaacaccgccatcagaaccagcatcgccagagtgagcgccaccgacgccgacatcggcaccaacggcgagttctactacagcttcaaggacagaaccgacatgttcgccatccaccccaccagcggcgtgatcgtgctgaccggcagactggactacctggagaccaagctgtacgagatggagatcctggccgccgacagaggcatgaagctgtacggcagcagcggcatcagcagcatggccaagctgaccgtgcacatcgagcaggccaacgagtgcgcccccgtgatcaccgccgtgaccctgagccccagcgagctggacagagaccccgcctacgccatcgtgaccgtggacgactgcgaccagggcgccaacggcgacatcgccagcctgagcatcgtggccggcgacctgctgcagcagttcagaaccgtgagaagcttccccggcagcaaggagtacaaggtgaaggccatcggcggcatcgactgggacagccaccccttcggctacaacctgaccctgcaggccaaggacaagggcacccccccccagttcagcagcgtgaaggtgatccacgtgaccagcccccagttcaaggccggccccgtgaagttcgagaaggacgtgtacagagccgagatcagcgagttcgccccccccaacacccccgtggtgatggtgaaggccatccccgcctacagccacctgagatacgtgttcaagagcacccccggcaaggccaagttcagcctgaactacaacaccggcctgatcagcatcctggagcccgtgaagagacagcaggccgcccacttcgagctggaggtgaccaccagcgacagaaaggccagcaccaaggtgctggtgaaggtgctgggcgccaacagcaacccccccgagttcacccagaccgcctacaaggccgccttcgacgagaacgtgcccatcggcaccaccgtgatgagcctgagcgccgtgtag

SEQ ID NO: 10686 - DNA, 399 bp, Artificial Sequence
  Description of Artificial Sequence: Synthetic coding sequence
atgtgcgacgccttcgtgggcacctggaagctggtgagcagcgagaacttcgacgactacatgaaggaggtgggcgtgggcttcgccaccagaaaggtggccggcatggccaagcccaacatgatcatcagcgtgaacggcgacgtgatcaccatcaagagcgagagcaccttcaagaacaccgagatcagcttcatcctgggccaggagttcgacgaggtgaccgccgacgacagaaaggtgaagagcaccatcaccctggacggcggcgtgctggtgcacgtgcagaagtgggacggcaagagcaccaccatcaagagaaagagagaggacgacaagctggtggtggagtgcgtgatgaagggcgtgaccagcaccagagtgtacgagagagcctag

SEQ ID NO: 10687 - DNA, 7536 bp, Artificial Sequence
  Description of Artificial Sequence: Synthetic coding sequence
atggaggaggtggtgatcgccggcatgagcggcaagctgcccgagagcgagaacctgcaggagttctgggacaacctgatcggcggcgtggacatggtgaccgacgacgacagaagatggaaggccggcctgtacggcctgcccagaagaagcggcaagctgaaggacctgagcagattcgacgccagcttcttcggcgtgcaccccaagcaggcccacaccatggacccccagctgagactgctgctggaggtgacctacgaggccatcgtggacggcggcatcaaccccgacagcctgagaggcacccacaccggcgtgtgggtgggcgtgagcggcagcgagaccagcgaggccctgagcagagaccccgagaccctggtgggctacagcatggtgggctgccagagagccatgatggccaacagactgagcttcttcttcgacttcagaggccccagcatcgccctggacaccgcctgcagcagcagcctgatggccctgcagaacgcctaccaggccatccacagcggccagtgccccgccgccatcgtgggcggcatcaacgtgctgctgaagcccaacaccagcgtgcagttcctgagactgggcatgctgagccccgagggcacctgcaaggccttcgacaccgccggcaacggctactgcagaagcgagggcgtggtggccgtgctgctgaccaagaagagcctggccagaagagtgtacgccaccatcctgaacgccggcaccaacaccgacggcttcaaggagcagggcgtgaccttccccagcggcgacatccaggagcagctgatcagaagcctgtaccagagcgccggcgtggcccccgagagcttcgagtacatcgaggcccacggcaccggcaccaaggtgggcgacccccaggagctgaacggcatcaccagagccctgtgcgccaccagacaggagcccctgctgatcggcagcaccaagagcaacatgggccaccccgagcccgccagcggcctggccgccctggccaaggtgctgctgagcctggagcacggcctgtgggcccccaacctgcacttccacagccccaaccccgagatccccgccctgctggacggcagactgcaggtggtggaccagcccctgcccgtgagaggcggcaacgtgggcatcaacagcttcggcttcggcggcagcaacgtgcacatcatcctgagacccaacacccagcccccccccgcccccgccccccacgccaccctgcccagactgctgagagccagcggcagaacccccgaggccgtgcagaagctgctggagcagggcctgagacacagccaggacctggccttcctgagcatgctgaacgacatcgccgccgtgcccgccaccgccatgcccttcagaggctacgccgtgctgggcggcgagagaggcggccccgaggtgcagcaggtgcccgccggcgagagacccctgtggttcatctgcagcggcatgggcacccagtggagaggcatgggcctgagcctgatgagactggacagattcagagacagcatcctgagaagcgacgaggccgtgaagcccttcggcctgaaggtgagccagctgctgctgagcaccgacgagagcaccttcgacgacatcgtgcacagcttcgtgagcctgaccgccatccagatcggcctgatcgacctgctgagctgcatgggcctgagacccgacggcatcgtgggccacagcctgggcgaggtggcctgcggctacgccgacggctgcctgagccaggaggaggccgtgctggccgcctactggagaggccagtgcatcaaggaggcccacctgccccccggcgccatggccgccgtgggcctgagctgggaggagtgcaagcagagatgcccccccggcgtggtgcccgcctgccacaacagcaaggacaccgtgaccatcagcggcccccaggcccccgtgttcgagttcgtggagcagctgagaaaggagggcgtgttcgccaaggaggtgagaaccggcggcatggccttccacagctacttcatggaggccatcgccccccccctgctgcaggagctgaagaaggtgatcagagagcccaagcccagaagcgccagatggctgagcaccagcatccccgaggcccagtggcacagcagcctggccagaaccagcagcgccgagtacaacgtgaacaacctggtgagccccgtgctgttccaggaggccctgtggcacgtgcccgagcacgccgtggtgctggagatcgccccccacgccctgctgcaggccgtgctgaagagaggcctgaagcccagctgcaccatcatccccctgatgaagaaggaccacagagacaacctggagttcttcctggccggcatcggcagactgcacctgagcggcatcgacgccaaccccaacgccctgttcccccccgtggagttccccgcccccagaggcacccccctgatcagccccctgatcaagtgggaccacagcctggcctgggacgtgcccgccgccgaggacttccccaacggcagcggcagccccagcgccgccatctacaacatcgacaccagcagcgagagccccgaccactacctggtggaccacaccctggacggcagagtgctgttccccgccaccggctacctgagcatcgtgtggaagaccctggccagagccctgggcctgggcgtggagcagctgcccgtggtgttcgaggacgtggtgctgcaccaggccaccatcctgcccaagaccggcaccgtgagcctggaggtgagactgctggaggccagcagagccttcgaggtgagcgagaacggcaacctggtggtgagcggcaaggtgtaccagtgggacgaccccgaccccagactgttcgaccaccccgagagccccacccccaaccccaccgagcccctgttcctggcccaggccgaggtgtacaaggagctgagactgagaggctacgactacggcccccacttccagggcatcctggaggccagcctggagggcgacagcggcagactgctgtggaaggacaactgggtgagcttcatggacaccatgctgcagatgagcatcctgggcagcgccaagcacggcctgtacctgcccaccagagtgaccgccatccacatcgaccccgccacccacagacagaagctgtacaccctgcaggacaaggcccaggtggccgacgtggtggtgagcagatggctgagagtgaccgtggccggcggcgtgcacatcagcggcctgcacaccgagagcgcccccagaagacagcaggagcagcaggtgcccatcctggagaagttctgcttcaccccccacaccgaggagggctgcctgagcgagagagccgccctgcaggaggagctgcagctgtgcaagggcctggtgcaggccctgcagaccaaggtgacccagcagggcctgaagatggtggtgcccggcctggacggcgcccagatccccagagaccccagccagcaggagctgcccagactgctgagcgccgcctgcagactgcagctgaacggcaacctgcagctggagctggcccaggtgctggcccaggagagacccaagctgcccgaggaccccctgctgagcggcctgctggacagccccgccctgaaggcctgcctggacaccgccgtggagaacatgcccagcctgaagatgaaggtggtggaggtgctggccggccacggccacctgtacagcagaatccccggcctgctgagcccccaccccctgctgcagctgagctacaccgccaccgacagacacccccaggccctggaggccgcccaggccgagctgcagcagcacgacgtggcccagggccagtgggaccccgccgaccccgcccccagcgccctgggcagcgccgacctgctggtgtgcaactgcgccgtggccgccctgggcgaccccgccagcgccctgagcaacatggtggccgccctgagagagggcggcttcctgctgctgcacaccctgctgagaggccaccccctgggcgacatcgtggccttcctgaccagcaccgagccccagtacggccagggcatcctgagccaggacgcctgggagagcctgttcagcagagtgagcctgagactggtgggcctgaagaagagcttctacggcagcaccctgttcctgtgcagaagacccaccccccaggacagccccatcttcctgcccgtggacgacaccagcttcagatgggtggagagcctgaagggcatcctggccgacgaggacagcagcagacccgtgtggctgaaggccatcaactgcgccaccagcggcgtggtgggcctggtgaactgcctgagaagagagcccggcggcaacagactgagatgcgtgctgctgagcaacctgagcagcaccagccacgtgcccgaggtggaccccggcagcgccgagctgcagaaggtgctgcagggcgacctggtgatgaacgtgtacagagacggcgcctggggcgccttcagacacttcctgctggaggaggacaagcccgaggagcccaccgcccacgccttcgtgagcaccctgaccagaggcgacctgagcagcatcagatgggtgtgcagcagcctgagacacgcccagcccacctgccccggcgcccagctgtgcaccgtgtactacgccagcctgaacttcagagacatcatgctggccaccggcaagctgagccccgacgccatccccggcaagtggaccagccaggacagcctgctgggcatggagttcagcggcagagacgccagcggcaagagagtgatgggcctggtgcccgccaagggcctggccaccagcgtgctgctgagccccgacttcctgtgggacgtgcccagcaactggaccctggaggaggccgccagcgtgcccgtggtgtacagcaccgcctactacgccctggtggtgagaggcagagtgagacccggcgagaccctgctgatccacagcggcagcggcggcgtgggccaggccgccatcgccatcgccctgagcctgggctgcagagtgttcaccaccgtgggcagcgccgagaagagagcctacctgcaggccagattcccccagctggacagcaccagcttcgccaacagcagagacaccagcttcgagcagcacgtgctgtggcacaccggcggcaagggcgtggacctggtgctgaacagcctggccgaggagaagctgcaggccagcgtgagatgcctggccacccacggcagattcctggagatcggcaagttcgacctgagccagaaccaccccctgggcatggccatcttcctgaagaacgtgaccttccacggcgtgctgctggacgccttcttcaacgagagcagcgccgactggagagaggtgtgggccctggtgcaggccggcatcagagacggcgtggtgagacccctgaagtgcaccgtgttccacggcgcccaggtggaggacgccttcagatacatggcccagggcaagcacatcggcaaggtggtggtgcaggtgctggccgaggagcccgaggccgtgctgaagggcgccaagcccaagctgatgagcgccatcagcaagaccttctgccccgcccacaagagctacatcatcgccggcggcctgggcggcttcggcctggagctggcccagtggctgatccagagaggcgtgcagaagctggtgctgaccagcagaagcggcatcagaaccggctaccaggccaagcaggtgagaagatggagaagacagggcgtgcaggtgcaggtgagcaccagcaacatcagcagcctggagggcgccagaggcctgatcgccgaggccgcccagctgggccccgtgggcggcgtgttcaacctggccgtggtgctgagagacggcctgctggagaaccagacccccgagttcttccaggacgtgtgcaagcccaagtacagcggcaccctgaacctggacagagtgaccagagaggcctgccccgagctggactacttcgtggtgttcagcagcgtgagctgcggcagaggcaacgccggccagagcaactacggcttcgccaacagcgccatggagagaatctgcgagaagagaagacacgagggcctgcccggcctggccgtgcagtggggcgccatcggcgacgtgggcatcctggtggagaccatgagcaccaacgacaccatcgtgagcggcaccctgccccagagaatggccagctgcctggaggtgctggacctgttcctgaaccagccccacatggtgctgagcagcttcgtgctggccgagaaggccgccgcctacagagacagagacagccagagagacctggtggaggccgtggcccacatcctgggcatcagagacctggccgccgtgaacctggacagcagcctggccgacctgggcctggacagcctgatgagcgtggaggtgagacagaccctggagagagagctgaacctggtgctgagcgtgagagaggtgagacagctgaccctgagaaagctgcaggagctgagcagcaaggccgacgaggccagcgagctggcctgccccacccccaaggaggacggcctggcccagcagcagacccagctgaacctgagaagcctgctggtgaaccccgagggccccaccctgatgagactgaacagcgtgcagagcagcgagagacccctgttcctggtgcaccccatcgagggcagcaccaccgtgttccacagcctggccagcagactgagcatccccacctacggcctgcagtgcaccagagccgcccccctggacagcatccacagcctggccgcctactacatcgactgcatcagacaggtgcagcccgagggcccctacagagtggccggctacagctacggcgcctgcgtggccttcgagatgtgcagccagctgcaggcccagcagagccccgcccccacccacaacagcctgttcctgttcgacggcagccccacctacgtgctggcctacacccagagctacagagccaagctgacccccggctgcgaggccgaggccgagaccgaggccatctgcttcttcgtgcagcagttcaccgacatggagcacaacagagtgctggaggccctgctgcccctgaagggcctggaggagagagtggccgccgccgtggacctgatcatcaagagccaccagggcctggacagacaggagctgagcttcgccgccagaagcttctactacaagctgagagccgccgagcagtacacccccaaggccaagtaccacggcaacgtgatgctgctgagagccaagaccggcggcgcctacggcgaggacctgggcgccgactacaacctgagccaggtgtgcgacggcaaggtgagcgtgcacgtgatcgagggcgaccacagaaccctgctggagggcagcggcctggagagcatcatcagcatcatccacagcagcctggccgagcccagagtgagcgtgagagagggctag

SEQ ID NO: 10688 - DNA, 2502 bp, Artificial Sequence
  Description of Artificial Sequence: Synthetic coding sequence
atgagcatcctgggcagcgccaagcacggcctgtacctgcccaccagagtgaccgccatccacatcgaccccgccacccacagacagaagctgtacaccctgcaggacaaggcccaggtggccgacgtggtggtgagcagatggctgagagtgaccgtggccggcggcgtgcacatcagcggcctgcacaccgagagcgcccccagaagacagcaggagcagcaggtgcccatcctggagaagttctgcttcaccccccacaccgaggagggctgcctgagcgagagagccgccctgcaggaggagctgcagctgtgcaagggcctggtgcaggccctgcagaccaaggtgacccagcagggcctgaagatggtggtgcccggcctggacggcgcccagatccccagagaccccagccagcaggagctgcccagactgctgagcgccgcctgcagactgcagctgaacggcaacctgcagctggagctggcccaggtgctggcccaggagagacccaagctgcccgaggaccccctgctgagcggcctgctggacagccccgccctgaaggcctgcctggacaccgccgtggagaacatgcccagcctgaagatgaaggtggtggaggtgctggccggccacggccacctgtacagcagaatccccggcctgctgagcccccaccccctgctgcagctgagctacaccgccaccgacagacacccccaggccctggaggccgcccaggccgagctgcagcagcacgacgtggcccagggccagtgggaccccgccgaccccgcccccagcgccctgggcagcgccgacctgctggtgtgcaactgcgccgtggccgccctgggcgaccccgccagcgccctgagcaacatggtggccgccctgagagagggcggcttcctgctgctgcacaccctgctgagaggccaccccctgggcgacatcgtggccttcctgaccagcaccgagccccagtacggccagggcatcctgagccaggacgcctgggagagcctgttcagcagagtgagcctgagactggtgggcctgaagaagagcttctacggcagcaccctgttcctgtgcagaagacccaccccccaggacagccccatcttcctgcccgtggacgacaccagcttcagatgggtggagagcctgaagggcatcctggccgacgaggacagcagcagacccgtgtggctgaaggccatcaactgcgccaccagcggcgtggtgggcctggtgaactgcctgagaagagagcccggcggcaacagactgagatgcgtgctgctgagcaacctgagcagcaccagccacgtgcccgaggtggaccccggcagcgccgagctgcagaaggtgctgcagggcgacctggtgatgaacgtgtacagagacggcgcctggggcgccttcagacacttcctgctggaggaggacaagcccgaggagcccaccgcccacgccttcgtgagcaccctgaccagaggcgacctgagcagcatcagatgggtgtgcagcagcctgagacacgcccagcccacctgccccggcgcccagctgtgcaccgtgtactacgccagcctgaacttcagagacatcatgctggccaccggcaagctgagccccgacgccatccccggcaagtggaccagccaggacagcctgctgggcatggagttcagcggcagagacgccagcggcaagagagtgatgggcctggtgcccgccaagggcctggccaccagcgtgctgctgagccccgacttcctgtgggacgtgcccagcaactggaccctggaggaggccgccagcgtgcccgtggtgtacagcaccgcctactacgccctggtggtgagaggcagagtgagacccggcgagaccctgctgatccacagcggcagcggcggcgtgggccaggccgccatcgccatcgccctgagcctgggctgcagagtgttcaccaccgtgggcagcgccgagaagagagcctacctgcaggccagattcccccagctggacagcaccagcttcgccaacagcagagacaccagcttcgagcagcacgtgctgtggcacaccggcggcaagggcgtggacctggtgctgaacagcctggccgaggagaagctgcaggccagcgtgagatgcctggccacccacggcagattcctggagatcggcaagttcgacctgagccagaaccaccccctgggcatggccatcttcctgaagaacgtgaccttccacggcgtgctgctggacgccttcttcaacgagagcagcgccgactggagagaggtgtgggccctggtgcaggccggcatcagagacggcgtggtgagacccctgaagtgcaccgtgttccacggcgcccaggtggaggacgccttcagatacatggcccaggccaaggccagccaggcctggccctgcagcggcgcccccagcgccacctgggccttctggtggagaagatag

SEQ ID NO: 10689 - DNA, 1143 bp, Artificial Sequence
  Description of Artificial Sequence: Synthetic coding sequence
atgatgttcagcggcttcaacgccgactacgaggccagcagcagcagatgcagcagcgccagccccgccggcgacagcctgagctactaccacagccccgccgacagcttcagcagcatgggcagccccgtgaacgcccaggacttctgcaccgacctggccgtgagcagcgccaacttcatccccaccgtgaccgccatcagcaccagccccgacctgcagtggctggtgcagcccgccctggtgagcagcgtggcccccagccagaccagagccccccaccccttcggcgtgcccgcccccagcgccggcgcctacagcagagccggcgtggtgaagaccatgaccggcggcagagcccagagcatcggcagaagaggcaaggtggagcagctgagccccgaggaggaggagaagagaagaatcagaagagagagaaacaagatggccgccgccaagtgcagaaacagaagaagagagctgaccgacaccctgcaggccgagaccgaccagctggaggacgagaagagcgccctgcagaccgagatcgccaacctgctgaaggagaaggagaagctggagttcatcctggccgcccacagacccgcctgcaagatccccgacgacctgggcttccccgaggagatgagcgtggccagcctggacctgaccggcggcctgcccgaggtggccacccccgagagcgaggaggccttcaccctgcccctgctgaacgaccccgagcccaagcccagcgtggagcccgtgaagagcatcagcagcatggagctgaagaccgagcccttcgacgacttcctgttccccgccagcagcagacccagcggcagcgagaccgccagaagcgtgcccgacatggacctgagcggcagcttctacgccgccgactgggagcccctgcacagcggcagcctgggcatgggccccatggccaccgagctggagcccctgtgcacccccgtggtgacctgcacccccagctgcaccgcctacaccagcagcttcgtgttcacctaccccgaggccgacagcttccccagctgcgccgccgcccacagaaagggcagcagcagcaacgagcccagcagcgacagcctgagcagccccaccctgctggccctgtag

SEQ ID NO: 10690 - DNA, 966 bp, Artificial Sequence
  Description of Artificial Sequence: Synthetic coding sequence
atggaggagggccagtacagcgagatcgaggagctgcccagaagaagatgctgcagaagaggcacccagatcgtgctgctgggcctggtgaccgccgccctgtgggccggcctgctgaccctgctgctgctgtggcactgggacaccacccagagcctgaagcagctggaggagagagccgccagaaacgtgagccaggtgagcaagaacctggagagccaccacggcgaccagatggcccagaagagccagagcacccagatcagccaggagctggaggagctgagagccgagcagcagagactgaagagccaggacctggagctgagctggaacctgaacggcctgcaggccgacctgagcagcttcaagagccaggagctgaacgagagaaacgaggccagcgacctgctggagagactgagagaggaggtgaccaagctgagaatggagctgcaggtgagcagcggcttcgtgtgcaacacctgccccgagaagtggatcaacttccagagaaagtgctactacttcggcaagggcaccaagcagtgggtgcacgccagatacgcctgcgacgacatggagggccagctggtgagcatccacagccccgaggagcaggacttcctgaccaagcacgccagccacaccggcagctggatcggcctgagaaacctggacctgaagggcgagttcatctgggtggacggcagccacgtggactacagcaactgggcccccggcgagcccaccagcagaagccagggcgaggactgcgtgatgatgagaggcagcggcagatggaacgacgccttctgcgacagaaagctgggcgcctgggtgtgcgacagactggccacctgcaccccccccgccagcgagggcagcgccgagagcatgggccccgacagcagacccgaccccgacggcagactgcccacccccagcgcccccctgcacagctag

SEQ ID NO: 10691 - DNA, 963 bp, Artificial Sequence
  Description of Artificial Sequence: Synthetic coding sequence
atgaacccccccagccaggagatcgaggagctgcccagaagaagatgctgcagaagaggcacccagatcgtgctgctgggcctggtgaccgccgccctgtgggccggcctgctgaccctgctgctgctgtggcactgggacaccacccagagcctgaagcagctggaggagagagccgccagaaacgtgagccaggtgagcaagaacctggagagccaccacggcgaccagatggcccagaagagccagagcacccagatcagccaggagctggaggagctgagagccgagcagcagagactgaagagccaggacctggagctgagctggaacctgaacggcctgcaggccgacctgagcagcttcaagagccaggagctgaacgagagaaacgaggccagcgacctgctggagagactgagagaggaggtgaccaagctgagaatggagctgcaggtgagcagcggcttcgtgtgcaacacctgccccgagaagtggatcaacttccagagaaagtgctactacttcggcaagggcaccaagcagtgggtgcacgccagatacgcctgcgacgacatggagggccagctggtgagcatccacagccccgaggagcaggacttcctgaccaagcacgccagccacaccggcagctggatcggcctgagaaacctggacctgaagggcgagttcatctgggtggacggcagccacgtggactacagcaactgggcccccggcgagcccaccagcagaagccagggcgaggactgcgtgatgatgagaggcagcggcagatggaacgacgccttctgcgacagaaagctgggcgcctgggtgtgcgacagactggccacctgcaccccccccgccagcgagggcagcgccgagagcatgggccccgacagcagacccgaccccgacggcagactgcccacccccagcgcccccctgcacagctag

SEQ ID NO: 10692 - DNA, 1125 bp, Artificial Sequence
  Description of Artificial Sequence: Synthetic coding sequence
atgtggttcctgaccaccctgctgctgtgggtgcccgtggacggccaggtggacaccaccaaggccgtgatcaccctgcagcccccctgggtgagcgtgttccaggaggagaccgtgaccctgcactgcgaggtgctgcacctgcccggcagcagcagcacccagtggttcctgaacggcaccgccacccagaccagcacccccagctacagaatcaccagcgccagcgtgaacgacagcggcgagtacagatgccagagaggcctgagcggcagaagcgaccccatccagctggagatccacagaggctggctgctgctgcaggtgagcagcagagtgttcaccgagggcgagcccctggccctgagatgccacgcctggaaggacaagctggtgtacaacgtgctgtactacagaaacggcaaggccttcaagttcttccactggaacagcaacctgaccatcctgaagaccaacatcagccacaacggcacctaccactgcagcggcatgggcaagcacagatacaccagcgccggcatcagcgtgaccgtgaaggagctgttccccgcccccgtgctgaacgccagcgtgaccagccccctgctggagggcaacctggtgaccctgagctgcgagaccaagctgctgctgcagagacccggcctgcagctgtacttcagcttctacatgggcagcaagaccctgagaggcagaaacaccagcagcgagtaccagatcctgaccgccagaagagaggacagcggcctgtactggtgcgaggccgccaccgaggacggcaacgtgctgaagagaagccccgagctggagctgcaggtgctgggcctgcagctgcccacccccgtgtggttccacgtgctgttctacctggccgtgggcatcatgttcctggtgaacaccgtgctgtgggtgaccatcagaaaggagctgaagagaaagaagaagtgggacctggagatcagcctggacagcggccacgagaagaaggtgatcagcagcctgcaggaggacagacacctggaggaggagctgaagtgccaggagcagaaggaggagcagctgcaggagggcgtgcacagaaaggagccccagggcgccacctag

SEQ ID NO: 10693 - DNA, 723 bp, Artificial Sequence
  Description of Artificial Sequence: Synthetic coding sequence
atgtggttcctgaccaccctgctgctgtggggctggctgctgctgcaggtgagcagcagagtgttcaccgagggcgagcccctggccctgagatgccacgcctggaaggacaagctggtgtacaacgtgctgtactacagaaacggcaaggccttcaagttcttccactggaacagcaacctgaccatcctgaagaccaacatcagccacaacggcacctaccactgcagcggcatgggcaagcacagatacaccagcgccggcatcagcgtgaccgtgaaggagctgttccccgcccccgtgctgaacgccagcgtgaccagccccctgctggagggcaacctggtgaccctgagctgcgagaccaagctgctgctgcagagacccggcctgcagctgtacttcagcttctacatgggcagcaagaccctgagaggcagaaacaccagcagcgagtaccagatcctgaccgccagaagagaggacagcggcctgtactggtgcgaggccgccaccgaggacggcaacgtgctgaagagaagccccgagctggagctgcaggtgctgggcctgcagctgcccacccccgtgtggttccacgtgctgttctacctggccgtgggcatcatgttcctggtgaacaccgtgctgtgggtgaccatcagaaaggagctgaagagaaagaagaagtgggacctggagatcagcctggacagcggctag

SEQ ID NO: 10694 - DNA, 2469 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagagctgggccgagatcaccagccagaccgagggcctgagcagactgctgagacagcacgccgaggacctgaacagcggccccctgagcaagctgagcctgctgatcagagagagacagcagctgagaaagacctacagcgagcagtggcagcagctgcagcaggagctgaccaagacccacagccaggacatcgagaagctgaagagccagtacagagccctggccagagacagcgcccaggccaagagaaagtaccaggaggccagcaaggacaaggacagagacaaggccaaggacaagtacgtgagaagcctgtggaagctgttcgcccaccacaacagatacgtgctgggcgtgagagccgcccagctgcaccaccagcaccaccaccagctgctgctgcccggcctgctgagaagcctgcaggacctgcacgaggagatggcctgcatcctgaaggagatcctgcaggagtacctggagatcagcagcctggtgcaggacgaggtggtggccatccacagagagatggccgccgccgccgccagaatccagcccgaggccgagtaccagggcttcctgagacagtacggcagcgcccccgacgtgcccccctgcgtgaccttcgacgagagcctgctggaggagggcgagcccctggagcccggcgagctgcagctgaacgagctgaccgtggagagcgtgcagcacaccctgaccagcgtgaccgacgagctggccgtggccaccgagatggtgttcagaagacaggagatggtgacccagctgcagcaggagctgagaaacgaggaggagaacacccaccccagagagagagtgcagctgctgggcaagagacaggtgctgcaggaggccctgcagggcctgcaggtggccctgtgcagccaggccaagctgcaggcccagcaggagctgctgcagaccaagctggagcacctgggccccggcgagcccccccccgtgctgctgctgcaggacgacagacacagcaccagcagcagcgagcaggagagagagggcggcagaacccccaccctggagatcctgaagagccacatcagcggcatcttcagacccaagttcagcctgcccccccccctgcagctgatccccgaggtgcagaagcccctgcacgagcagctgtggtaccacggcgccatccccagagccgaggtggccgagctgctggtgcacagcggcgacttcctggtgagagagagccagggcaagcaggagtacgtgctgagcgtgctgtgggacggcctgcccagacacttcatcatccagagcctggacaacctgtacagactggagggcgagggcttccccagcatccccctgctgatcgaccacctgctgagcacccagcagcccctgaccaagaagagcggcgtggtgctgcacagagccgtgcccaaggacaagtgggtgctgaaccacgaggacctggtgctgggcgagcagatcggcagaggcaacttcggcgaggtgttcagcggcagactgagagccgacaacaccctggtggccgtgaagagctgcagagagaccctgccccccgacctgaaggccaagttcctgcaggaggccagaatcctgaagcagtacagccaccccaacatcgtgagactgatcggcgtgtgcacccagaagcagcccatctacatcgtgatggagctggtgcagggcggcgacttcctgaccttcctgagaaccgagggcgccagactgagagtgaagaccctgctgcagatggtgggcgacgccgccgccggcatggagtacctggagagcaagtgctgcatccacagagacctggccgccagaaactgcctggtgaccgagaagaacgtgctgaagatcagcgacttcggcatgagcagagaggaggccgacggcgtgtacgccgccagcggcggcctgagacaggtgcccgtgaagtggaccgcccccgaggccctgaactacggcagatacagcagcgagagcgacgtgtggagcttcggcatcctgctgtgggagaccttcagcctgggcgccagcccctaccccaacctgagcaaccagcagaccagagagttcgtggagaagggcggcagactgccctgccccgagctgtgccccgacgccgtgttcagactgatggagcagtgctgggcctacgagcccggccagagacccagcttcagcaccatctaccaggagctgcagagcatcagaaagagacacagatag

SEQ ID NO: 10695 - DNA, 2295 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagacccacagccaggacatcgagaagctgaagagccagtacagagccctggccagagacagcgcccaggccaagagaaagtaccaggaggccagcaaggacaaggacagagacaaggccaaggacaagtacgtgagaagcctgtggaagctgttcgcccaccacaacagatacgtgctgggcgtgagagccgcccagctgcaccaccagcaccaccaccagctgctgctgcccggcctgctgagaagcctgcaggacctgcacgaggagatggcctgcatcctgaaggagatcctgcaggagtacctggagatcagcagcctggtgcaggacgaggtggtggccatccacagagagatggccgccgccgccgccagaatccagcccgaggccgagtaccagggcttcctgagacagtacggcagcgcccccgacgtgcccccctgcgtgaccttcgacgagagcctgctggaggagggcgagcccctggagcccggcgagctgcagctgaacgagctgaccgtggagagcgtgcagcacaccctgaccagcgtgaccgacgagctggccgtggccaccgagatggtgttcagaagacaggagatggtgacccagctgcagcaggagctgagaaacgaggaggagaacacccaccccagagagagagtgcagctgctgggcaagagacaggtgctgcaggaggccctgcagggcctgcaggtggccctgtgcagccaggccaagctgcaggcccagcaggagctgctgcagaccaagctggagcacctgggccccggcgagcccccccccgtgctgctgctgcaggacgacagacacagcaccagcagcagcgagcaggagagagagggcggcagaacccccaccctggagatcctgaagagccacatcagcggcatcttcagacccaagttcagcctgcccccccccctgcagctgatccccgaggtgcagaagcccctgcacgagcagctgtggtaccacggcgccatccccagagccgaggtggccgagctgctggtgcacagcggcgacttcctggtgagagagagccagggcaagcaggagtacgtgctgagcgtgctgtgggacggcctgcccagacacttcatcatccagagcctggacaacctgtacagactggagggcgagggcttccccagcatccccctgctgatcgaccacctgctgagcacccagcagcccctgaccaagaagagcggcgtggtgctgcacagagccgtgcccaaggacaagtgggtgctgaaccacgaggacctggtgctgggcgagcagatcggcagaggcaacttcggcgaggtgttcagcggcagactgagagccgacaacaccctggtggccgtgaagagctgcagagagaccctgccccccgacctgaaggccaagttcctgcaggaggccagaatcctgaagcagtacagccaccccaacatcgtgagactgatcggcgtgtgcacccagaagcagcccatctacatcgtgatggagctggtgcagggcggcgacttcctgaccttcctgagaaccgagggcgccagactgagagtgaagaccctgctgcagatggtgggcgacgccgccgccggcatggagtacctggagagcaagtgctgcatccacagagacctggccgccagaaactgcctggtgaccgagaagaacgtgctgaagatcagcgacttcggcatgagcagagaggaggccgacggcgtgtacgccgccagcggcggcctgagacaggtgcccgtgaagtggaccgcccccgaggccctgaactacggcagatacagcagcgagagcgacgtgtggagcttcggcatcctgctgtgggagaccttcagcctgggcgccagcccctaccccaacctgagcaaccagcagaccagagagttcgtggagaagggcggcagactgccctgccccgagctgtgccccgacgccgtgttcagactgatggagcagtgctgggcctacgagcccggccagagacccagcttcagcaccatctaccaggagctgcagagcatcagaaagagacacagatag

SEQ ID NO: 10696 - DNA, 2046 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagacccacagccaggacatcgagaagctgaagagccagtacagagccctggccagagacagcgcccaggccaagagaaagtaccaggaggccagcaaggacaaggacagagacaaggccaaggacaagtacgtgagaagcctgtggaagctgttcgcccaccacaacagatacgtgctgggcgtgagagccgcccagctgcaccaccagcaccaccaccagctgctgctgcccggcctgctgagaagcctgcaggacctgcacgaggagatggcctgcatcctgaaggagatcctgcaggagtacctggagatcagcagcctggtgcaggacgaggtggtggccatccacagagagatggccgccgccgccgccagaatccagcccgaggccgagtaccagggcttcctgagacagtacggcagcgcccccgacgtgcccccctgcgtgaccttcgacgagagcctgctggaggagggcgagcccctggagcccggcgagctgcagctgaacgagctgaccgtggagagcgtgcagcacaccctgaccagcgtgaccgacgagctggccgtggccaccgagatggtgttcagaagacaggagatggtgacccagctgcagcaggagctgagaaacgaggaggagaacacccaccccagagagagagtgcagctgctgggcaagagacaggtgctgcaggaggccctgcagggcctgcaggtggccctgtgcagccaggccaagctgcaggcccagcaggagctgctgcagaccaagctggagcacctgggccccggcgagcccccccccgtgctgctgctgcaggacgacagacacagcaccagcagcagcgagcaggagagagagggcggcagaacccccaccctggagatcctgaagagccacatcagcggcatcttcagacccaagttcagcaacctgtacagactggagggcgagggcttccccagcatccccctgctgatcgaccacctgctgagcacccagcagcccctgaccaagaagagcggcgtggtgctgcacagagccgtgcccaaggacaagtgggtgctgaaccacgaggacctggtgctgggcgagcagatcggcagaggcaacttcggcgaggtgttcagcggcagactgagagccgacaacaccctggtggccgtgaagagctgcagagagaccctgccccccgacctgaaggccaagttcctgcaggaggccagaagcagccccagcaccagcagctggagcctgtgcagaggcagcagcccccccgccggcggcgacttcctgaccttcctgagaaccgagggcgccagactgagagtgaagaccctgctgcagatggtgggcgacgccgccgccggcatggagtacctggagagcaagtgctgcatccacagagacctggccgccagaaactgcctggtgaccgagaagaacgtgctgaagatcagcgacttcggcatgagcagagaggaggccgacggcgtgtacgccgccagcggcggcctgagacaggtgcccgtgaagtggaccgcccccgaggccctgaactacggcagatacagcagcgagagcgacgtgtggagcttcggcatcctgctgtgggagaccttcagcctgggcgccagcccctaccccaacctgagcaaccagcagaccagagagttcgtggagaagggcggcagactgccctgccccgagctgtgccccgacgccgtgttcagactgatggagcagtgctgggcctacgagcccggccagagacccagcttcagcaccatctaccaggagctgcagagcatcagaaagagacacagatag

SEQ ID NO: 10697 - DNA, 2085 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagacccacagccaggacatcgagaagctgaagagccagtacagagccctggccagagacagcgcccaggccaagagaaagtaccaggaggccagcaaggacaaggacagagacaaggccaaggacaagtacgtgagaagcctgtggaagctgttcgcccaccacaacagatacgtgctgggcgtgagagccgcccagctgcaccaccagcaccaccaccagctgctgctgcccggcctgctgagaagcctgcaggacctgcacgaggagatggcctgcatcctgaaggagatcctgcaggagtacctggagatcagcagcctggtgcaggacgaggtggtggccatccacagagagatggccgccgccgccgccagaatccagcccgaggccgagtaccagggcttcctgagacagtacggcagcgcccccgacgtgcccccctgcgtgaccttcgacgagagcctgctggaggagggcgagcccctggagcccggcgagctgcagctgaacgagctgaccgtggagagcgtgcagcacaccctgaccagcgtgaccgacgagctggccgtggccaccgagatggtgttcagaagacaggagatggtgacccagctgcagcaggagctgagaaacgaggaggagaacacccaccccagagagagagtgcagctgctgggcaagagacaggtgctgcaggaggccctgcagggcctgcaggtggccctgtgcagccaggccaagctgcaggcccagcaggagctgctgcagaccaagctggagcacctgggccccggcgagcccccccccgtgctgctgctgcaggacgacagacacagcaccagcagcagcgagcaggagagagagggcggcagaacccccaccctggagatcctgaagagccacatcagcggcatcttcagacccaagttcagcaacctgtacagactggagggcgagggcttccccagcatccccctgctgatcgaccacctgctgagcacccagcagcccctgaccaagaagagcggcgtggtgctgcacagagccgtgcccaaggacaagtgggtgctgaaccacgaggacctggtgctgggcgagcagatcggcagaggcaacttcggcgaggtgttcagcggcagactgagagccgacaacaccctggtggccgtgaagagctgcagagagaccctgccccccgacctgaaggccaagttcctgcaggaggccagaatcctgaagcagtacagccaccccaacatcgtgagactgatcggcgtgtgcacccagaagcagcccatctacatcgtgatggagctggtgcagggcggcgacttcctgaccttcctgagaaccgagggcgccagactgagagtgaagaccctgctgcagatggtgggcgacgccgccgccggcatggagtacctggagagcaagtgctgcatccacagagacctggccgccagaaactgcctggtgaccgagaagaacgtgctgaagatcagcgacttcggcatgagcagagaggaggccgacggcgtgtacgccgccagcggcggcctgagacaggtgcccgtgaagtggaccgcccccgaggccctgaactacggcagatacagcagcgagagcgacgtgtggagcttcggcatcctgctgtgggagaccttcagcctgggcgccagcccctaccccaacctgagcaaccagcagaccagagagttcgtggagaagggcggcagactgccctgccccgagctgtgccccgacgccgtgttcagactgatggagcagtgctgggcctacgagcccggccagagacccagcttcagcaccatctaccaggagctgcagagcatcagaaagagacacagatag

SEQ ID NO: 10698 - DNA, 129 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagatag

SEQ ID NO: 10699 - DNA, 348 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagagctgggccgagatcaccagccagaccgagggcctgagcagactgctgagacagcacgccgaggacctgaacagcggccccctgagcaagctgagcctgctgatcagagagagacagcagctgagaaagacctag

SEQ ID NO: 10700 - DNA, 2259 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagagctgggccgagatcaccagccagaccgagggcctgagcagactgctgagacagcacgccgaggacctgaacagcggccccctgagcaagctgagcctgctgatcagagagagacagcagctgagaaagacctacagcgagcagtggcagcagctgcagcaggagctgaccaagacccacagccaggacatcgagaagctgaagagccagtacagagccctggccagagacagcgcccaggccaagagaaagtaccaggaggccagcaaggacaaggacagagacaaggccaaggacaagtacgtgagaagcctgtggaagctgttcgcccaccacaacagatacgtgctgggcgtgagagccgcccagctgcaccaccagcaccaccaccagctgctgctgcccggcctgctgagaagcctgcaggacctgcacgaggagatggcctgcatcctgaaggagatcctgcaggagtacctggagatcagcagcctggtgcaggacgaggtggtggccatccacagagagatggccgccgccgccgccagaatccagcccgaggccgagtaccagggcttcctgagacagtacggcagcgcccccgacgtgcccccctgcgtgaccttcgacgagagcctgctggaggagggcgagcccctggagcccggcgagctgcagctgaacgagctgaccgtggagagcgtgcagcacaccctgaccagcgtgaccgacgagctggccgtggccaccgagatggtgttcagaagacaggagatggtgacccagctgcagcaggagctgagaaacgaggaggagaacacccaccccagagagagagtgcagctgctgggcaagagacaggtgctgcaggaggccctgcagggcctgcaggtggccctgtgcagccaggccaagctgcaggcccagcaggagctgctgcagaccaagctggagcacctgggccccggcgagcccccccccgtgctgctgctgcaggacgacagacacagcaccagcagcagcgagcaggagagagagggcggcagaacccccaccctggagatcctgaagagccacatcagcggcatcttcagacccaagttcagcaacctgtacagactggagggcgagggcttccccagcatccccctgctgatcgaccacctgctgagcacccagcagcccctgaccaagaagagcggcgtggtgctgcacagagccgtgcccaaggacaagtgggtgctgaaccacgaggacctggtgctgggcgagcagatcggcagaggcaacttcggcgaggtgttcagcggcagactgagagccgacaacaccctggtggccgtgaagagctgcagagagaccctgccccccgacctgaaggccaagttcctgcaggaggccagaatcctgaagcagtacagccaccccaacatcgtgagactgatcggcgtgtgcacccagaagcagcccatctacatcgtgatggagctggtgcagggcggcgacttcctgaccttcctgagaaccgagggcgccagactgagagtgaagaccctgctgcagatggtgggcgacgccgccgccggcatggagtacctggagagcaagtgctgcatccacagagacctggccgccagaaactgcctggtgaccgagaagaacgtgctgaagatcagcgacttcggcatgagcagagaggaggccgacggcgtgtacgccgccagcggcggcctgagacaggtgcccgtgaagtggaccgcccccgaggccctgaactacggcagatacagcagcgagagcgacgtgtggagcttcggcatcctgctgtgggagaccttcagcctgggcgccagcccctaccccaacctgagcaaccagcagaccagagagttcgtggagaagggcggcagactgccctgccccgagctgtgccccgacgccgtgttcagactgatggagcagtgctgggcctacgagcccggccagagacccagcttcagcaccatctaccaggagctgcagagcatcagaaagagacacagatag

SEQ ID NO: 10701 - DNA, 2085 bp, Artificial Sequence; identical to SEQ ID NO: 10697
  Description of Artificial Sequence: Synthetic coding sequence

SEQ ID NO: 10702 - DNA, 444 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagagctgggccgagatcaccagccagaccgagggcctgagcagactgctgagacagcacgccgaggacctgaacagcggccccctgagcaagctgagcctgctgatcagagagagacagcagctgagaaagacctacagcgagcagtggcagcagctgcagcaggagctgaccaagacccacagccaggacatcgagaagctgaagagccagtacagagccctggccagatag

SEQ ID NO: 10703 - DNA, 1638 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagagctgggccgagatcaccagccagaccgagggcctgagcagactgctgagacagcacgccgaggacctgaacagcggccccctgagcaagctgagcctgctgatcagagagagacagcagctgagaaagacctacagcgagcagtggcagcagctgcagcaggagctgaccaagacccacagccaggacatcgagaagctgaagagccagtacagagccctggccagagacagcgcccaggccaagagaaagtaccaggaggccagcaaggacaaggacagagacaaggccaaggacaagtacgtgagaagcctgtggaagctgttcgcccaccacaacagatacgtgctgggcgtgagagccgcccagctgcaccaccagcaccaccaccagctgctgctgcccggcctgctgagaagcctgcaggacctgcacgaggagatggcctgcatcctgaaggagatcctgcaggagtacctggagatcagcagcctggtgcaggacgaggtggtggccatccacagagagatggccgccgccgccgccagaatccagcccgaggccgagtaccagggcttcctgagacagtacggcagcgcccccgacgtgcccccctgcgtgaccttcgacgagagcctgctggaggagggcgagcccctggagcccggcgagctgcagctgaacgagctgaccgtggagagcgtgcagcacaccctgaccagcgtgaccgacgagctggccgtggccaccgagatggtgttcagaagacaggagatggtgacccagctgcagcaggagctgagaaacgaggaggagaacacccaccccagagagagagtgcagctgctgggcaagagacaggtgctgcaggaggccctgcagggcctgcaggtggccctgtgcagccaggccaagctgcaggcccagcaggagctgctgcagaccaagctggagcacctgggccccggcgagcccccccccgtgctgctgctgcaggacgacagacacagcaccagcagcagcgagcaggagagagagggcggcagaacccccaccctggagatcctgaagagccacatcagcggcatcttcagacccaagttcagcctgcccccccccctgcagctgatccccgaggtgcagaagcccctgcacgagcagctgtggtaccacggcgccatccccagagccgaggtggccgagctgctggtgcacagcggcgacttcctggtgagagagagccagggcaagcaggagtacgtgctgagcgtgctgtgggacggcctgcccagacacttcatcatccaggcccacgcccccagcgagtggagactgctgacccccggccccctgccctgcagaacctgcaccgactggaagggcaaggccttcctggccttcctgtgcagcagcaccacctactag

SEQ ID NO: 10704 - DNA, 366 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccaggtgggcctgtacggcaccctggtgggcgccggctgcatctgcctgctgctgcccctgctgggcgccctgtggggcagcggctggagaagcggcagacccatgctgggcagccactgcgcccccctgcccgccagccccatctgcgccgtgtag

SEQ ID NO: 10705 - DNA, 510 bp, Artificial Sequence
  Description of Artificial Sequence: Synthetic coding sequence
atgggcttcagcagcgagctgtgcagcccccagggccacggcgtgctgcagcagatgcaggaggccgagctgagactgctggagggcatgagaaagtggatggcccagagagtgaagagcgacagagagtacgccggcctgctgcaccacatgagcctgcaggacagcggcggccagagcagagccatcagccccgacagccccatcagccagagctgggccgagatcaccagccagaccgagggcctgagcagactgctgagacagcacgccgaggacctgaacagcggccccctgagcaagctgagcctgctgatcagagagagacagcagctgagaaagacctacagcgagcagtggcagcagctgcagcaggagctgaccaagacccacagccaggacatcgagaagctgaagagccagtacagagccctggccagagacagcgcccaggccaagagaaagtaccaggaggccagcaaggacaaggacagagacaaggccaagtag

SEQ ID NO: 10706 - DNA, 2283 bp, Artificial Sequence
  Description of Artificial Sequence: Synthetic coding sequence
atgaagacctgggtgaagatcgtgttcggcgtggccaccagcgccgtgctggccctgctggtgatgtgcatcgtgctgagacccagcagagtgcacaacagcgaggagaacaccatgagagccctgaccctgaaggacatcctgaacggcaccttcagctacaagaccttcttccccaactggatcagcggccaggagtacctgcaccagagcgccgacaacaacatcgtgctgtacaacatcgagaccggccagagctacaccatcctgagcaacagaaccatgaagagcgtgaacgccagcaactacggcctgagccccgacagacagttcgtgtacctggagagcgactacagcaagctgtggagatacagctacaccgccacctactacatctacgacctgagcaacggcgagttcgtgagaggcaacgagctgcccagacccatccagtacctgtgctggagccccgtgggcagcaagctggcctacgtgtaccagaacaacatctacctgaagcagagacccggcgacccccccttccagatcaccttcaacggcagagagaacaagatcttcaacggcatccccgactgggtgtacgaggaggagatgctggccaccaagtacgccctgtggtggagccccaacggcaagttcctggcctacgccgagttcaacgacaccgacatccccgtgatcgcctacagctactacggcgacgagcagtaccccagaaccatcaacatcccctaccccaaggccggcgccaagaaccccgtggtgagaatcttcatcatcgacaccacctaccccgcctacgtgggcccccaggaggtgcccgtgcccgccatgatcgccagcagcgactactacttcagctggctgacctgggtgaccgacgagagagtgtgcctgcagtggctgaagagagtgcagaacgtgagcgtgctgagcatctgcgacttcagagaggactggcagacctgggactgccccaagacccaggagcacatcgaggagagcagaaccggctgggccggcggcttcttcgtgagcacccccgtgttcagctacgacgccatcagctactacaagatcttcagcgacaaggacggctacaagcacatccactacatcaaggacaccgtggagaacgccatccagatcaccagcggcaagtgggaggccatcaacatcttcagagtgacccaggacagcctgttctacagcagcaacgagttcgaggagtaccccggcagaagaaacatctacagaatcagcatcggcagctacccccccagcaagaagtgcgtgacctgccacctgagaaaggagagatgccagtactacaccgccagcttcagcgactacgccaagtactacgccctggtgtgctacggccccggcatccccatcagcaccctgcacgacggcagaaccgaccaggagatcaagatcctggaggagaacaaggagctggagaacgccctgaagaacatccagctgcccaaggaggagatcaagaagctggaggtggacgagatcaccctgtggtacaagatgatcctgcccccccagttcgacagaagcaagaagtaccccctgctgatccaggtgtacggcggcccctgcagccagagcgtgagaagcgtgttcgccgtgaactggatcagctacctggccagcaaggagggcatggtgatcgccctggtggacggcagaggcaccgccttccagggcgacaagctgctgtacgccgtgtacagaaagctgggcgtgtacgaggtggaggaccagatcaccgccgtgagaaagttcatcgagatgggcttcatcgacgagaagagaatcgccatctggggctggagctacggcggctacgtgagcagcctggccctggccagcggcaccggcctgttcaagtgcggcatcgccgtggcccccgtgagcagctgggagtactacgccagcgtgtacaccgagagattcatgggcctgcccaccaaggacgacaacctggagcactacaagaacagcaccgtgatggccagagccgagtacttcagaaacgtggactacctgctgatccacggcaccgccgacgacaacgtgcacttccagaacagcgcccagatcgccaaggccctggtgaacgcccaggtggacttccaggccatgtggtacagcgaccagaaccacggcctgagcggcctgagcaccaaccacctgtacacccacatgacccacttcctgaagcagtgcttcagcctgagcgactag

SEQ ID NO: 10707 - DNA, 2208 bp, Artificial Sequence
  Description of Artificial Sequence: Synthetic coding sequence
atgaagacctgggtgaagatcgtgttcggcgtggccaccagcgccgtgctggccctgctggtgatgtgcatcgtgctgagacccagcagagtgcacaacagcgaggagaacaccatgagagccctgaccctgaaggacatcctgaacggcaccttcagctacaagaccttcttccccaactggatcagcggccaggagtacctgcaccagagcgccgacaacaacatcgtgctgtacaacatcgagaccggccagagctacaccatcctgagcaacagaaccatgctgtggagatacagctacaccgccacctactacatctacgacctgagcaacggcgagttcgtgagaggcaacgagctgcccagacccatccagtacctgtgctggagccccgtgggcagcaagctggcctacgtgtaccagaacaacatctacctgaagcagagacccggcgacccccccttccagatcaccttcaacggcagagagaacaagatcttcaacggcatccccgactgggtgtacgaggaggagatgctggccaccaagtacgccctgtggtggagccccaacggcaagttcctggcctacgccgagttcaacgacaccgacatccccgtgatcgcctacagctactacggcgacgagcagtaccccagaaccatcaacatcccctaccccaaggccggcgccaagaaccccgtggtgagaatcttcatcatcgacaccacctaccccgcctacgtgggcccccaggaggtgcccgtgcccgccatgatcgccagcagcgactactacttcagctggctgacctgggtgaccgacgagagagtgtgcctgcagtggctgaagagagtgcagaacgtgagcgtgctgagcatctgcgacttcagagaggactggcagacctgggactgccccaagacccaggagcacatcgaggagagcagaaccggctgggccggcggcttcttcgtgagcacccccgtgttcagctacgacgccatcagctactacaagatcttcagcgacaaggacggctacaagcacatccactacatcaaggacaccgtggagaacgccatccagatcaccagcggcaagtgggaggccatcaacatcttcagagtgacccaggacagcctgttctacagcagcaacgagttcgaggagtaccccggcagaagaaacatctacagaatcagcatcggcagctacccccccagcaagaagtgcgtgacctgccacctgagaaaggagagatgccagtactacaccgccagcttcagcgactacgccaagtactacgccctggtgtgctacggccccggcatccccatcagcaccctgcacgacggcagaaccgaccaggagatcaagatcctggaggagaacaaggagctggagaacgccctgaagaacatccagctgcccaaggaggagatcaagaagctggaggtggacgagatcaccctgtggtacaagatgatcctgcccccccagttcgacagaagcaagaagtaccccctgctgatccaggtgtacggcggcccctgcagccagagcgtgagaagcgtgttcgccgtgaactggatcagctacctggccagcaaggagggcatggtgatcgccctggtggacggcagaggcaccgccttccagggcgacaagctgctgtacgccgtgtacagaaagctgggcgtgtacgaggtggaggaccagatcaccgccgtgagaaagttcatcgagatgggcttcatcgacgagaagagaatcgccatctggggctggagctacggcggctacgtgagcagcctggccctggccagcggcaccggcctgttcaagtgcggcatcgccgtggcccccgtgagcagctgggagtactacgccagcgtgtacaccgagagattcatgggcctgcccaccaaggacgacaacctggagcactacaagaacagcaccgtgatggccagagccgagtacttcagaaacgtggactacctgctgatccacggcaccgccgacgacaacgtgcacttccagaacagcgcccagatcgccaaggccctggtgaacgcccaggtggacttccaggccatgtggtacagcgaccagaaccacggcctgagcggcctgagcaccaaccacctgtacacccacatgacccacttcctgaagcagtgcttcagcctgagcgactag

SEQ ID NO: 10708 - DNA, 468 bp, Artificial Sequence
  Description of Artificial Sequence: Synthetic coding sequence
atggccgagggcgagatcaccaccttcaccgccctgaccgagaagttcaacctgccccccggcaactacaagaagcccaagctgctgtactgcagcaacggcggccacttcctgagaatcctgcccgacggcaccgtggacggcaccagagacagaagcgaccagcacatccagctgcagctgagcgccgagagcgtgggcgaggtgtacatcaagagcaccgagaccggccagtacctggccatggacaccgacggcctgctgtacggcagccagacccccaacgaggagtgcctgttcctggagagactggaggagaaccactacaacacctacatcagcaagaagcacgccgagaagaactggttcgtgggcctgaagaagaacggcagctgcaagagaggccccagaacccactacggccagaaggccatcctgttcctgcccctgcccgtgagcagcgactag

SEQ ID NO: 10709 - DNA, 468 bp, Artificial Sequence; identical to SEQ ID NO: 10708
  Description of Artificial Sequence: Synthetic coding sequence

SEQ ID NO: 10710 - DNA, 468 bp, Artificial Sequence; identical to SEQ ID NO: 10708
  Description of Artificial Sequence: Synthetic coding sequence

SEQ ID NO: 10711 - DNA, 177 bp, Artificial Sequence
  Description of Artificial Sequence: Synthetic coding sequence
atggccgagggcgagatcaccaccttcaccgccctgaccgagaagttcaacctgccccccggcaactacaagaagcccaagctgctgtactgcagcaacggcggccacttcctgagaatcctgcccgacggcaccgtggacggcaccagagacagaagcgaccagcacatccagtag

SEQ ID NO: 10712 - DNA, 126 bp, Artificial Sequence
  Description of Artificial Sequence: Synthetic coding sequence
atggccgagggcgagatcaccaccttcaccgccctgaccgagaagttcaacctgccccccggcaactacaagaagcccaagctgctgtactgcagcaacggcggccacttcctgagaatcctgtag

SEQ ID NO: 10713 - DNA, 468 bp, Artificial Sequence; identical to SEQ ID NO: 10708
  Description of Artificial Sequence: Synthetic coding sequence

SEQ ID NO: 10714 - DNA, 468 bp, Artificial Sequence; identical to SEQ ID NO: 10708
  Description of Artificial Sequence: Synthetic coding sequence

SEQ ID NO: 10715 - DNA, 183 bp, Artificial Sequence
  Description of Artificial Sequence: Synthetic coding sequence
atggccgagggcgagatcaccaccttcaccgccctgaccgagaagttcaacctgccccccggcaactacaagaagcccaagctgctgtactgcagcaacggcggccacttcctgagaatcctgcccgacggcaccgtggacggcaccagagacagaagcgaccagcacaccgacaccaagtag

SEQ ID NO: 10716 - DNA, 627 bp, Artificial Sequence
  Description of Artificial Sequence: Synthetic coding sequence
atgtggaagtggatcctgacccactgcgccagcgccttcccccacctgcccggctgctgctgctgctgcttcctgctgctgttcctggtgagcagcgtgcccgtgacctgccaggccctgggccaggacatggtgagccccgaggccaccaacagcagcagcagcagcttcagcagccccagcagcgccggcagacacgtgagaagctacaaccacctgcagggcgacgtgagatggagaaagctgttcagcttcaccaagtacttcctgaagatcgagaagaacggcaaggtgagcggcaccaagaaggagaactgcccctacagcatcctggagatcaccagcgtggagatcggcgtggtggccgtgaaggccatcaacagcaactactacctggccatgaacaagaagggcaagctgtacggcagcaaggagttcaacaacgactgcaagctgaaggagagaatcgaggagaacggctacaacacctacgccagcttcaactggcagcacaacggcagacagatgtacgtggccctgaacggcaagggcgcccccagaagaggccagaagaccagaagaaagaacaccagcgcccacttcctgcccatggtggtgcacagctag

SEQ ID NO: 10717 - DNA, 201 bp, Artificial Sequence
  Description of Artificial Sequence: Synthetic coding sequence
atgtggaagtggatcctgacccactgcgccagcgccttcccccacctgcccggctgctgctgctgctgcttcctgctgctgttcctggtgagcagcgtgcccgtgacctgccaggccctgggccaggacatggtgagccccgaggccaccaacagcagcagcagcagcttcagcagccccagcagcgccggcagacactag

SEQ ID NO: 10718 - DNA, 867 bp, Artificial Sequence
  Description of Artificial Sequence: Synthetic coding sequence
ctggtgggcgtgggcggcggcgacgtggaggacgtgacccccagacccggcggctgccagatcagcggcagaggcgccagaggctgcaacggcatccccggcgccgccgcctgggaggccgccctgcccagaagaagacccagaagacaccccagcgtgaaccccagaagcagagccgccggcagccccagaaccagaggcagaagaaccgaggagagacccagcggcagcagactgggcgacagaggcagaggcagagccctgcccggcggcagactgggcggcagaggcagaggcagagcccccgagagagtgggcggcagaggcagaggcagaggcaccgccgcccccagagccgcccccgccgccagaggcagcagacccggccccgccggcaccatggccgccggcagcatcaccaccctgcccgccctgcccgaggacggcggcagcggcgccttcccccccggccacttcaaggaccccaagagactgtactgcaagaacggcggcttcttcctgagaatccaccccgacggcagagtggacggcgtgagagagaagagcgacccccacatcaagctgcagctgcaggccgaggagagaggcgtggtgagcatcaagggcgtgtgcgccaacagatacctggccatgaaggaggacggcagactgctggccagcaagtgcgtgaccgacgagtgcttcttcttcgagagactggagagcaacaactacaacacctacagaagcagaaagtacaccagctggtacgtggccctgaagagaaccggccagtacaagctgggcagcaagaccggccccggccagaaggccatcctgttcctgcccatgagcgccaagagctag

SEQ ID NO: 10719 - DNA, 585 bp, Artificial Sequence
  Description of Artificial Sequence: Synthetic coding sequence
atgcacaagtggatcctgacctggatcctgcccaccctgctgtacagaagctgcttccacatcatctgcctggtgggcaccatcagcctggcctgcaacgacatgacccccgagcagatggccaccaacgtgaactgcagcagccccgagagacacaccagaagctacgactacatggagggcggcgacatcagagtgagaagactgttctgcagaacccagtggtacctgagaatcgacaagagaggcaaggtgaagggcacccaggagatgaagaacaactacaacatcatggagatcagaaccgtggccgtgggcatcgtggccatcaagggcgtggagagcgagttctacctggccatgaacaaggagggcaagctgtacgccaagaaggagtgcaacgaggactgcaacttcaaggagctgatcctggagaaccactacaacacctacgccagcgccaagtggacccacaacggcggcgagatgttcgtggccctgaaccagaagggcatccccgtgagaggcaagaagaccaagaaggagcagaagaccgcccacttcctgcccatggccatcacctag

SEQ ID NO: 10720 - DNA, 585 bp, Artificial Sequence; identical to SEQ ID NO: 10719
  Description of Artificial Sequence: Synthetic coding sequence

SEQ ID NO: 10721 - DNA, 705 bp, Artificial Sequence
  Description of Artificial Sequence: Synthetic coding sequence
atgaagatctgcagcctgaccctgctgagcttcctgctgctggccgcccaggtgctgctggtggagggcaagaagaaggtgaagaacggcctgcacagcaaggtggtgagcgagcagaaggacaccctgggcaacacccagatcaagcagaagagcagacccggcaacaagggcaagttcgtgaccaaggaccaggccaactgcagatgggccgccaccgagcaggaggagggcatcagcctgaaggtggagtgcacccagctggaccacgagttcagctgcgtgttcgccggcaaccccaccagctgcctgaagctgaaggacgagagagtgtactggaagcaggtggccagaaacctgagaagccagaaggacatctgcagatacagcaagaccgccgtgaagaccagagtgtgcagaaaggacttccccgagagcagcctgaagctggtgagcagcaccctgttcggcaacaccaagcccagaaaggagaagaccgagatgagccccagagagcacatcaagggcaaggagaccacccccagcagcctggccgtgacccagaccatggccaccaaggcccccgagtgcgtggaggaccccgacatggccaaccagagaaagaccgccctggagttctgcggcgagacctggagcagcctgtgcaccttcttcctgagcatcgtgcaggacaccagctgctag

SEQ ID NO: 10722 - DNA, 705 bp, Artificial Sequence; identical to SEQ ID NO: 10721
  Description of Artificial Sequence: Synthetic coding sequence

SEQ ID NO: 10723 - DNA, 2421 bp, Artificial Sequence
  Description of Artificial Sequence: Synthetic coding sequence
atgggcgcccccgcctgcgccctggccctgtgcgtggccgtggccatcgtggccggcgccagcagcgagagcctgggcaccgagcagagagtggtgggcagagccgccgaggtgcccggccccgagcccggccagcaggagcagctggtgttcggcagcggcgacgccgtggagctgagctgccccccccccggcggcggccccatgggccccaccgtgtgggtgaaggacggcaccggcctggtgcccagcgagagagtgctggtgggcccccagagactgcaggtgctgaacgccagccacgaggacagcggcgcctacagctgcagacagagactgacccagagagtgctgtgccacttcagcgtgagagtgaccgacgcccccagcagcggcgacgacgaggacggcgaggacgaggccgaggacaccggcgtggacaccggcgccccctactggaccagacccgagagaatggacaagaagctgctggccgtgcccgccgccaacaccgtgagattcagatgccccgccgccggcaaccccacccccagcatcagctggctgaagaacggcagagagttcagaggcgagcacagaatcggcggcatcaagctgagacaccagcagtggagcctggtgatggagagcgtggtgcccagcgacagaggcaactacacctgcgtggtggagaacaagttcggcagcatcagacagacctacaccctggacgtgctggagagaagcccccacagacccatcctgcaggccggcctgcccgccaaccagaccgccgtgctgggcagcgacgtggagttccactgcaaggtgtacagcgacgcccagccccacatccagtggctgaagcacgtggaggtgaacggcagcaaggtgggccccgacggcaccccctacgtgaccgtgctgaagaccgccggcgccaacaccaccgacaaggagctggaggtgctgagcctgcacaacgtgaccttcgaggacgccggcgagtacacctgcctggccggcaacagcatcggcttcagccaccacagcgcctggctggtggtgctgcccgccgaggaggagctggtggaggccgacgaggccggcagcgtgtacgccggcatcctgagctacggcgtgggcttcttcctgttcatcctggtggtggccgccgtgaccctgtgcagactgagaagcccccccaagaagggcctgggcagccccaccgtgcacaagatcagcagattccccctgaagagacaggtgagcctggagagcaacgccagcatgagcagcaacacccccctggtgagaatcgccagactgagcagcggcgagggccccaccctggccaacgtgagcgagctggagctgcccgccgaccccaagtgggagctgagcagagccagactgaccctgggcaagcccctgggcgagggctgcttcggccaggtggtgatggccgaggccatcggcatcgacaaggacagagccgccaagcccgtgaccgtggccgtgaagatgctgaaggacgacgccaccgacaaggacctgagcgacctggtgagcgagatggagatgatgaagatgatcggcaagcacaagaacatcatcaacctgctgggcgcctgcacccagggcggccccctgtacgtgctggtggagtacgccgccaagggcaacctgagagagttcctgagagccagaagaccccccggcctggactacagcttcgacacctgcaagccccccgaggagcagctgaccttcaaggacctggtgagctgcgcctaccaggtggccagaggcatggagtacctggccagccagaagtgcatccacagagacctggccgccagaaacgtgctggtgaccgaggacaacgtgatgaagatcgccgacttcggcctggccagagacgtgcacaacctggactactacaagaagaccaccaacggcagactgcccgtgaagtggatggcccccgaggccctgttcgacagagtgtacacccaccagagcgacgtgtggagcttcggcgtgctgctgtgggagatcttcaccctgggcggcagcccctaccccggcatccccgtggaggagctgttcaagctgctgaaggagggccacagaatggacaagcccgccaactgcacccacgacctgtacatgatcatgagagagtgctggcacgccgcccccagccagagacccaccttcaagcagctggtggaggacctggacagagtgctgaccgtgaccagcaccgacgagtacctggacctgagcgcccccttcgagcagtacagccccggcggccaggacacccccagcagcagcagcagcggcgacgacagcgtgttcgcccacgacctgctgccccccgccccccccagcagcggcggcagcagaacctag

SEQ ID NO: 10724 - DNA, 513 bp, Artificial Sequence
  Description of Artificial Sequence: Synthetic coding sequence
gagtacctggacctgagcgcccccttcgagcagtacagccccggcggccaggacacccccagcagcagcagcagcggcgacgacagcgtgttcgcccacgacctgctggccaccggcccccagcagtgcgagggcagcctggccgcccaccccgccgccggcgcccagcccctgcccggcatgagactgagcgccgacggcgagaccgccacccagagcttcggcctgtgcgtgtgcgtgtgcgtgtgcgtgtgctgcaccagcgcctgcgcctgcgtgagagcccacctggccagcagatgcagaggcaccctgggcgtgcccgccgccgtgcagagaagccccgactggtgctgcagcaccgagggccccctgttctggggcgaccccgtgcagaacgtgagcggccccaccagatgggaccccggccagggcgccggccccgacatgagacccctgcccctgcaccacggcaccagccagggcctgggccccagccacacccagagctag

SEQ ID NO: 10725 - DNA, 2427 bp, Artificial Sequence
  Description of Artificial Sequence: Synthetic coding sequence
atgggcgcccccgcctgcgccctggccctgtgcgtggccgtggccatcgtggccggcgccagcagcgagagcctgggcaccgagcagagagtggtgggcagagccgccgaggtgcccggccccgagcccggccagcaggagcagctggtgttcggcagcggcgacgccgtggagctgagctgccccccccccggcggcggccccatgggccccaccgtgtgggtgaaggacggcaccggcctggtgcccagcgagagagtgctggtgggcccccagagactgcaggtgctgaacgccagccacgaggacagcggcgcctacagctgcagacagagactgacccagagagtgctgtgccacttcagcgtgagagtgaccgacgcccccagcagcggcgacgacgaggacggcgaggacgaggccgaggacaccggcgtggacaccggcgccccctactggaccagacccgagagaatggacaagaagctgctggccgtgcccgccgccaacaccgtgagattcagatgccccgccgccggcaaccccacccccagcatcagctggctgaagaacggcagagagttcagaggcgagcacagaatcggcggcatcaagctgagacaccagcagtggagcctggtgatggagagcgtggtgcccagcgacagaggcaactacacctgcgtggtggagaacaagttcggcagcatcagacagacctacaccctggacgtgctggagagaagcccccacagacccatcctgcaggccggcctgcccgccaaccagaccgccgtgctgggcagcgacgtggagttccactgcaaggtgtacagcgacgcccagccccacatccagtggctgaagcacgtggaggtgaacggcagcaaggtgggccccgacggcaccccctacgtgaccgtgctgaagagctggatcagcgagagcgtggaggccgacgtgagactgagactggccaacgtgagcgagagagacggcggcgagtacctgtgcagagccaccaacttcatcggcgtggccgagaaggccttctggctgagcgtgcacggccccagagccgccgaggaggagctggtggaggccgacgaggccggcagcgtgtacgccggcatcctgagctacggcgtgggcttcttcctgttcatcctggtggtggccgccgtgaccctgtgcagactgagaagcccccccaagaagggcctgggcagccccaccgtgcacaagatcagcagattccccctgaagagacaggtgagcctggagagcaacgccagcatgagcagcaacacccccctggtgagaatcgccagactgagcagcggcgagggccccaccctggccaacgtgagcgagctggagctgcccgccgaccccaagtgggagctgagcagagccagactgaccctgggcaagcccctgggcgagggctgcttcggccaggtggtgatggccgaggccatcggcatcgacaaggacagagccgccaagcccgtgaccgtggccgtgaagatgctgaaggacgacgccaccgacaaggacctgagcgacctggtgagcgagatggagatgatgaagatgatcggcaagcacaagaacatcatcaacctgctgggcgcctgcacccagggcggccccctgtacgtgctggtggagtacgccgccaagggcaacctgagagagttcctgagagccagaagaccccccggcctggactacagcttcgacacctgcaagccccccgaggagcagctgaccttcaaggacctggtgagctgcgcctaccaggtggccagaggcatggagtacctggccagccagaagtgcatccacagagacctggccgccagaaacgtgctggtgaccgaggacaacgtgatgaagatcgccgacttcggcctggccagagacgtgcacaacctggactactacaagaagaccaccaacggcagactgcccgtgaagtggatggcccccgaggccctgttcgacagagtgtacacccaccagagcgacgtgtggagcttcggcgtgctgctgtgggagatcttcaccctgggcggcagcccctaccccggcatccccgtggaggagctgttcaagctgctgaaggagggccacagaatggacaagcccgccaactgcacccacgacctgtacatgatcatgagagagtgctggcacgccgcccccagccagagacccaccttcaagcagctggtggaggacctggacagagtgctgaccgtgaccagcaccgacgagtacctggacctgagcgcccccttcgagcagtacagccccggcggccaggacacccccagcagcagcagcagcggcgacgacagcgtgttcgcccacgacctgctgccccccgccccccccagcagcggcggcagcagaacctag

SEQ ID NO: 10726 - DNA, 2085 bp, Artificial Sequence
  Description of Artificial Sequence: Synthetic coding sequence
atgggcgcccccgcctgcgccctggccctgtgcgtggccgtggccatcgtggccggcgccagcagcgagagcctgggcaccgagcagagagtggtgggcagagccgccgaggtgcccggccccgagcccggccagcaggagcagctggtgttcggcagcggcgacgccgtggagctgagctgccccccccccggcggcggccccatgggccccaccgtgtgggtgaaggacggcaccggcctggtgcccagcgagagagtgctggtgggcccccagagactgcaggtgctgaacgccagccacgaggacagcggcgcctacagctgcagacagagactgacccagagagtgctgtgccacttcagcgtgagagtgaccgacgcccccagcagcggcgacgacgaggacggcgaggacgaggccgaggacaccggcgtggacaccggcgccccctactggaccagacccgagagaatggacaagaagctgctggccgtgcccgccgccaacaccgtgagattcagatgccccgccgccggcaaccccacccccagcatcagctggctgaagaacggcagagagttcagaggcgagcacagaatcggcggcatcaagctgagacaccagcagtggagcctggtgatggagagcgtggtgcccagcgacagaggcaactacacctgcgtggtggagaacaagttcggcagcatcagacagacctacaccctggacgtgctggagagaagcccccacagacccatcctgcaggccggcctgcccgccaaccagaccgccgtgctgggcagcgacgtggagttccactgcaaggtgtacagcgacgcccagccccacatccagtggctgaagcacgtggaggtgaacggcagcaaggtgggccccgacggcaccccctacgtgaccgtgctgaaggtgagcctggagagcaacgccagcatgagcagcaacacccccctggtgagaatcgccagactgagcagcggcgagggccccaccctggccaacgtgagcgagctggagctgcccgccgaccccaagtgggagctgagcagagccagactgaccctgggcaagcccctgggcgagggctgcttcggccaggtggtgatggccgaggccatcggcatcgacaaggacagagccgccaagcccgtgaccgtggccgtgaagatgctgaaggacgacgccaccgacaaggacctgagcgacctggtgagcgagatggagatgatgaagatgatcggcaagcacaagaacatcatcaacctgctgggcgcctgcacccagggcggccccctgtacgtgctggtggagtacgccgccaagggcaacctgagagagttcctgagagccagaagaccccccggcctggactacagcttcgacacctgcaagccccccgaggagcagctgaccttcaaggacctggtgagctgcgcctaccaggtggccagaggcatggagtacctggccagccagaagtgcatccacagagacctggccgccagaaacgtgctggtgaccgaggacaacgtgatgaagatcgccgacttcggcctggccagagacgtgcacaacctggactactacaagaagaccaccaacggcagactgcccgtgaagtggatggcccccgaggccctgttcgacagagtgtacacccaccagagcgacgtgtggagcttcggcgtgctgctgtgggagatcttcaccctgggcggcagcccctaccccggcatccccgtggaggagctgttcaagctgctgaaggagggccacagaatggacaagcccgccaactgcacccacgacctgtacatgatcatgagagagtgctggcacgccgcccccagccagagacccaccttcaagcagctggtggaggacctggacagagtgctgaccgtgaccagcaccgacgagtacctggacctgagcgcccccttcgagcagtacagccccggcggccaggacacccccagcagcagcagcagcggcgacgacagcgtgttcgcccacgacctgctgccccccgccccccccagcagcggcggcagcagaacctag

SEQ ID NO: 10727 - DNA, 2421 bp, Artificial Sequence; identical to SEQ ID NO: 10723
  Description of Artificial Sequence: Synthetic coding sequence

SEQ ID NO: 10728 - DNA, 2379 bp, Artificial Sequence
  Description of Artificial Sequence: Synthetic coding sequence
atgggcgcccccgcctgcgccctggccctgtgcgtggccgtggccatcgtggccggcgccagcagcgagagcctgggcaccgagcagagagtggtgggcagagccgccgaggtgcccggccccgagcccggccagcaggagcagctggtgttcggcagcggcgacgccgtggagctgagctgccccccccccggcggcggccccatgggccccaccgtgtgggtgaaggacggcaccggcctggtgcccagcgagagagtgctggtgggcccccagagactgcaggtgctgaacgccagccacgaggacagcggcgcctacagctgcagacagagactgacccagagagtgctgtgccacttcagcgtgagagtgaccgacgcccccagcagcggcgacgacgaggacggcgaggacgaggccgaggacaccggcgtggacaccggcgccccctactggaccagacccgagagaatggacaagaagctgctggccgtgcccgccgccaacaccgtgagattcagatgccccgccgccggcaaccccacccccagcatcagctggctgaagaacggcagagagttcagaggcgagcacagaatcggcggcatcaagctgagacaccagcagtggagcctggtgatggagagcgtggtgcccagcgacagaggcaactacacctgcgtggtggagaacaagttcggcagcatcagacagacctacaccctggacgtgctggagagaagcccccacagacccatcctgcaggccggcctgcccgccaaccagaccgccgtgctgggcagcgacgtggagttccactgcaaggtgtacagcgacgcccagccccacatccagtggctgaagcacgtggaggtgaacggcagcaaggtgggccccgacggcaccccctacgtgaccgtgctgaagaccgccggcgccaacaccaccgacaaggagctggaggtgctgagcctgcacaacgtgaccttcgaggacgccggcgagtacacctgcctggccggcaacagcatcggcttcagccaccacagcgcctggctggtggtgctgcccgccgaggaggagctggtggaggccgacgaggccggcagcgtgtacgccggcatcctgagctacggcgtgggcttcttcctgttcatcctggtggtggccgccgtgaccctgtgcagactgagaagcccccccaagaagggcctgggcagccccaccgtgcacaagatcagcagattccccctgaagagacagcaggtgagcctggagagcaacgccagcatgagcagcaacacccccctggtgagaatcgccagactgagcagcggcgagggccccaccctggccaacgtgagcgagctggagctgcccgccgaccccaagtgggagctgagcagagccagactgaccctgggcaagcccctgggcgagggctgcttcggccaggtggtgatggccgaggccatcggcatcgacaaggacagagccgccaagcccgtgaccgtggccgtgaagatgctgaaggacgacgccaccgacaaggacctgagcgacctggtgagcgagatggagatgatgaagatgatcggcaagcacaagaacatcatcaacctgctgggcgcctgcacccagggcggccccctgtacgtgctggtggagtacgccgccaagggcaacctgagagagttcctgagagccagaagaccccccggcctggactacagcttcgacacctgcaagccccccgaggagcagctgaccttcaaggacctggtgagctgcgcctaccaggtggccagaggcatggagtacctggccagccagaagtgcatccacagagacctggccgccagaaacgtgctggtgaccgaggacaacgtgatgaagatcgccgacttcggcctggccagagacgtgcacaacctggactactacaagaagaccaccaacctggtgctgtggggccccgccctgggcgacctgcacgccggcggcctgcccgtgcccagacacccctgcggcggcgccctgcaggccgccgagggcggccccccccacggccaggccagacagctgcacaccagacccgtgcacgaccacgccggcgtgctggcctgcagagccctgcccgaggcccacctgcaggccgccggcggcggccccggcccctgcccctacagagacgtgcacagaagagtgcccggccccgtgggcgccttcagagccgtgctgcccggctggcccggccacccccagctgcagctgctgagaggcagactgagagtgtgccccagacccgccgcccccggccccacccagcagtggggcctggccgacgtgaagggccactggagccccaccatgtag

SEQ ID NO: 10729 - DNA, 2409 bp, Artificial Sequence
  Description of Artificial Sequence: Synthetic coding sequence
atgagactgctgctggccctgctgggcgtgctgctgagcgtgcccggcccccccgtgctgagcctggaggccagcgaggaggtggagctggagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagatcgccagcttcctgcccgaggacgccggcagatacctgtgcctggccagaggcagcatgatcgtgctgcagaacctgaccctgatcaccggcgacagcctgaccagcagcaacgacgacgaggaccccaagagccacagagaccccagcaacagacacagctacccccagcaggccccctactggacccacccccagagaatggagaagaagctgcacgccgtgcccgccggcaacaccgtgaagttcagatgccccgccgccggcaaccccacccccaccatcagatggctgaaggacggccaggccttccacggcgagaacagaatcggcggcatcagactgagacaccagcactggagcctggtgatggagagcgtggtgcccagcgacagaggcacctacacctgcctggtggagaacgccgtgggcagcatcagatacaactacctgctggacgtgctggagagaagcccccacagacccatcctgcaggccggcctgcccgccaacaccaccgccgtggtgggcagcgacgtggagctgctgtgcaaggtgtacagcgacgcccagccccacatccagtggctgaagcacatcgtgatcaacggcagcagcttcggcgccgacggcttcccctacgtgcaggtgctgaagaccgccgacatcaacagcagcgaggtggaggtgctgtacctgagaaacgtgagcgccgaggacgccggcgagtacacctgcctggccggcaacagcatcggcctgagctaccagagcgcctggctgaccgtgctgcccgaggaggaccccacctggaccgccgccgcccccgaggccagatacaccgacatcatcctgtacgccagcggcagcctggccctggccgtgctgctgctgctggccggcctgtacagaggccaggccctgcacggcagacaccccagaccccccgccaccgtgcagaagctgagcagattccccctggccagacagttcagcctggagagcggcagcagcggcaagagcagcagcagcctggtgagaggcgtgagactgagcagcagcggccccgccctgctggccggcctggtgagcctggacctgcccctggaccccctgtgggagttccccagagacagactggtgctgggcaagcccctgggcgagggctgcttcggccaggtggtgagagccgaggccttcggcatggaccccgccagacccgaccaggccagcaccgtggccgtgaagatgctgaaggacaacgccagcgacaaggacctggccgacctggtgagcgagatggaggtgatgaagctgatcggcagacacaagaacatcatcaacctgctgggcgtgtgcacccaggagggccccctgtacgtgatcgtggagtgcgccgccaagggcaacctgagagagttcctgagagccagaagaccccccggccccgacctgagccccgacggccccagaagcagcgagggccccctgagcttccccgtgctggtgagctgcgcctaccaggtggccagaggcatgcagtacctggagagcagaaagtgcatccacagagacctggccgccagaaacgtgctggtgaccgaggacaacgtgatgaagatcgccgacttcggcctggccagaggcgtgcaccacatcgactactacaagaagaccagcaacggcagactgcccgtgaagtggatggcccccgaggccctgttcgacagagtgtacacccaccagagcgacgtgtggagcttcggcatcctgctgtgggagatcttcaccctgggcggcagcccctaccccggcatccccgtggaggagctgttcagcctgctgagagagggccacagaatggacagacccccccactgcccccccgagctgtacggcctgatgagagagtgctggcacgccgcccccagccagagacccaccttcaagcagctggtggaggccctggacaaggtgctgctggccgtgagcgaggagtacctggacctgagactgaccttcggcccctacagccccagcggcggcgacgccagcagcacctgcagcagcagcgacagcgtgttcagccacgaccccctgcccctgggcagcagcagcttccccttcggcagcggcgtgcagacctag

SEQ ID NO: 10730 - DNA, 2289 bp, Artificial Sequence
  Description of Artificial Sequence: Synthetic coding sequence
atgagactgctgctggccctgctgggcgtgctgctgagcgtgcccggcccccccgtgctgagcctggaggccagcgaggaggtggagctggagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagatcgccagcttcctgcccgaggacgccggcagatacctgtgcctggccagaggcagcatgatcgtgctgcagaacctgaccctgatcaccggcgacagcctgaccagcagcaacgacgacgaggaccccaagagccacagagaccccagcaacagacacagctacccccagcaggccccctactggacccacccccagagaatggagaagaagctgcacgccgtgcccgccggcaacaccgtgaagttcagatgccccgccgccggcaaccccacccccaccatcagatggctgaaggacggccaggccttccacggcgagaacagaatcggcggcatcagactgagacaccagcactggagcctggtgatggagagcgtggtgcccagcgacagaggcacctacacctgcctggtggagaacgccgtgggcagcatcagatacaactacctgctggacgtgctggagagaagcccccacagacccatcctgcaggccggcctgcccgccaacaccaccgccgtggtgggcagcgacgtggagctgctgtgcaaggtgtacagcgacgcccagccccacatccagtggctgaagcacatcgtgatcaacggcagcagcttcggcgccgacggcttcccctacgtgcaggtgctgaagaccgccgacatcaacagcagcgaggtggaggtgctgtacctgagaaacgtgagcgccgaggacgccggcgagtacacctgcctggccggcaacagcatcggcctgagctaccagagcgcctggctgaccgtgctgcccggcaccggcagaatcccccacctgacctgcgacagcctgacccccgccggcagaaccaagagccccaccctgcagttcagcctggagagcggcagcagcggcaagagcagcagcagcctggtgagaggcgtgagactgagcagcagcggccccgccctgctggccggcctggtgagcctggacctgcccctggaccccctgtgggagttccccagagacagactggtgctgggcaagcccctgggcgagggctgcttcggccaggtggtgagagccgaggccttcggcatggaccccgccagacccgaccaggccagcaccgtggccgtgaagatgctgaaggacaacgccagcgacaaggacctggccgacctggtgagcgagatggaggtgatgaagctgatcggcagacacaagaacatcatcaacctgctgggcgtgtgcacccaggagggccccctgtacgtgatcgtggagtgcgccgccaagggcaacctgagagagttcctgagagccagaagaccccccggccccgacctgagccccgacggccccagaagcagcgagggccccctgagcttccccgtgctggtgagctgcgcctaccaggtggccagaggcatgcagtacctggagagcagaaagtgcatccacagagacctggccgccagaaacgtgctggtgaccgaggacaacgtgatgaagatcgccgacttcggcctggccagaggcgtgcaccacatcgactactacaagaagaccagcaacggcagactgcccgtgaagtggatggcccccgaggccctgttcgacagagtgtacacccaccagagcgacgtgtggagcttcggcatcctgctgtgggagatcttcaccctgggcggcagcccctaccccggcatccccgtggaggagctgttcagcctgctgagagagggccacagaatggacagacccccccactgcccccccgagctgtacggcctgatgagagagtgctggcacgccgcccccagccagagacccaccttcaagcagctggtggaggccctggacaaggtgctgctggccgtgagcgaggagtacctggacctgagactgaccttcggcccctacagccccagcggcggcgacgccagcagcacctgcagcagcagcgacagcgtgttcagccacgaccccctgcccctgggcagcagcagcttccccttcggcagcggcgtgcagacctag

SEQ ID NO: 10731 - DNA, 3093 bp, Artificial Sequence
  Description of Artificial Sequence: Synthetic coding sequence
ccctgcatgtggcaccagcagcacgtgccctgcgtgtgcgtgtgcccctacgtgtgcgtgtgcatgagagtgtgcgtgtgcgtgtgctggcccctgagctgcgccctgaacgccgtgtgcgtgacctgccccaagagcgtggccttcgccctgggcgtggccagcgccgcctgcggctgcgtgggcgtgaaggagtggtggctgctgcagcacgccctgcagagcgcctgcgccctgcacgtgagatgcgtgctgtgcacccaggaggccgccagcgacggcgccgccggcagcgccgacctgtgccccctgcccaccgagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagatcgccagcttcctgcccgaggacgccggcagatacctgtgcctggccagaggcagcatgatcgtgctgcagaacctgaccctgatcaccggcgacagcccccccgccaccatgatgagaacccccagccccatcggcacccccagaatcggcaccgtgacccccagcaaggtgagcagaagccccagaacctgcgtgcccgccgccgcccacctgatcaccgagaagagaagacccgtgtgggagcacaccgtgatcctgggcgccttcccctgcccccccgccccctactggacccacccccagagaatggagaagaagctgcacgccgtgcccgccggcaacaccgtgaagttcagatgccccgccgccggcaaccccacccccaccatcagatggctgaaggacggccaggccttccacggcgagaacagaatcggcggcatcagactgagacaccagcactggagcctggtgatggagagcgtggtgcccagcgacagaggcacctacacctgcctggtggagaacgccgtgggcagcatcagatacaactacctgctggacgtgctggagagaagcccccacagacccatcctgcaggccggcctgcccgccaacaccaccgccgtggtgggcagcgacgtggagctgctgtgcaaggtgtacagcgacgcccagccccacatccagtggctgaagcacatcgtgatcaacggcagcagcttcggcgccgacggcttcccctacgtgcaggtgctgaagaccgccgacatcaacagcagcgaggtggaggtgctgtacctgagaaacgtgagcgccgaggacgccggcgagtacacctgcctggccggcaacagcatcggcctgagctaccagagcgcctggctgaccgtgctgcccggcgagcacctgaagggccaggagatgctgagagacgcccccctgggccagcagtggggcctgtggcccgtgggctggagcgtgagcgtgggcctgtggggcctggcctggggcgccgtgtgcggcttcgtgggcctgagctgcatgaccgcccccctgtgcctgagcaccagaggcagaccctgcgacagactgctgagatgcggctgcctgggcctgggcatcaccaccgccagcagcgtgtgcgtgcccacctacgtgggcagctgggagggcctgggctgcaccggcagacccgtgagccccctgaccagcctgagcgtgtgcgtgtgcccctgcgccagagccgaggaggaccccacctggaccgccgccgcccccgaggccagatacaccgacatcatcctgtacgccagcggcagcctggccctggccgtgctgctgctgctggccggcctgtacagaggccaggccctgcacggcagacaccccagaccccccgccaccgtgcagaagctgagcagattccccctggccagacagttcagcctggagagcggcagcagcggcaagagcagcagcagcctggtgagaggcgtgagactgagcagcagcggccccgccctgctggccggcctggtgagcctggacctgcccctggaccccctgtgggagttccccagagacagactggtgctgggcaagcccctgggcgagggctgcttcggccaggtggtgagagccgaggccttcggcatggaccccgccagacccgaccaggccagcaccgtggccgtgaagatgctgaaggacaacgccagcgacaaggacctggccgacctggtgagcgagatggaggtgatgaagctgatcggcagacacaagaacatcatcaacctgctgggcgtgtgcacccaggagggccccctgtacgtgatcgtggagtgcgccgccaagggcaacctgagagagttcctgagagccagaagaccccccggccccgacctgagccccgacggccccagaagcagcgagggccccctgagcttccccgtgctggtgagctgcgcctaccaggtggccagaggcatgcagtacctggagagcagaaagtgcatccacagagacctggccgccagaaacgtgctggtgaccgaggacaacgtgatgaagatcgccgacttcggcctggccagaggcgtgcaccacatcgactactacaagaagaccagcaacggcagactgcccgtgaagtggatggcccccgaggccctgttcgacagagtgtacacccaccagagcgacgtgtggagcttcggcatcctgctgtgggagatcttcaccctgggcggcagcccctaccccggcatccccgtggaggagctgttcagcctgctgagagagggccacagaatggacagacccccccactgcccccccgagctgtacggcctgatgagagagtgctggcacgccgcccccagccagagacccaccttcaagcagctggtggaggccctggacaaggtgctgctggccgtgagcgaggagtacctggacctgagactgaccttcggcccctacagccccagcggcggcgacgccagcagcacctgcagcagcagcgacagcgtgttcagccacgaccccctgcccctgggcagcagcagcttccccttcggcagcggcgtgcagacctag

SEQ ID NO: 10732 - DNA, 2289 bp, Artificial Sequence; identical to SEQ ID NO: 10730
  Description of Artificial Sequence: Synthetic coding sequence

SEQ ID NO: 10733 - DNA, 2409 bp, Artificial Sequence; identical to SEQ ID NO: 10729
  Description of Artificial Sequence: Synthetic coding sequence

SEQ ID NO: 10734 - DNA, 606 bp, Artificial Sequence
  Description of Artificial Sequence: Synthetic coding sequence
atgagactgctgctggccctgctgggcgtgctgctgagcgtgcccggcccccccgtgctgagcctggaggccagcgaggaggtggagctggagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagatcgccagcttcctgcccgaggacgccggcagatacctgtgcctggccagaggcagcatgatcgtgctgcagaacctgaccctgatcaccggcgacagcctgaccagcagcaacgacgacgaggaccccaagagccacagagaccccagcaacagacacagctacccccagcaggccccctactggacccacccccagagaatggagaagaagctgcacgccgtgcccgccggcaacaccgtgaagttcagatgccccgccgccggcaaccccacccccaccatcagatggctgaaggacggccaggccttccacggcgagaacagaatcggcggcatcagatag

SEQ ID NO: 10735 - DNA, 264 bp, Artificial Sequence
  Description of Artificial Sequence: Synthetic coding sequence
atgagactgctgctggccctgctgggcgtgctgctgagcgtgcccggcccccccgtgctgagcctggaggccagcgaggaggtggagctggagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagtag

SEQ ID NO: 10736 - DNA, 327 bp, Artificial Sequence
  Description of Artificial Sequence: Synthetic coding sequence
atgagactgctgctggccctgctgggcgtgctgctgagcgtgcccggcccccccgtgctgagcctggaggccagcgaggaggtggagctggagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagatcgccagcttcctgcccgaggacgccggcagatacctgtgcctggccagaggcagcatgatctag

SEQ ID NO: 10737 - DNA, 345 bp, Artificial Sequence
  Description of Artificial Sequence: Synthetic coding sequence
atgagactgctgctggccctgctgggcgtgctgctgagcgtgcccggcccccccgtgctgagcctggaggccagcgaggaggtggagctggagccctgcctggcccccagcctggagcagcaggagcaggagctgaccgtggccctgggccagcccgtgagactgtgctgcggcagagccgagagaggcggccactggtacaaggagggcagcagactggcccccgccggcagagtgagaggctggagaggcagactggagatcgccagcttcctgcccgaggacgccggcagatacctgtgcctggccagaggcagcatgatcgtgctgcagaacctgacctag

SEQ ID NO: 10738 - DNA, 7164 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgaggtgccccagctgaccgacctgagcttcgtggacatcaccgacagcagcatcggcctgagatggacccccctgaacagcagcaccatcatcggctacagaatcaccgtggtggccgccggcgagggcatccccatcttcgaggacttcgtggacagcagcgtgggctactacaccgtgaccggcctggagcccggcatcgactacgacatcagcgtgatcaccctgatcaacggcggcgagagcgcccccaccaccctgacccagcagaccgccgtgcccccccccaccgacctgagattcttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggcgaggagatccagatcggccacatccccagagaggacgtggactaccacctgtacccccacggccccggcctgaaccccaacgccagcaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10739 - DNA, 7341 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgaggtgccccagctgaccgacctgagcttcgtggacatcaccgacagcagcatcggcctgagatggacccccctgaacagcagcaccatcatcggctacagaatcaccgtggtggccgccggcgagggcatccccatcttcgaggacttcgtggacagcagcgtgggctactacaccgtgaccggcctggagcccggcatcgactacgacatcagcgtgatcaccctgatcaacggcggcgagagcgcccccaccaccctgacccagcagaccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10740 - DNA, 7068 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10741 - DNA, 6555 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10742 - DNA, 6636 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcggctggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10743 - DNA, 7434 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgaggtgccccagctgaccgacctgagcttcgtggacatcaccgacagcagcatcggcctgagatggacccccctgaacagcagcaccatcatcggctacagaatcaccgtggtggccgccggcgagggcatccccatcttcgaggacttcgtggacagcagcgtgggctactacaccgtgaccggcctggagcccggcatcgactacgacatcagcgtgatcaccctgatcaacggcggcgagagcgcccccaccaccctgacccagcagaccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggcgaggagatccagatcggccacatccccagagaggacgtggactaccacctgtacccccacggccccggcctgaaccccaacgccagcaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10744 - DNA, 6891 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggcgaggagatccagatcggccacatccccagagaggacgtggactaccacctgtacccccacggccccggcctgaaccccaacgccagcaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10745 - DNA, 6096 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccggccaggaggccctgagccagaccaccatcagctgggcccccttccaggacaccagcgagtacatcatcagctgccaccccgtgggcaccgacgaggagcccctgcagagcaccaaggcctag

SEQ ID NO: 10746 - DNA, 6531 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10747 - DNA, 7161 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggcgaggagatccagatcggccacatccccagagaggacgtggactaccacctgtacccccacggccccggcctgaaccccaacgccagcaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10748 - DNA, 6723 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10749 - DNA, 1974 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccgtgagcatcccccccagaaacctgggctactag

SEQ ID NO: 10750 - DNA, 6804 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgaggtgccccagctgaccgacctgagcttcgtggacatcaccgacagcagcatcggcctgagatggacccccctgaacagcagcaccatcatcggctacagaatcaccgtggtggccgccggcgagggcatccccatcttcgaggacttcgtggacagcagcgtgggctactacaccgtgaccggcctggagcccggcatcgactacgacatcagcgtgatcaccctgatcaacggcggcgagagcgcccccaccaccctgacccagcagaccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10751 - DNA, 6798 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10752 - DNA, 6993 bp, Artificial Sequence
  Description of Artificial Sequence: Synthetic coding sequence
atgctgagaggccccggccccggcctgctgctgctggccgtgcagtgcctgggcaccgccgtgcccagcaccggcgccagcaagagcaagagacaggcccagcagatggtgcagccccagagccccgtggccgtgagccagagcaagcccggctgctacgacaacggcaagcactaccagatcaaccagcagtgggagagaacctacctgggcaacgccctggtgtgcacctgctacggcggcagcagaggcttcaactgcgagagcaagcccgaggccgaggagacctgcttcgacaagtacaccggcaacacctacagagtgggcgacacctacgagagacccaaggacagcatgatctgggactgcacctgcatcggcgccggcagaggcagaatcagctgcaccatcgccaacagatgccacgagggcggccagagctacaagatcggcgacacctggagaagaccccacgagaccggcggctacatgctggagtgcgtgtgcctgggcaacggcaagggcgagtggacctgcaagcccatcgccgagaagtgcttcgaccacgccgccggcaccagctacgtggtgggcgagacctgggagaagccctaccagggctggatgatggtggactgcacctgcctgggcgagggcagcggcagaatcacctgcaccagcagaaacagatgcaacgaccaggacaccagaaccagctacagaatcggcgacacctggagcaagaaggacaacagaggcaacctgctgcagtgcatctgcaccggcaacggcagaggcgagtggaagtgcgagagacacaccagcgtgcagaccaccagcagcggcagcggccccttcaccgacgtgagagccgccgtgtaccagccccagccccacccccagccccccccctacggccactgcgtgaccgacagcggcgtggtgtacagcgtgggcatgcagtggctgaagacccagggcaacaagcagatgctgtgcacctgcctgggcaacggcgtgagctgccaggagaccgccgtgacccagacctacggcggcaacagcaacggcgagccctgcgtgctgcccttcacctacaacggcagaaccttctacagctgcaccaccgagggcagacaggacggccacctgtggtgcagcaccaccagcaactacgagcaggaccagaagtacagcttctgcaccgaccacaccgtgctggtgcagaccagaggcggcaacagcaacggcgccctgtgccacttccccttcctgtacaacaaccacaactacaccgactgcaccagcgagggcagaagagacaacatgaagtggtgcggcaccacccagaactacgacgccgaccagaagttcggcttctgccccatggccgcccacgaggagatctgcaccaccaacgagggcgtgatgtacagaatcggcgaccagtgggacaagcagcacgacatgggccacatgatgagatgcacctgcgtgggcaacggcagaggcgagtggacctgcatcgcctacagccagctgagagaccagtgcatcgtggacgacatcacctacaacgtgaacgacaccttccacaagagacacgaggagggccacatgctgaactgcacctgcttcggccagggcagaggcagatggaagtgcgaccccgtggaccagtgccaggacagcgagaccggcaccttctaccagatcggcgacagctgggagaagtacgtgcacggcgtgagataccagtgctactgctacggcagaggcatcggcgagtggcactgccagcccctgcagacctaccccagcagcagcggccccgtggaggtgttcatcaccgagacccccagccagcccaacagccaccccatccagtggaacgccccccagcccagccacatcagcaagtacatcctgagatggagacccaagaacagcgtgggcagatggaaggaggccaccatccccggccacctgaacagctacaccatcaagggcctgaagcccggcgtggtgtacgagggccagctgatcagcatccagcagtacggccaccaggaggtgaccagattcgacttcaccaccaccagcaccagcacccccgtgaccagcaacaccgtgaccggcgagaccacccccttcagccccctggtggccaccagcgagagcgtgaccgagatcaccgccagcagcttcgtggtgagctgggtgagcgccagcgacaccgtgagcggcttcagagtggagtacgagctgagcgaggagggcgacgagccccagtacctggacctgcccagcaccgccaccagcgtgaacatccccgacctgctgcccggcagaaagtacatcgtgaacgtgtaccagatcagcgaggacggcgagcagagcctgatcctgagcaccagccagaccaccgcccccgacgccccccccgacaccaccgtggaccaggtggacgacaccagcatcgtggtgagatggagcagaccccaggcccccatcaccggctacagaatcgtgtacagccccagcgtggagggcagcagcaccgagctgaacctgcccgagaccgccaacagcgtgaccctgagcgacctgcagcccggcgtgcagtacaacatcaccatctacgccgtggaggagaaccaggagagcacccccgtggtgatccagcaggagaccaccggcacccccagaagcgacaccgtgcccagccccagagacctgcagttcgtggaggtgaccgacgtgaaggtgaccatcatgtggaccccccccgagagcgccgtgaccggctacagagtggacgtgatccccgtgaacctgcccggcgagcacggccagagactgcccatcagcagaaacaccttcgccgaggtgaccggcctgagccccggcgtgacctactacttcaaggtgttcgccgtgagccacggcagagagagcaagcccctgaccgcccagcagaccaccaagctggacgcccccaccaacctgcagttcgtgaacgagaccgacagcaccgtgctggtgagatggaccccccccagagcccagatcaccggctacagactgaccgtgggcctgaccagaagaggccagcccagacagtacaacgtgggccccagcgtgagcaagtaccccctgagaaacctgcagcccgccagcgagtacaccgtgagcctggtggccatcaagggcaaccaggagagccccaaggccaccggcgtgttcaccaccctgcagcccggcagcagcatccccccctacaacaccgaggtgaccgagaccaccatcgtgatcacctggacccccgcccccagaatcggcttcaagctgggcgtgagacccagccagggcggcgaggcccccagagaggtgaccagcgacagcggcagcatcgtggtgagcggcctgacccccggcgtggagtacgtgtacaccatccaggtgctgagagacggccaggagagagacgcccccatcgtgaacaaggtggtgacccccctgagcccccccaccaacctgcacctggaggccaaccccgacaccggcgtgctgaccgtgagctgggagagaagcaccacccccgacatcaccggctacagaatcaccaccacccccaccaacggccagcagggcaacagcctggaggaggtggtgcacgccgaccagagcagctgcaccttcgacaacctgagccccggcctggagtacaacgtgagcgtgtacaccgtgaaggacgacaaggagagcgtgcccatcagcgacaccatcatccccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaacatcgacagacccaagggcctggccttcaccgacgtggacgtggacagcatcaagatcgcctgggagagcccccagggccaggtgagcagatacagagtgacctacagcagccccgaggacggcatccacgagctgttccccgcccccgacggcgaggaggacaccgccgagctgcagggcctgagacccggcagcgagtacaccgtgagcgtggtggccctgcacgacgacatggagagccagcccctgatcggcacccagagcaccgccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10753 - DNA, 3312 bp, Artificial Sequence
  Description of Artificial Sequence: Synthetic coding sequence
ctgagatggacccccctgaacagcagcaccatcatcggctacagaatcaccgtggtggccgccggcgagggcatccccatcttcgaggacttcgtggacagcagcgtgggctactacaccgtgaccggcctggagcccggcatcgactacgacatcagcgtgatcaccctgatcaacggcggcgagagcgcccccaccaccctgacccagcagaccgccgtgcccccccccaccgacctgagattcaccaacatcggccccgacaccatgagagtgacctgggcccccccccccagcatcgacctgaccaacttcctggtgagatacagccccgtgaagaacgaggaggacgtggccgagctgagcatcagccccagcgacaacgccgtggtgctgaccaacctgctgcccggcaccgagtacgtggtgagcgtgagcagcgtgtacgagcagcacgagagcacccccctgagaggcagacagaagaccggcctggacagccccaccggcatcgacttcagcgacatcaccgccaacagcttcaccgtgcactggatcgcccccagagccaccatcaccggctacagaatcagacaccaccccgagcacttcagcggcagacccagagaggacagagtgccccacagcagaaacagcatcaccctgaccaacctgacccccggcaccgagtacgtggtgagcatcgtggccctgaacggcagagaggagagccccctgctgatcggccagcagagcaccgtgagcgacgtgcccagagacctggaggtggtggccgccacccccaccagcctgctgatcagctgggacgcccccgccgtgaccgtgagatactacagaatcacctacggcgagaccggcggcaacagccccgtgcaggagttcaccgtgcccggcagcaagagcaccgccaccatcagcggcctgaagcccggcgtggactacaccatcaccgtgtacgccgtgaccggcagaggcgacagccccgccagcagcaagcccatcagcatcaactacagaaccgagatcgacaagcccagccagatgcaggtgaccgacgtgcaggacaacagcatcagcgtgaagtggctgcccagcagcagccccgtgaccggctacagagtgaccaccacccccaagaacggccccggccccaccaagaccaagaccgccggccccgaccagaccgagatgaccatcgagggcctgcagcccaccgtggagtacgtggtgagcgtgtacgcccagaaccccagcggcgagagccagcccctggtgcagaccgccgtgaccaccatccccgcccccaccgacctgaagttcacccaggtgacccccaccagcctgagcgcccagtggaccccccccaacgtgcagctgaccggctacagagtgagagtgacccccaaggagaagaccggccccatgaaggagatcaacctggcccccgacagcagcagcgtggtggtgagcggcctgatggtggccaccaagtacgaggtgagcgtgtacgccctgaaggacaccctgaccagcagacccgcccagggcgtggtgaccaccctggagaacgtgagcccccccagaagagccagagtgaccgacgccaccgagaccaccatcaccatcagctggagaaccaagaccgagaccatcaccggcttccaggtggacgccgtgcccgccaacggccagacccccatccagagaaccatcaagcccgacgtgagaagctacaccatcaccggcctgcagcccggcaccgactacaagatctacctgtacaccctgaacgacaacgccagaagcagccccgtggtgatcgacgccagcaccgccatcgacgcccccagcaacctgagattcctggccaccacccccaacagcctgctggtgagctggcagccccccagagccagaatcaccggctacatcatcaagtacgagaagcccggcagcccccccagagaggtggtgcccagacccagacccggcgtgaccgaggccaccatcaccggcctggagcccggcaccgagtacaccatctacgtgatcgccctgaagaacaaccagaagagcgagcccctgatcggcagaaagaagaccgacgagctgccccagctggtgaccctgccccaccccaacctgcacggccccgagatcctggacgtgcccagcaccgtgcagaagacccccttcgtgacccaccccggctacgacaccggcaacggcatccagctgcccggcaccagcggccagcagcccagcgtgggccagcagatgatcttcgaggagcacggcttcagaagaaccaccccccccaccaccgccacccccatcagacacagacccagaccctacccccccaacgtgggcgaggagatccagatcggccacatccccagagaggacgtggactaccacctgtacccccacggccccggcctgaaccccaacgccagcaccggccaggaggccctgagccagaccaccatcagctgggcccccttccaggacaccagcgagtacatcatcagctgccaccccgtgggcaccgacgaggagcccctgcagttcagagtgcccggcaccagcaccagcgccaccctgaccggcctgaccagaggcgccacctacaacgtgatcgtggaggccctgaaggaccagcagagacacaaggtgagagaggaggtggtgaccgtgggcaacagcgtgaacgagggcctgaaccagcccaccgacgacagctgcttcgacccctacaccgtgagccactacgccgtgggcgacgagtgggagagaatgagcgagagcggcttcaagctgctgtgccagtgcctgggcttcggcagcggccacttcagatgcgacagcagcagatggtgccacgacaacggcgtgaactacaagatcggcgagaagtgggacagacagggcgagaacggccagatgatgagctgcacctgcctgggcaacggcaagggcgagttcaagtgcgacccccacgaggccacctgctacgacgacggcaagacctaccacgtgggcgagcagtggcagaaggagtacctgggcgccatctgcagctgcacctgcttcggcggccagagaggctggagatgcgacaactgcagaagacccggcggcgagcccagccccgagggcaccaccggccagagctacaaccagtacagccagagataccaccagagaaccaacaccaacgtgaactgccccatcgagtgcttcatgcccctggacgtgcaggccgacagagaggacagcagagagtag

SEQ ID NO: 10754 - DNA, 312 bp, Artificial Sequence
  Description of Artificial Sequence: Synthetic coding sequence
atgcccgtgagcgtgagcagcggcagaaccttccccaagagaggccagacctgcgtggtgcactacaccggcatgctggaggacggcaagaagttcgacagcagcagagacagaaacaagcccttcaagttcatgctgggcaagcaggaggtgatcagaggctgggaggagggcgtggcccagatgagcgtgggccagagagccaagctgaccatcagccccgactacgcctacggcgccaccggccaccccggcatcatccccccccacgccaccctggtgttcgacgtggagctgctgaagctggagtag

SEQ ID NO: 10755 - DNA, 327 bp, Artificial Sequence
  Description of Artificial Sequence: Synthetic coding sequence
atgggcgtgcaggtggagaccatcagccccggcgacggcagaaccttccccaagagaggccagacctgcgtggtgcactacaccggcatgctggaggacggcaagaagttcgacagcagcagagacagaaacaagcccttcaagttcatgctgggcaagcaggaggtgatcagaggctgggaggagggcgtggcccagatgagcgtgggccagagagccaagctgaccatcagccccgactacgcctacggcgccaccggccaccccggcatcatccccccccacgccaccctggtgttcgacgtggagctgctgaagctggagtag

SEQ ID NO: 10756 - DNA, 312 bp, Artificial Sequence; identical to SEQ ID NO: 10754
  Description of Artificial Sequence: Synthetic coding sequence

SEQ ID NO: 10757 - DNA, 327 bp, Artificial Sequence; identical to SEQ ID NO: 10755
  Description of Artificial Sequence: Synthetic coding sequence

SEQ ID NO: 10758 - DNA, 279 bp, Artificial Sequence
  Description of Artificial Sequence: Synthetic coding sequence
atgggcgtgcaggtggagaccatcagccccggcgacggcatgctggaggacggcaagaagttcgacagcagcagagacagaaacaagcccttcaagttcatgctgggcaagcaggaggtgatcagaggctgggaggagggcgtggcccagatgagcgtgggccagagagccaagctgaccatcagccccgactacgcctacggcgccaccggccaccccggcatcatccccccccacgccaccctggtgttcgacgtggagctgctgaagctggagtag

SEQ ID NO: 10759 - DNA, 1143 bp, Artificial Sequence
  Description of Artificial Sequence: Synthetic coding sequence
atgggcatccagggcctggccaagctgatcgccgacgtggcccccagcgccatcagagagaacgacatcaagagctacttcggcagaaaggtggccatcgacgccagcatgagcatctaccagttcctgatcgccgtgagacagggcggcgacgtgctgcagaacgaggagggcgagaccaccagccacctgatgggcatgttctacagaaccatcagaatgatggagaacggcatcaagcccgtgtacgtgttcgacggcaagcccccccagctgaagagcggcgagctggccaagagaagcgagagaagagccgaggccgagaagcagctgcagcaggcccaggccgccggcgccgagcaggaggtggagaagttcaccaagagactggtgaaggtgaccaagcagcacaacgacgagtgcaagcacctgctgagcctgatgggcatcccctacctggacgcccccagcgaggccgaggccagctgcgccgccctggtgaaggccggcaaggtgtacgccgccgccaccgaggacatggactgcctgaccttcggcagccccgtgctgatgagacacctgaccgccagcgaggccaagaagctgcccatccaggagttccacctgagcagaatcctgcaggagctgggcctgaaccaggagcagttcgtggacctgtgcatcctgctgggcagcgactactgcgagagcatcagaggcatcggccccaagagagccgtggacctgatccagaagcacaagagcatcgaggagatcgtgagaagactggaccccaacaagtaccccgtgcccgagaactggctgcacaaggaggcccaccagctgttcctggagcccgaggtgctggaccccgagagcgtggagctgaagtggagcgagcccaacgaggaggagctgatcaagttcatgtgcggcgagaagcagttcagcgaggagagaatcagaagcggcgtgaagagactgagcaagagcagacagggcagcacccagggcagactggacgacttcttcaaggtgaccggcagcctgagcagcgccaagagaaaggagcccgagcccaagggcagcaccaagaagaaggccaagaccggcgccgccggcaagttcaagagaggcaagtag

SEQ ID NO: 10760 - DNA, 498 bp, Artificial Sequence
  Description of Artificial Sequence: Synthetic coding sequence
atgggcatccagggcctggccaagctgatcgccgacgtggcccccagcgccatcagagagaacgacatcaagagctacttcggcagaaaggtggccatcgacgccagcatgagcatctaccagttcctgatcgccgtgagacagggcggcgacgtgctgcagaacgaggagggcgagaccaccagccacctgatgggcatgttctacagaaccatcagaatgatggagaacggcatcaagcccgtgtacgtgttcgacggcaagcccccccagctgaagagcggcgagctggccaagagaagcgagagaagagccgaggccgagaagcagctgcagcaggcccaggccgccggcgccgagcaggaggtggagaagttcaccaagagactggtgaaggtgaccaagcagcacaacgacgagtgcaagcacctgctgagcctgatgggcatcccctacctggacgcccccagcgaggccgaggccagctgcgccgcctag

SEQ ID NO: 10761 - DNA, 4017 bp, Artificial Sequence
  Description of Artificial Sequence: Synthetic coding sequence
atggtgagctactgggacaccggcgtgctgctgtgcgccctgctgagctgcctgctgctgaccggcagcagcagcggcagcaagctgaaggaccccgagctgagcctgaagggcacccagcacatcatgcaggccggccagaccctgcacctgcagtgcagaggcgaggccgcccacaagtggagcctgcccgagatggtgagcaaggagagcgagagactgagcatcaccaagagcgcctgcggcagaaacggcaagcagttctgcagcaccctgaccctgaacaccgcccaggccaaccacaccggcttctacagctgcaagtacctggccgtgcccaccagcaagaagaaggagaccgagagcgccatctacatcttcatcagcgacaccggcagacccttcgtggagatgtacagcgagatccccgagatcatccacatgaccgagggcagagagctggtgatcccctgcagagtgaccagccccaacatcaccgtgaccctgaagaagttccccctggacaccctgatccccgacggcaagagaatcatctgggacagcagaaagggcttcatcatcagcaacgccacctacaaggagatcggcctgctgacctgcgaggccaccgtgaacggccacctgtacaagaccaactacctgacccacagacagaccaacaccatcatcgacgtgcagatcagcacccccagacccgtgaagctgctgagaggccacaccctggtgctgaactgcaccgccaccacccccctgaacaccagagtgcagatgacctggagctaccccgacgagaagaacaagagagccagcgtgagaagaagaatcgaccagagcaacagccacgccaacatcttctacagcgtgctgaccatcgacaagatgcagaacaaggacaagggcctgtacacctgcagagtgagaagcggccccagcttcaagagcgtgaacaccagcgtgcacatctacgacaaggccttcatcaccgtgaagcacagaaagcagcaggtgctggagaccgtggccggcaagagaagctacagactgagcatgaaggtgaaggccttccccagccccgaggtggtgtggctgaaggacggcctgcccgccaccgagaagagcgccagatacctgaccagaggctacagcctgatcatcaaggacgtgaccgaggaggacgccggcaactacaccatcctgctgagcatcaagcagagcaacgtgttcaagaacctgaccgccaccctgatcgtgaacgtgaagccccagatctacgagaaggccgtgagcagcttccccgaccccgccctgtaccccctgggcagcagacagatcctgacctgcaccgcctacggcatcccccagcccaccatcaagtggttctggcacccctgcaaccacaaccacagcgaggccagatgcgacttctgcagcaacaacgaggagagcttcatcctggacgccgacagcaacatgggcaacagaatcgagagcatcacccagagaatggccatcatcgagggcaagaacaagatggccagcaccctggtggtggccgacagcagaatcagcggcatctacatctgcatcgccagcaacaaggtgggcaccgtgggcagaaacatcagcttctacatcaccgacgtgcccaacggcttccacgtgaacctggagaagatgcccaccgagggcgaggacctgaagctgagctgcaccgtgaacaagttcctgtacagagacgtgacctggatcctgctgagaaccgtgaacaacagaaccatgcactacagcatcagcaagcagaagatggccatcaccaaggagcacagcatcaccctgaacctgaccatcatgaacgtgagcctgcaggacagcggcacctacgcctgcagagccagaaacgtgtacaccggcgaggagatcctgcagaagaaggagatcaccatcagagaccaggaggccccctacctgctgagaaacctgagcgaccacaccgtggccatcagcagcagcaccaccctggactgccacgccaacggcgtgcccgagccccagatcacctggttcaagaacaaccacaagatccagcaggagcccggcatcatcctgggccccggcagcagcaccctgttcatcgagagagtgaccgaggaggacgagggcgtgtaccactgcaaggccaccaaccagaagggcagcgtggagagcagcgcctacctgaccgtgcagggcaccagcgacaagagcaacctggagctgatcaccctgacctgcacctgcgtggccgccaccctgttctggctgctgctgaccctgttcatcagaaagatgaagagaagcagcagcgagatcaagaccgactacctgagcatcatcatggaccccgacgaggtgcccctggacgagcagtgcgagagactgccctacgacgccagcaagtgggagttcgccagagagagactgaagctgggcaagagcctgggcagaggcgccttcggcaaggtggtgcaggccagcgccttcggcatcaagaagagccccacctgcagaaccgtggccgtgaagatgctgaaggagggcgccaccgccagcgagtacaaggccctgatgaccgagctgaagatcctgacccacatcggccaccacctgaacgtggtgaacctgctgggcgcctgcaccaagcagggcggccccctgatggtgatcgtggagtactgcaagtacggcaacctgagcaactacctgaagagcaagagagacctgttcttcctgaacaaggacgccgccctgcacatggagcccaagaaggagaagatggagcccggcctggagcagggcaagaagcccagactggacagcgtgaccagcagcgagagcttcgccagcagcggcttccaggaggacaagagcctgagcgacgtggaggaggaggaggacagcgacggcttctacaaggagcccatcaccatggaggacctgatcagctacagcttccaggtggccagaggcatggagttcctgagcagcagaaagtgcatccacagagacctggccgccagaaacatcctgctgagcgagaacaacgtggtgaagatctgcgacttcggcctggccagagacatctacaagaaccccgactacgtgagaaagggcgacaccagactgcccctgaagtggatggcccccgagagcatcttcgacaagatctacagcaccaagagcgacgtgtggagctacggcgtgctgctgtgggagatcttcagcctgggcggcagcccctaccccggcgtgcagatggacgaggacttctgcagcagactgagagagggcatgagaatgagagcccccgagtacagcacccccgagatctaccagatcatgctggactgctggcacagagaccccaaggagagacccagattcgccgagctggtggagaagctgggcgacctgctgcaggccaacgtgcagcaggacggcaaggactacatccccatcaacgccatcctgaccggcaacagcggcttcacctacagcacccccgccttcagcgaggacttcttcaaggagagcatcagcgcccccaagttcaacagcggcagcagcgacgacgtgagatacgtgaacgccttcaagttcatgagcctggagagaatcaagaccttcgaggagctgctgcccaacgccaccagcatgttcgacgactaccagggcgacagcagcaccctgctggccagccccatgctgaagagattcacctggaccgacagcaagcccaaggccagcctgaagatcgacctgagagtgaccagcaagagcaaggagagcggcctgagcgacgtgagcagacccagcttctgccacagcagctgcggccacgtgagcgagggcaagagaagattcacctacgaccacgccgagctggagagaaagatcgcctgctgcagccccccccccgactacaacagcgtggtgctgtacagcaccccccccatctag

SEQ ID NO: 10762 - DNA, 531 bp, Artificial Sequence
  Description of Artificial Sequence: Synthetic coding sequence
atggtgagctactgggacaccggcgtgctgctgtgcgccctgctgagctgcctgctgctgaccggcagcagcagcggcagcaagctgaaggaccccgagctgagcctgaagggcacccagcacatcatgcaggccggccagaccctgcacctgcagtgcagaggcgaggccgcccacaagtggagcctgcccgagatggtgagcaaggagagcgagagactgagcatcaccaagagcgcctgcggcagaaacggcaagcagttctgcagcaccctgaccctgaacaccgcccaggccaaccacaccggcttctacagctgcaagtacctggccgtgcccaccagcaagaagaaggagaccgagagcgccatctacatcttcatcagcgacaccggcagacccttcgtggagatgtacagcgagatccccgagatcatccacatgaccgagggcagagagctggtgatcccctgcagagtgaccagccccaacatcaccgtgaccctgaagaagaagaacaagagagcctag

SEQ ID NO: 10763 - DNA, 1626 bp, Artificial Sequence
  Description of Artificial Sequence: Synthetic coding sequence
atggtgagctactgggacaccggcgtgctgctgtgcgccctgctgagctgcctgctgctgaccggcagcagcagcggcagcaagctgaaggaccccgagctgagcctgaagggcacccagcacatcatgcaggccggccagaccctgcacctgcagtgcagaggcgaggccgcccacaagtggagcctgcccgagatggtgagcaaggagagcgagagactgagcatcaccaagagcgcctgcggcagaaacggcaagcagttctgcagcaccctgaccctgaacaccgcccaggccaaccacaccggcttctacagctgcaagtacctggccgtgcccaccagcaagaagaaggagaccgagagcgccatctacatcttcatcagcgacaccggcagacccttcgtggagatgtacagcgagatccccgagatcatccacatgaccgagggcagagagctggtgatcccctgcagagtgaccagccccaacatcaccgtgaccctgaagaagttccccctggacaccctgatccccgacggcaagagaatcatctgggacagcagaaagggcttcatcatcagcaacgccacctacaaggagatcggcctgctgacctgcgaggccaccgtgaacggccacctgtacaagaccaactacctgacccacagacagaccaacaccatcatcgacgtgcagatcagcacccccagacccgtgaagctgctgagaggccacaccctggtgctgaactgcaccgccaccacccccctgaacaccagagtgcagatgacctggagctaccccgacgagaagaacaagagagccagcgtgagaagaagaatcgaccagagcaacagccacgccaacatcttctacagcgtgctgaccatcgacaagatgcagaacaaggacaagggcctgtacacctgcagagtgagaagcggccccagcttcaagagcgtgaacaccagcgtgcacatctacgacaaggccttcatcaccgtgaagcacagaaagcagcaggtgctggagaccgtggccggcaagagaagctacagactgagcatgaaggtgaaggccttccccagccccgaggtggtgtggctgaaggacggcctgcccgccaccgagaagagcgccagatacctgaccagaggctacagcctgatcatcaaggacgtgaccgaggaggacgccggcaactacaccatcctgctgagcatcaagcagagcaacgtgttcaagaacctgaccgccaccctgatcgtgaacgtgaagccccagatctacgagaaggccgtgagcagcttccccgaccccgccctgtaccccctgggcagcagacagatcctgacctgcaccgcctacggcatcccccagcccaccatcaagtggttctggcacccctgcaaccacaaccacagcgaggccagatgcgacttctgcagcaacaacgaggagagcttcatcctggacgccgacagcaacatgggcaacagaatcgagagcatcacccagagaatggccatcatcgagggcaagaacaagctgccccccgccaacagcagcttcatgctgccccccaccagcttcagcagcaactacttccacttcctgccctag

SEQ ID NO: 10764 - DNA, 1671 bp, Artificial Sequence
  Description of Artificial Sequence: Synthetic coding sequence
atgaagagaagcagcagcgagatcaagaccgactacctgagcatcatcatggaccccgacgaggtgcccctggacgagcagtgcgagagactgccctacgacgccagcaagtgggagttcgccagagagagactgaagctgggcaagagcctgggcagaggcgccttcggcaaggtggtgcaggccagcgccttcggcatcaagaagagccccacctgcagaaccgtggccgtgaagatgctgaaggagggcgccaccgccagcgagtacaaggccctgatgaccgagctgaagatcctgacccacatcggccaccacctgaacgtggtgaacctgctgggcgcctgcaccaagcagggcggccccctgatggtgatcgtggagtactgcaagtacggcaacctgagcaactacctgaagagcaagagagacctgttcttcctgaacaaggacgccgccctgcacatggagcccaagaaggagaagatggagcccggcctggagcagggcaagaagcccagactggacagcgtgaccagcagcgagagcttcgccagcagcggcttccaggaggacaagagcctgagcgacgtggaggaggaggaggacagcgacggcttctacaaggagcccatcaccatggaggacctgatcagctacagcttccaggtggccagaggcatggagttcctgagcagcagaaagtgcatccacagagacctggccgccagaaacatcctgctgagcgagaacaacgtggtgaagatctgcgacttcggcctggccagagacatctacaagaaccccgactacgtgagaaagggcgacaccagactgcccctgaagtggatggcccccgagagcatcttcgacaagatctacagcaccaagagcgacgtgtggagctacggcgtgctgctgtgggagatcttcagcctgggcggcagcccctaccccggcgtgcagatggacgaggacttctgcagcagactgagagagggcatgagaatgagagcccccgagtacagcacccccgagatctaccagatcatgctggactgctggcacagagaccccaaggagagacccagattcgccgagctggtggagaagctgggcgacctgctgcaggccaacgtgcagcaggacggcaaggactacatccccatcaacgccatcctgaccggcaacagcggcttcacctacagcacccccgccttcagcgaggacttcttcaaggagagcatcagcgcccccaagttcaacagcggcagcagcgacgacgtgagatacgtgaacgccttcaagttcatgagcctggagagaatcaagaccttcgaggagctgctgcccaacgccaccagcatgttcgacgactaccagggcgacagcagcaccctgctggccagccccatgctgaagagattcacctggaccgacagcaagcccaaggccagcctgaagatcgacctgagagtgaccagcaagagcaaggagagcggcctgagcgacgtgagcagacccagcttctgccacagcagctgcggccacgtgagcgagggcaagagaagattcacctacgaccacgccgagctggagagaaagatcgcctgctgcagccccccccccgactacaacagcgtggtgctgtacagcaccccccccatctag

SEQ ID NO: 10765 - DNA, 45 bp, Artificial Sequence
  Description of Artificial Sequence: Synthetic coding sequence
gagctgagcaacttcgagtgcctgcacccctgcagccaggagtag

SEQ ID NO: 10766 - DNA, 2202 bp, Artificial Sequence
  Description of Artificial Sequence: Synthetic coding sequence
atggtgagctactgggacaccggcgtgctgctgtgcgccctgctgagctgcctgctgctgaccggcagcagcagcggcagcaagctgaaggaccccgagctgagcctgaagggcacccagcacatcatgcaggccggccagaccctgcacctgcagtgcagaggcgaggccgcccacaagtggagcctgcccgagatggtgagcaaggagagcgagagactgagcatcaccaagagcgcctgcggcagaaacggcaagcagttctgcagcaccctgaccctgaacaccgcccaggccaaccacaccggcttctacagctgcaagtacctggccgtgcccaccagcaagaagaaggagaccgagagcgccatctacatcttcatcagcgacaccggcagacccttcgtggagatgtacagcgagatccccgagatcatccacatgaccgagggcagagagctggtgatcccctgcagagtgaccagccccaacatcaccgtgaccctgaagaagttccccctggacaccctgatccccgacggcaagagaatcatctgggacagcagaaagggcttcatcatcagcaacgccacctacaaggagatcggcctgctgacctgcgaggccaccgtgaacggccacctgtacaagaccaactacctgacccacagacagaccaacaccatcatcgacgtgcagatcagcacccccagacccgtgaagctgctgagaggccacaccctggtgctgaactgcaccgccaccacccccctgaacaccagagtgcagatgacctggagctaccccgacgagaagaacaagagagccagcgtgagaagaagaatcgaccagagcaacagccacgccaacatcttctacagcgtgctgaccatcgacaagatgcagaacaaggacaagggcctgtacacctgcagagtgagaagcggccccagcttcaagagcgtgaacaccagcgtgcacatctacgacaaggccttcatcaccgtgaagcacagaaagcagcaggtgctggagaccgtggccggcaagagaagctacagactgagcatgaaggtgaaggccttccccagccccgaggtggtgtggctgaaggacggcctgcccgccaccgagaagagcgccagatacctgaccagaggctacagcctgatcatcaaggacgtgaccgaggaggacgccggcaactacaccatcctgctgagcatcaagcagagcaacgtgttcaagaacctgaccgccaccctgatcgtgaacgtgaagccccagatctacgagaaggccgtgagcagcttccccgaccccgccctgtaccccctgggcagcagacagatcctgacctgcaccgcctacggcatcccccagcccaccatcaagtggttctggcacccctgcaaccacaaccacagcgaggccagatgcgacttctgcagcaacaacgaggagagcttcatcctggacgccgacagcaacatgggcaacagaatcgagagcatcacccagagaatggccatcatcgagggcaagaacaagatggccagcaccctggtggtggccgacagcagaatcagcggcatctacatctgcatcgccagcaacaaggtgggcaccgtgggcagaaacatcagcttctacatcaccgacgtgcccaacggcttccacgtgaacctggagaagatgcccaccgagggcgaggacctgaagctgagctgcaccgtgaacaagttcctgtacagagacgtgacctggatcctgctgagaaccgtgaacaacagaaccatgcactacagcatcagcaagcagaagatggccatcaccaaggagcacagcatcaccctgaacctgaccatcatgaacgtgagcctgcaggacagcggcacctacgcctgcagagccagaaacgtgtacaccggcgaggagatcctgcagaagaaggagatcaccatcagagaccaggaggccccctacctgctgagaaacctgagcgaccacaccgtggccatcagcagcagcaccaccctggactgccacgccaacggcgtgcccgagccccagatcacctggttcaagaacaaccacaagatccagcaggagcccgagctgtacaccagcaccagccccagcagcagcagcagcagccccctgagcagcagcagcagcagcagcagcagcagcagcagctag

SEQ ID NO: 10767 - DNA, 1086 bp, Artificial Sequence
  Description of Artificial Sequence: Synthetic coding sequence
atgaacagcgacctgctggtggacagcgacggcttctacaaggagcccatcaccatggaggacctgatcagctacagcttccaggtggccagaggcatggagttcctgagcagcagaaagtgcatccacagagacctggccgccagaaacatcctgctgagcgagaacaacgtggtgaagatctgcgacttcggcctggccagagacatctacaagaaccccgactacgtgagaaagggcgacaccagactgcccctgaagtggatggcccccgagagcatcttcgacaagatctacagcaccaagagcgacgtgtggagctacggcgtgctgctgtgggagatcttcagcctgggcggcagcccctaccccggcgtgcagatggacgaggacttctgcagcagactgagagagggcatgagaatgagagcccccgagtacagcacccccgagatctaccagatcatgctggactgctggcacagagaccccaaggagagacccagattcgccgagctggtggagaagctgggcgacctgctgcaggccaacgtgcagcaggacggcaaggactacatccccatcaacgccatcctgaccggcaacagcggcttcacctacagcacccccgccttcagcgaggacttcttcaaggagagcatcagcgcccccaagttcaacagcggcagcagcgacgacgtgagatacgtgaacgccttcaagttcatgagcctggagagaatcaagaccttcgaggagctgctgcccaacgccaccagcatgttcgacgactaccagggcgacagcagcaccctgctggccagccccatgctgaagagattcacctggaccgacagcaagcccaaggccagcctgaagatcgacctgagagtgaccagcaagagcaaggagagcggcctgagcgacgtgagcagacccagcttctgccacagcagctgcggccacgtgagcgagggcaagagaagattcacctacgaccacgccgagctggagagaaagatcgcctgctgcagccccccccccgactacaacagcgtggtgctgtacagcaccccccccatctag

SEQ ID NO: 10768 - DNA, 75 bp, Artificial Sequence
  Description of Artificial Sequence: Synthetic coding sequence
ctgccccccgccaacagcagcttcatgctgccccccaccagcttcagcagcaactacttccacttcctgccctag

SEQ ID NO: 10769 - DNA, 1062 bp, Artificial Sequence
  Description of Artificial Sequence: Synthetic coding sequence
atggagctgaccgagctgctgctggtggtgatgctgctgctgaccgccagactgaccctgagcagccccgccccccccgcctgcgacctgagagtgctgagcaagctgctgagagacagccacgtgctgcacagcagactgagccagtgccccgaggtgcaccccctgcccacccccgtgctgctgcccgccgtggacttcagcctgggcgagtggaagacccagatggaggagaccaaggcccaggacatcctgggcgccgtgaccctgctgctggagggcgtgatggccgccagaggccagctgggccccacctgcctgagcagcctgctgggccagctgagcggccaggtgagactgctgctgggcgccctgcagagcctgctgggcacccagctgcccccccagggcagaaccaccgcccacaaggaccccaacgccatcttcctgagcttccagcacctgctgagaggcaaggtgagattcctgatgctggtgggcggcagcaccctgtgcgtgagaagagccccccccaccaccgccgtgcccagcagaaccagcctggtgctgaccctgaacgagctgcccaacagaaccagcggcctgctggagaccaacttcaccgccagcgccagaaccaccggcagcggcctgctgaagtggcagcagggcttcagagccaagatccccggcctgctgaaccagaccagcagaagcctggaccagatccccggctacctgaacagaatccacgagctgctgaacggcaccagaggcctgttccccggccccagcagaagaaccctgggcgcccccgacatcagcagcggcaccagcgacaccggcagcctgccccccaacctgcagcccggctacagccccagccccacccacccccccaccggccagtacaccctgttccccctgccccccaccctgcccacccccgtggtgcagctgcaccccctgctgcccgaccccagcgcccccacccccacccccaccagccccctgctgaacaccagctacacccacagccagaacctgagccaggagggctag

SEQ ID NO: 10770 - DNA, 537 bp, Artificial Sequence
  Description of Artificial Sequence: Synthetic coding sequence
atgaccgtgctggcccccgcctggagccccaccacctacctgctgctgctgctgctgctgagcagcggcctgagcggcacccaggactgcagcttccagcacagccccatcagcagcgacttcgccgtgaagatcagagagctgagcgactacctgctgcaggactaccccgtgaccgtggccagcaacctgcaggacgaggagctgtgcggcggcctgtggagactggtgctggcccagagatggatggagagactgaagaccgtggccggcagcaagatgcagggcctgctggagagagtgaacaccgagatccacttcgtgaccaagtgcgccttccagcccccccccagctgcctgagattcgtgcagaccaacatcagcagactgctgcaggagaccagcgagcagctggtggccctgaagccctggatcaccagacagaacttcagcagatgcctggagctgcagtgccagcccgtggagaccgtgttccacagagtgagccaggacggcctggacctgctgaccagctag

SEQ ID NO: 10771 - DNA, 708 bp, Artificial Sequence
  Description of Artificial Sequence: Synthetic coding sequence
atgaccgtgctggcccccgcctggagccccaccacctacctgctgctgctgctgctgctgagcagcggcctgagcggcacccaggactgcagcttccagcacagccccatcagcagcgacttcgccgtgaagatcagagagctgagcgactacctgctgcaggactaccccgtgaccgtggccagcaacctgcaggacgaggagctgtgcggcggcctgtggagactggtgctggcccagagatggatggagagactgaagaccgtggccggcagcaagatgcagggcctgctggagagagtgaacaccgagatccacttcgtgaccaagtgcgccttccagcccccccccagctgcctgagattcgtgcagaccaacatcagcagactgctgcaggagaccagcgagcagctggtggccctgaagccctggatcaccagacagaacttcagcagatgcctggagctgcagtgccagcccgacagcagcaccctgccccccccctggagccccagacccctggaggccaccgcccccaccgccccccagccccccctgctgctgctgctgctgctgcccgtgggcctgctgctgctggccgccgcctggtgcctgcactggcagagaaccagaagaagaacccccagacccggcgagcaggtgccccccgtgcccagcccccaggacctgctgctggtggagcactag

SEQ ID NO: 10772 - DNA, 4092 bp, Artificial Sequence
  Description of Artificial Sequence: Synthetic coding sequence
atgcagagaggcgccgccctgtgcctgagactgtggctgtgcctgggcctgctggacggcctggtgagcggctacagcatgaccccccccaccctgaacatcaccgaggagagccacgtgatcgacaccggcgacagcctgagcatcagctgcagaggccagcaccccctggagtgggcctggcccggcgcccaggaggcccccgccaccggcgacaaggacagcgaggacaccggcgtggtgagagactgcgagggcaccgacgccagaccctactgcaaggtgctgctgctgcacgaggtgcacgccaacgacaccggcagctacgtgtgctactacaagtacatcaaggccagaatcgagggcaccaccgccgccagcagctacgtgttcgtgagagacttcgagcagcccttcatcaacaagcccgacaccctgctggtgaacagaaaggacgccatgtgggtgccctgcctggtgagcatccccggcctgaacgtgaccctgagaagccagagcagcgtgctgtggcccgacggccaggaggtggtgtgggacgacagaagaggcatgctggtgagcacccccctgctgcacgacgccctgtacctgcagtgcgagaccacctggggcgaccaggacttcctgagcaaccccttcctggtgcacatcaccggcaacgagctgtacgacatccagctgctgcccagaaagagcctggagctgctggtgggcgagaagctggtgctgaactgcaccgtgtgggccgagttcaacagcggcgtgaccttcgactgggactaccccggcaagcaggccgagagaggcaagtgggtgcccgagagaagaagccagcagacccacaccgagctgagcagcatcctgaccatccacaacgtgagccagcacgacctgggcagctacgtgtgcaaggccaacaacggcatccagagattcagagagagcaccgaggtgatcgtgcacgagaaccccttcatcagcgtggagtggctgaagggccccatcctggaggccaccgccggcgacgagctggtgaagctgcccgtgaagctggccgcctaccccccccccgagttccagtggtacaaggacggcaaggccctgagcggcagacacagcccccacgccctggtgctgaaggaggtgaccgaggccagcaccggcacctacaccctggccctgtggaacagcgccgccggcctgagaagaaacatcagcctggagctggtggtgaacgtgcccccccagatccacgagaaggaggccagcagccccagcatctacagcagacacagcagacaggccctgacctgcaccgcctacggcgtgcccctgcccctgagcatccagtggcactggagaccctggaccccctgcaagatgttcgcccagagaagcctgagaagaagacagcagcaggacctgatgccccagtgcagagactggagagccgtgaccacccaggacgccgtgaaccccatcgagagcctggacacctggaccgagttcgtggagggcaagaacaagaccgtgagcaagctggtgatccagaacgccaacgtgagcgccatgtacaagtgcgtggtgagcaacaaggtgggccaggacgagagactgatctacttctacgtgaccaccatccccgacggcttcaccatcgagagcaagcccagcgaggagctgctggagggccagcccgtgctgctgagctgccaggccgacagctacaagtacgagcacctgagatggtacagactgaacctgagcaccctgcacgacgcccacggcaaccccctgctgctggactgcaagaacgtgcacctgttcgccacccccctggccgccagcctggaggaggtggcccccggcgccagacacgccaccctgagcctgagcatccccagagtggcccccgagcacgagggccactacgtgtgcgaggtgcaggacagaagaagccacgacaagcactgccacaagaagtacctgagcgtgcaggccctggaggcccccagactgacccagaacctgaccgacctgctggtgaacgtgagcgacagcctggagatgcagtgcctggtggccggcgcccacgcccccagcatcgtgtggtacaaggacgagagactgctggaggagaagagcggcgtggacctggccgacagcaaccagaagctgagcatccagagagtgagagaggaggacgccggcagatacctgtgcagcgtgtgcaacgccaagggctgcgtgaacagcagcgccagcgtggccgtggagggcagcgaggacaagggcagcatggagatcgtgatcctggtgggcaccggcgtgatcgccgtgttcttctgggtgctgctgctgctgatcttctgcaacatgagaagacccgcccacgccgacatcaagaccggctacctgagcatcatcatggaccccggcgaggtgcccctggaggagcagtgcgagtacctgagctacgacgccagccagtgggagttccccagagagagactgcacctgggcagagtgctgggctacggcgccttcggcaaggtggtggaggccagcgccttcggcatccacaagggcagcagctgcgacaccgtggccgtgaagatgctgaaggagggcgccaccgccagcgagcacagagccctgatgagcgagctgaagatcctgatccacatcggcaaccacctgaacgtggtgaacctgctgggcgcctgcaccaagccccagggccccctgatggtgatcgtggagttctgcaagtacggcaacctgagcaacttcctgagagccaagagagacgccttcagcccctgcgccgagaagagccccgagcagagaggcagattcagagccatggtggagctggccagactggacagaagaagacccggcagcagcgacagagtgctgttcgccagattcagcaagaccgagggcggcgccagaagagccagccccgaccaggaggccgaggacctgtggctgagccccctgaccatggaggacctggtgtgctacagcttccaggtggccagaggcatggagttcctggccagcagaaagtgcatccacagagacctggccgccagaaacatcctgctgagcgagagcgacgtggtgaagatctgcgacttcggcctggccagagacatctacaaggaccccgactacgtgagaaagggcagcgccagactgcccctgaagtggatggcccccgagagcatcttcgacaaggtgtacaccacccagagcgacgtgtggagcttcggcgtgctgctgtgggagatcttcagcctgggcgccagcccctaccccggcgtgcagatcaacgaggagttctgccagagactgagagacggcaccagaatgagagcccccgagctggccacccccgccatcagaagaatcatgctgaactgctggagcggcgaccccaaggccagacccgccttcagcgagctggtggagatcctgggcgacctgctgcagggcagaggcctgcaggaggaggaggaggtgtgcatggcccccagaagcagccagagcagcgaggagggcagcttcagccaggtgagcaccatggccctgcacatcgcccaggccgacgccgaggacagcccccccagcctgcagagacacagcctggccgccagatactacaactgggtgagcttccccggctgcctggccagaggcgccgagaccagaggcagcagcagaatgaagaccttcgaggagttccccatgacccccaccacctacaagggcagcgtggacaaccagaccgacagcggcatggtgctggccagcgaggagttcgagcagatcgagagcagacacagacaggagagcggcttcagctgcaagggccccggccagaacgtggccgtgaccagagcccaccccgacagccagggcagaagaagaagacccgagagaggcgccagaggcggccaggtgttctacaacagcgagtacggcgagctgagcgagcccagcgaggaggaccactgcagccccagcgccagagtgaccttcttcaccgacaacagctactag

SEQ ID NO: 10773 - DNA, 2283 bp, Artificial Sequence
  Description of Artificial Sequence: Synthetic coding sequence
atgctggtgagcacccccctgctgcacgacgccctgtacctgcagtgcgagaccacctggggcgaccaggacttcctgagcaaccccttcctggtgcacatcaccggcaacgagctgtacgacatccagctgctgcccagaaagagcctggagctgctggtgggcgagaagctggtgctgaactgcaccgtgtgggccgagttcaacagcggcgtgaccttcgactgggactaccccggcaagcaggccgagagaggcaagtgggtgcccgagagaagaagccagcagacccacaccgagctgagcagcatcctgaccatccacaacgtgagccagcacgacctgggcagctacgtgtgcaaggccaacaacggcatccagagattcagagagagcaccgaggtgatcgtgcacgagaaccccttcatcagcgtggagtggctgaagggccccatcctggaggccaccgccggcgacgagctggtgaagctgcccgtgaagctggccgcctaccccccccccgagttccagtggtacaaggacggcaaggccctgagcggcagacacagcccccacgccctggtgctgaaggaggtgaccgaggccagcaccggcacctacaccctggccctgtggaacagcgccgccggcctgagaagaaacatcagcctggagctggtggtgaacgtgcccccccagatccacgagaaggaggccagcagccccagcatctacagcagacacagcagacaggccctgacctgcaccgcctacggcgtgcccctgcccctgagcatccagtggcactggagaccctggaccccctgcaagatgttcgcccagagaagcctgagaagaagacagcagcaggacctgatgccccagtgcagagactggagagccgtgaccacccaggacgccgtgaaccccatcgagagcctggacacctggaccgagttcgtggagggcaagaacaagaccgtgagcaagctggtgatccagaacgccaacgtgagcgccatgtacaagtgcgtggtgagcaacaaggtgggccaggacgagagactgatctacttctacgtgaccaccatccccgacggcttcaccatcgagagcaagcccagcgaggagctgctggagggccagcccgtgctgctgagctgccaggccgacagctacaagtacgagcacctgagatggtacagactgaacctgagcaccctgcacgacgcccacggcaaccccctgctgctggactgcaagaacgtgcacctgttcgccacccccctggccgccagcctggaggaggtggcccccggcgccagacacgccaccctgagcctgagcatccccagagtggcccccgagcacgagggccactacgtgtgcgaggtgcaggacagaagaagccacgacaagcactgccacaagaagtacctgagcgtgcaggccctggaggcccccagactgacccagaacctgaccgacctgctggtgaacgtgagcgacagcctggagatgcagtgcctggtggccggcgcccacgcccccagcatcgtgtggtacaaggacgagagactgctggaggagaagagcggcgtggacctggccgacagcaaccagaagctgagcatccagagagtgagagaggaggacgccggcagatacctgtgcagcgtgtgcaacgccaagggctgcgtgaacagcagcgccagcgtggccgtggagggcagcgaggacaagggcagcatggagatcgtgatcctggtgggcaccggcgtgatcgccgtgttcttctgggtgctgctgctgctgatcttctgcaacatgagaagacccgcccacgccgacatcaagaccggctacctgagcatcatcatggaccccggcgaggtgcccctggaggagcagtgcgagtacctgagctacgacgccagccagtgggagttccccagagagagactgcacctgggcagagtgctgggctacggcgccttcggcaaggtggtggaggccagcgccttcggcatccacaagggcagcagctgcgacaccgtggccgtgaagatgctgaagggcgtgggcagcgccggcggcagaggcagcctggccggcgaggagcagcagctgggcgtgggcagatgggacggcaacagcggcagagagaccgaggccggcagccagagccaccccagattctacagagaggccgccggcttcagagccgagggcccccccgagccccccagcgtgggccccgccggctgccccggcggcccctag

SEQ ID NO: 10774 - DNA, 3897 bp, Artificial Sequence
  Description of Artificial Sequence: Synthetic coding sequence
atgcagagaggcgccgccctgtgcctgagactgtggctgtgcctgggcctgctggacggcctggtgagcggctacagcatgaccccccccaccctgaacatcaccgaggagagccacgtgatcgacaccggcgacagcctgagcatcagctgcagaggccagcaccccctggagtgggcctggcccggcgcccaggaggcccccgccaccggcgacaaggacagcgaggacaccggcgtggtgagagactgcgagggcaccgacgccagaccctactgcaaggtgctgctgctgcacgaggtgcacgccaacgacaccggcagctacgtgtgctactacaagtacatcaaggccagaatcgagggcaccaccgccgccagcagctacgtgttcgtgagagacttcgagcagcccttcatcaacaagcccgacaccctgctggtgaacagaaaggacgccatgtgggtgccctgcctggtgagcatccccggcctgaacgtgaccctgagaagccagagcagcgtgctgtggcccgacggccaggaggtggtgtgggacgacagaagaggcatgctggtgagcacccccctgctgcacgacgccctgtacctgcagtgcgagaccacctggggcgaccaggacttcctgagcaaccccttcctggtgcacatcaccggcaacgagctgtacgacatccagctgctgcccagaaagagcctggagctgctggtgggcgagaagctggtgctgaactgcaccgtgtgggccgagttcaacagcggcgtgaccttcgactgggactaccccggcaagcaggccgagagaggcaagtgggtgcccgagagaagaagccagcagacccacaccgagctgagcagcatcctgaccatccacaacgtgagccagcacgacctgggcagctacgtgtgcaaggccaacaacggcatccagagattcagagagagcaccgaggtgatcgtgcacgagaaccccttcatcagcgtggagtggctgaagggccccatcctggaggccaccgccggcgacgagctggtgaagctgcccgtgaagctggccgcctaccccccccccgagttccagtggtacaaggacggcaaggccctgagcggcagacacagcccccacgccctggtgctgaaggaggtgaccgaggccagcaccggcacctacaccctggccctgtggaacagcgccgccggcctgagaagaaacatcagcctggagctggtggtgaacgtgcccccccagatccacgagaaggaggccagcagccccagcatctacagcagacacagcagacaggccctgacctgcaccgcctacggcgtgcccctgcccctgagcatccagtggcactggagaccctggaccccctgcaagatgttcgcccagagaagcctgagaagaagacagcagcaggacctgatgccccagtgcagagactggagagccgtgaccacccaggacgccgtgaaccccatcgagagcctggacacctggaccgagttcgtggagggcaagaacaagaccgtgagcaagctggtgatccagaacgccaacgtgagcgccatgtacaagtgcgtggtgagcaacaaggtgggccaggacgagagactgatctacttctacgtgaccaccatccccgacggcttcaccatcgagagcaagcccagcgaggagctgctggagggccagcccgtgctgctgagctgccaggccgacagctacaagtacgagcacctgagatggtacagactgaacctgagcaccctgcacgacgcccacggcaaccccctgctgctggactgcaagaacgtgcacctgttcgccacccccctggccgccagcctggaggaggtggcccccggcgccagacacgccaccctgagcctgagcatccccagagtggcccccgagcacgagggccactacgtgtgcgaggtgcaggacagaagaagccacgacaagcactgccacaagaagtacctgagcgtgcaggccctggaggcccccagactgacccagaacctgaccgacctgctggtgaacgtgagcgacagcctggagatgcagtgcctggtggccggcgcccacgcccccagcatcgtgtggtacaaggacgagagactgctggaggagaagagcggcgtggacctggccgacagcaaccagaagctgagcatccagagagtgagagaggaggacgccggcagatacctgtgcagcgtgtgcaacgccaagggctgcgtgaacagcagcgccagcgtggccgtggagggcagcgaggacaagggcagcatggagatcgtgatcctggtgggcaccggcgtgatcgccgtgttcttctgggtgctgctgctgctgatcttctgcaacatgagaagacccgcccacgccgacatcaagaccggctacctgagcatcatcatggaccccggcgaggtgcccctggaggagcagtgcgagtacctgagctacgacgccagccagtgggagttccccagagagagactgcacctgggcagagtgctgggctacggcgccttcggcaaggtggtggaggccagcgccttcggcatccacaagggcagcagctgcgacaccgtggccgtgaagatgctgaaggagggcgccaccgccagcgagcacagagccctgatgagcgagctgaagatcctgatccacatcggcaaccacctgaacgtggtgaacctgctgggcgcctgcaccaagccccagggccccctgatggtgatcgtggagttctgcaagtacggcaacctgagcaacttcctgagagccaagagagacgccttcagcccctgcgccgagaagagccccgagcagagaggcagattcagagccatggtggagctggccagactggacagaagaagacccggcagcagcgacagagtgctgttcgccagattcagcaagaccgagggcggcgccagaagagccagccccgaccaggaggccgaggacctgtggctgagccccctgaccatggaggacctggtgtgctacagcttccaggtggccagaggcatggagttcctggccagcagaaagtgcatccacagagacctggccgccagaaacatcctgctgagcgagagcgacgtggtgaagatctgcgacttcggcctggccagagacatctacaaggaccccgactacgtgagaaagggcagcgccagactgcccctgaagtggatggcccccgagagcatcttcgacaaggtgtacaccacccagagcgacgtgtggagcttcggcgtgctgctgtgggagatcttcagcctgggcgccagcccctaccccggcgtgcagatcaacgaggagttctgccagagactgagagacggcaccagaatgagagcccccgagctggccacccccgccatcagaagaatcatgctgaactgctggagcggcgaccccaaggccagacccgccttcagcgagctggtggagatcctgggcgacctgctgcagggcagaggcctgcaggaggaggaggaggtgtgcatggcccccagaagcagccagagcagcgaggagggcagcttcagccaggtgagcaccatggccctgcacatcgcccaggccgacgccgaggacagcccccccagcctgcagagacacagcctggccgccagatactacaactgggtgagcttccccggctgcctggccagaggcgccgagaccagaggcagcagcagaatgaagaccttcgaggagttccccatgacccccaccacctacaagggcagcgtggacaaccagaccgacagcggcatggtgctggccagcgaggagttcgagcagatcgagagcagacacagacaggagagcggcttcagatag

SEQ ID NO: 10775 - DNA, 3921 bp, Artificial Sequence
  Description of Artificial Sequence: Synthetic coding sequence
atgcagagaggcgccgccctgtgcctgagactgtggctgtgcctgggcctgctggacggcctggtgagcggctacagcatgaccccccccaccctgaacatcaccgaggagagccacgtgatcgacaccggcgacagcctgagcatcagctgcagaggccagcaccccctggagtgggcctggcccggcgcccaggaggcccccgccaccggcgacaaggacagcgaggacaccggcgtggtgagagactgcgagggcaccgacgccagaccctactgcaaggtgctgctgctgcacgaggtgcacgccaacgacaccggcagctacgtgtgctactacaagtacatcaaggccagaatcgagggcaccaccgccgccagcagctacgtgttcgtgagagacttcgagcagcccttcatcaacaagcccgacaccctgctggtgaacagaaaggacgccatgtgggtgccctgcctggtgagcatccccggcctgaacgtgaccctgagaagccagagcagcgtgctgtggcccgacggccaggaggtggtgtgggacgacagaagaggcatgctggtgagcacccccctgctgcacgacgccctgtacctgcagtgcgagaccacctggggcgaccaggacttcctgagcaaccccttcctggtgcacatcaccggcaacgagctgtacgacatccagctgctgcccagaaagagcctggagctgctggtgggcgagaagctggtgctgaactgcaccgtgtgggccgagttcaacagcggcgtgaccttcgactgggactaccccggcaagcaggccgagagaggcaagtgggtgcccgagagaagaagccagcagacccacaccgagctgagcagcatcctgaccatccacaacgtgagccagcacgacctgggcagctacgtgtgcaaggccaacaacggcatccagagattcagagagagcaccgaggtgatcgtgcacgagaaccccttcatcagcgtggagtggctgaagggccccatcctggaggccaccgccggcgacgagctggtgaagctgcccgtgaagctggccgcctaccccccccccgagttccagtggtacaaggacggcaaggccctgagcggcagacacagcccccacgccctggtgctgaaggaggtgaccgaggccagcaccggcacctacaccctggccctgtggaacagcgccgccggcctgagaagaaacatcagcctggagctggtggtgaacgtgcccccccagatccacgagaaggaggccagcagccccagcatctacagcagacacagcagacaggccctgacctgcaccgcctacggcgtgcccctgcccctgagcatccagtggcactggagaccctggaccccctgcaagatgttcgcccagagaagcctgagaagaagacagcagcaggacctgatgccccagtgcagagactggagagccgtgaccacccaggacgccgtgaaccccatcgagagcctggacacctggaccgagttcgtggagggcaagaacaagaccgtgagcaagctggtgatccagaacgccaacgtgagcgccatgtacaagtgcgtggtgagcaacaaggtgggccaggacgagagactgatctacttctacgtgaccaccatccccgacggcttcaccatcgagagcaagcccagcgaggagctgctggagggccagcccgtgctgctgagctgccaggccgacagctacaagtacgagcacctgagatggtacagactgaacctgagcaccctgcacgacgcccacggcaaccccctgctgctggactgcaagaacgtgcacctgttcgccacccccctggccgccagcctggaggaggtggcccccggcgccagacacgccaccctgagcctgagcatccccagagtggcccccgagcacgagggccactacgtgtgcgaggtgcaggacagaagaagccacgacaagcactgccacaagaagtacctgagcgtgcaggccctggaggcccccagactgacccagaacctgaccgacctgctggtgaacgtgagcgacagcctggagatgcagtgcctggtggccggcgcccacgcccccagcatcgtgtggtacaaggacgagagactgctggaggagaagagcggcgtggacctggccgacagcaaccagaagctgagcatccagagagtgagagaggaggacgccggcagatacctgtgcagcgtgtgcaacgccaagggctgcgtgaacagcagcgccagcgtggccgtggagggcagcgaggacaagggcagcatggagatcgtgatcctggtgggcaccggcgtgatcgccgtgttcttctgggtgctgctgctgctgatcttctgcaacatgagaagacccgcccacgccgacatcaagaccggctacctgagcatcatcatggaccccggcgaggtgcccctggaggagcagtgcgagtacctgagctacgacgccagccagtgggagttccccagagagagactgcacctgggcagagtgctgggctacggcgccttcggcaaggtggtggaggccagcgccttcggcatccacaagggcagcagctgcgacaccgtggccgtgaagatgctgaaggagggcgccaccgccagcgagcacagagccctgatgagcgagctgaagatcctgatccacatcggcaaccacctgaacgtggtgaacctgctgggcgcctgcaccaagccccagggccccctgatggtgatcgtggagttctgcaagtacggcaacctgagcaacttcctgagagccaagagagacgccttcagcccctgcgccgagaagagccccgagcagagaggcagattcagagccatggtggagctggccagactggacagaagaagacccggcagcagcgacagagtgctgttcgccagattcagcaagaccgagggcggcgccagaagagccagccccgaccaggaggccgaggacctgtggctgagccccctgaccatggaggacctggtgtgctacagcttccaggtggccagaggcatggagttcctggccagcagaaagtgcatccacagagacctggccgccagaaacatcctgctgagcgagagcgacgtggtgaagatctgcgacttcggcctggccagagacatctacaaggaccccgactacgtgagaaagggcagcgccagactgcccctgaagtggatggcccccgagagcatcttcgacaaggtgtacaccacccagagcgacgtgtggagcttcggcgtgctgctgtgggagatcttcagcctgggcgccagcccctaccccggcgtgcagatcaacgaggagttctgccagagactgagagacggcaccagaatgagagcccccgagctggccacccccgccatcagaagaatcatgctgaactgctggagcggcgaccccaaggccagacccgccttcagcgagctggtggagatcctgggcgacctgctgcagggcagaggcctgcaggaggaggaggaggtgtgcatggcccccagaagcagccagagcagcgaggagggcagcttcagccaggtgagcaccatggccctgcacatcgcccaggccgacgccgaggacagcccccccagcctgcagagacacagcctggccgccagatactacaactgggtgagcttccccggctgcctggccagaggcgccgagaccagaggcagcagcagaatgaagaccttcgaggagttccccatgacccccaccacctacaagggcagcgtggacaaccagaccgacagcggcatggtgctggccagcgaggagttcgagcagatcgagagcagacacagacaggagagcggcttcagaggcaccagaagaaccagaggcgcctag

SEQ ID NO: 10776 - DNA, 1740 bp, Artificial Sequence
  Description of Artificial Sequence: Synthetic coding sequence
atgaacgccatcgtggccctgtgccacttctgcgagctgcacggccccagaaccctgttctgcaccgaggtgctgcacgcccccctgccccagggcgacggcaacgaggacagccccggccagggcgagcaggccgaggaggaggagggcggcatccagatgaacagcagaatgagagcccacagccccgccgagggcgccagcgtggagagcagcagccccggccccaagaagagcgacatgtgcgagggctgcagaagcctggccgccggccaccccggctacatcagccacgacaaggagaccagcatcaagtacgtgagccaccagcaccccagccacccccagctgttcagcatcgtgagacaggcctgcgtgagaagcctgagctgcgaggtgtgccccggcagagagggccccatcttcttcggcgacgagcagcacggcttcgtgttcagccacaccttcttcatcaaggacagcctggccagaggcttccagagatggtacagcatcatcaccatcatgatggacagaatctacctgatcaacagctggcccttcctgctgggcaaggtgagaggcatcatcgacgagctgcagggcaaggccctgaaggtgttcgaggccgagcagttcggctgcccccagagagcccagagaatgaacaccgccttcacccccttcctgcaccagagaaacggcaacgccgccagaagcctgaccagcctgaccagcgacgacaacctgtgggcctgcctgcacaccagcttcgcctggctgctgaaggcctgcggcagcagactgaccgagaagctgctggagggcgcccccaccgaggacaccctggtgcagatggagaagctggccgacctggaggaggagagcgagagctgggacaacagcgaggccgaggaggaggagaaggcccccgtgctgcccgagagcaccgagggcagagagctgacccagggccccgccgagagcagcagcctgagcggctgcggcagctggcagcccagaaagctgcccgtgttcaagagcctgagacacatgagacaggtgctgggcgcccccagcttcagaatgctggcctggcacgtgctgatgggcaaccaggtgatctggaagagcagagacgtggacctggtgcagagcgccttcgaggtgctgagaaccatgctgcccgtgggctgcgtgagaatcatcccctacagcagccagtacgaggaggcctacagatgcaacttcctgggcctgagcccccacgtgcagatccccccccacgtgctgagcagcgagttcgccgtgatcgtggaggtgcacgccgccgccagaagcaccctgcaccccgtgggctgcgaggacgaccagagcctgagcaagtacgagttcgtggtgaccagcggcagccccgtggccgccgacagagtgggccccaccatcctgaacaagatcgaggccgccctgaccaaccagaacctgagcgtggacgtggtggaccagtgcctggtgtgcctgaaggaggagtggatgaacaaggtgaaggtgctgttcaagttcaccaaggtggacagcagacccaaggaggacacccagaagctgctgagcatcctgggcgccagcgaggaggacaacgtgaagctgctgaagttctggatgaccggcctgagcaagacctacaagagccacctgatgagcaccgtgagaagccccaccgccagcgagagcagaaactag

SEQ ID NO: 10777 - DNA, 594 bp, Artificial Sequence
  Description of Artificial Sequence: Synthetic coding sequence
atgaacgccatcgtggccctgtgccacttctgcgagctgcacggccccagaaccctgttctgcaccgaggtgctgcacgcccccctgccccagggcgacggcaacgaggacagccccggccagggcgagcaggccgaggaggaggagggcggcatccagatgaacagcagaatgagagcccacagccccgccgagggcgccagcgtggagagcagcagccccggccccaagaagagcgacatgtgcgagggctgcagaagcctggccgccggccaccccggctacatcagccacgacaaggagaccagcatcaagtacgtgagccaccagcaccccagccacccccagctgttcagcatcgtgagacaggcctgcgtgagaagcctgagctgcgaggtgagcctggtggccaccgagcccgtgagcgtgggcgcccacatgctgcccggcgccctgggcggcctgggcgccagcatcgcccagggcggcagacactggagcagcctgagagccgacccccagatcagcaccgcccagggcaccggcagactgccctgccccgagctgagagaggagagctgctggacctgctag

SEQ ID NO: 10778 - DNA, 1029 bp, Artificial Sequence
  Description of Artificial Sequence: Synthetic coding sequence
atgaacgccatcgtggccctgtgccacttctgcgagctgcacggccccagaaccctgttctgcaccgaggtgctgcacgcccccctgccccagggcgacggcaacgaggacagccccggccagggcgagcaggccgaggaggaggagggcggcatccagatgaacagcagaatgagagcccacagccccgccgagggcgccagcgtggagagcagcagccccggccccaagaagagcgacatgtgcgagggctgcagaagcctggccgccggccaccccggctacatcagccacgacaaggagaccagcatcaagtacgtgagccaccagcaccccagccacccccagctgttcagcatcgtgagacaggcctgcgtgagaagcctgagctgcgaggtgtgccccggcagagagggccccatcttcttcggcgacgagcagcacggcttcgtgttcagccacaccttcttcatcaaggacagcctggccagaggcttccagagatggtacagcatcatcaccatcatgatggacagaatctacctgatcaacagctggcccttcctgctgggcaaggtgagaggcatcatcgacgagctgcagggcaaggccctgaaggtgttcgaggccgagcagttcggctgcccccagagagcccagagaatgaacaccgccttcacccccttcctgcaccagagaaacggcaacgccgccagaagcctgaccagcctgaccagcgacgacaacctgtgggcctgcctgcacaccagcttcgcctggctgctgaaggcctgcggcagcagactgaccgagaagctgctggagggcgcccccaccgaggacaccctggtgcagatggagaagctggccggcgaggccggcgtgctgctgcccggcccctggcccggctggccctggggcggcaccagctgcctgctgagctggcaggagagcctgagagagggcaacgccgccctgaaccagcccagaaccagcctgagagaggcccacccccccatcagcgtgtag

SEQ ID NO: 10779 - DNA, 594 bp, Artificial Sequence; identical to SEQ ID NO: 10777
  Description of Artificial Sequence: Synthetic coding sequence

SEQ ID NO: 10780 - DNA, 462 bp, Artificial Sequence
  Description of Artificial Sequence: Synthetic coding sequence
atgaacagcagaatgagagcccacagccccgccgagggcgccagcgtggagagcagcagccccggccccaagaagagcgacatgtgcgagggctgcagaagcctggccgccggccaccccggctacatcagccacgacaaggagaccagcatcaagtacgtgagccaccagcaccccagccacccccagctgttcagcatcgtgagacaggcctgcgtgagaagcctgagctgcgaggtgtgccccggcagagagggccccatcttcttcggcgacgagcagcacggcttcgtgttcagccacaccttcttcatcaaggacagcctggccagaggcttccagagatggtacagcatcatcaccatcatgatggacagaatctacctgatcaacagctggcccttcctgctgggcaaggtgagaggcatcatcgacgagctgcagggcaaggccctgaagtag

SEQ ID NO: 10781 - DNA, 1419 bp, Artificial Sequence
  Description of Artificial Sequence: Synthetic coding sequence
atgctgggcaccgtgaagatggagggccacgagaccagcgactggaacagctactacgccgacacccaggaggcctacagcagcgtgcccgtgagcaacatgaacagcggcctgggcagcatgaacagcatgaacacctacatgaccatgaacaccatgaccaccagcggcaacatgacccccgccagcttcaacatgagctacgccaaccccggcctgggcgccggcctgagccccggcgccgtggccggcatgcccggcggcagcgccggcgccatgaacagcatgaccgccgccggcgtgaccgccatgggcaccgccctgagccccagcggcatgggcgccatgggcgcccagcaggccgccagcatgaacggcctgggcccctacgccgccgccatgaacccctgcatgagccccatggcctacgcccccagcaacctgggcagaagcagagccggcggcggcggcgacgccaagaccttcaagagaagctacccccacgccaagcccccctacagctacatcagcctgatcaccatggccatccagcaggcccccagcaagatgctgaccctgagcgagatctaccagtggatcatggacctgttcccctactacagacagaaccagcagagatggcagaacagcatcagacacagcctgagcttcaacgactgcttcgtgaaggtggccagaagccccgacaagcccggcaagggcagctactggaccctgcaccccgacagcggcaacatgttcgagaacggctgctacctgagaagacagaagagattcaagtgcgagaagcagcccggcgccggcggcggcggcggcagcggcagcggcggcagcggcgccaagggcggccccgagagcagaaaggaccccagcggcgccagcaaccccagcgccgacagccccctgcacagaggcgtgcacggcaagaccggccagctggagggcgcccccgcccccggccccgccgccagcccccagaccctggaccacagcggcgccaccgccaccggcggcgccagcgagctgaagacccccgccagcagcaccgccccccccatcagcagcggccccggcgccctggccagcgtgcccgccagccaccccgcccacggcctggccccccacgagagccagctgcacctgaagggcgacccccactacagcttcaaccaccccttcagcatcaacaacctgatgagcagcagcgagcagcagcacaagctggacttcaaggcctacgagcaggccctgcagtacagcccctacggcagcaccctgcccgccagcctgcccctgggcagcgccagcgtgaccaccagaagccccatcgagcccagcgccctggagcccgcctactaccagggcgtgtacagcagacccgtgctgaacaccagctag

SEQ ID NO: 10782 - DNA, 1320 bp, Artificial Sequence
  Description of Artificial Sequence: Synthetic coding sequence
atgaacagcggcctgggcagcatgaacagcatgaacacctacatgaccatgaacaccatgaccaccagcggcaacatgacccccgccagcttcaacatgagctacgccaaccccggcctgggcgccggcctgagccccggcgccgtggccggcatgcccggcggcagcgccggcgccatgaacagcatgaccgccgccggcgtgaccgccatgggcaccgccctgagccccagcggcatgggcgccatgggcgcccagcaggccgccagcatgaacggcctgggcccctacgccgccgccatgaacccctgcatgagccccatggcctacgcccccagcaacctgggcagaagcagagccggcggcggcggcgacgccaagaccttcaagagaagctacccccacgccaagcccccctacagctacatcagcctgatcaccatggccatccagcaggcccccagcaagatgctgaccctgagcgagatctaccagtggatcatggacctgttcccctactacagacagaaccagcagagatggcagaacagcatcagacacagcctgagcttcaacgactgcttcgtgaaggtggccagaagccccgacaagcccggcaagggcagctactggaccctgcaccccgacagcggcaacatgttcgagaacggctgctacctgagaagacagaagagattcaagtgcgagaagcagcccggcgccggcggcggcggcggcagcggcagcggcggcagcggcgccaagggcggccccgagagcagaaaggaccccagcggcgccagcaaccccagcgccgacagccccctgcacagaggcgtgcacggcaagaccggccagctggagggcgcccccgcccccggccccgccgccagcccccagaccctggaccacagcggcgccaccgccaccggcggcgccagcgagctgaagacccccgccagcagcaccgccccccccatcagcagcggccccggcgccctggccagcgtgcccgccagccaccccgcccacggcctggccccccacgagagccagctgcacctgaagggcgacccccactacagcttcaaccaccccttcagcatcaacaacctgatgagcagcagcgagcagcagcacaagctggacttcaaggcctacgagcaggccctgcagtacagcccctacggcagcaccctgcccgccagcctgcccctgggcagcgccagcgtgaccaccagaagccccatcgagcccagcgccctggagcccgcctactaccagggcgtgtacagcagacccgtgctgaacaccagctag

SEQ ID NO: 10783 - DNA, 1506 bp, Artificial Sequence
  Description of Artificial Sequence: Synthetic coding sequence
atgcaggccagatacagcgtgagcgaccccaacgccctgggcgtggtgccctacctgagcgagcagaactactacagagccgccggcagctacggcggcatggccagccccatgggcgtgtacagcggccaccccgagcagtacagcgccggcatgggcagaagctacgccccctaccaccaccaccagcccgccgcccccaaggacctggtgaagcccccctacagctacatcgccctgatcaccatggccatccagaacgcccccgagaagaagatcaccctgaacggcatctaccagttcatcatggacagattccccttctacagagagaacaagcagggctggcagaacagcatcagacacaacctgagcctgaacgagtgcttcgtgaaggtgcccagagacgacaagaagcccggcaagggcagctactggaccctggaccccgacagctacaacatgttcgagaacggcagcttcctgagaagaagaagaagattcaagaagaaggacgtgagcaaggagaaggaggagagagcccacctgaaggagcccccccccgccgccagcaagggcgcccccgccaccccccacctggccgacgcccccaaggaggccgagaagaaggtggtgatcaagagcgaggccgccagccccgccctgcccgtgatcaccaaggtggagaccctgagccccgagagcgccctgcagggcagccccagaagcgccgccagcacccccgccggcagccccgacggcagcctgcccgagcaccacgccgccgcccccaacggcctgcccggcttcagcgtggagaacatcatgaccctgagaaccagcccccccggcggcgagctgagccccggcgccggcagagccggcctggtggtgccccccctggccctgccctacgccgccgccccccccgccgcctacggccagccctgcgcccagggcctggaggccggcgccgccggcggctaccagtgcagcatgagagccatgagcctgtacaccggcgccgagagacccgcccacatgtgcgtgccccccgccctggacgaggccctgagcgaccaccccagcggccccaccagccccctgagcgccctgaacctggccgccggccaggagggcgccctggccgccaccggccaccaccaccagcaccacggccaccaccacccccaggcccccccccccccccccgccccccagccccagcccaccccccagcccggcgccgccgccgcccaggccgccagctggtacctgaaccacagcggcgacctgaaccacctgcccggccacaccttcgccgcccagcagcagaccttccccaacgtgagagagatgttcaacagccacagactgggcatcgagaacagcaccctgggcgagagccaggtgagcggcaacgccagctgccagctgccctacagaagcaccccccccctgtacagacacgccgccccctacagctacgactgcaccaagtactag

SEQ ID NO: 10784 - DNA, 1968 bp, Artificial Sequence
  Description of Artificial Sequence: Synthetic coding sequence
atggccgaggccccccaggtggtggagatcgaccccgacttcgagcccctgcccagacccagaagctgcacctggcccctgcccagacccgagttcagccagagcaacagcgccaccagcagccccgcccccagcggcagcgccgccgccaaccccgacgccgccgccggcctgcccagcgccagcgccgccgccgtgagcgccgacttcatgagcaacctgagcctgctggaggagagcgaggacttcccccaggcccccggcagcgtggccgccgccgtggccgccgccgccgccgccgccgccaccggcggcctgtgcggcgacttccagggccccgaggccggctgcctgcaccccgcccccccccagccccccccccccggccccctgagccagcacccccccgtgccccccgccgccgccggccccctggccggccagcccagaaagagcagcagcagcagaagaaacgcctggggcaacctgagctacgccgacctgatcaccaaggccatcgagagcagcgccgagaagagactgaccctgagccagatctacgagtggatggtgaagagcgtgccctacttcaaggacaagggcgacagcaacagcagcgccggctggaagaacagcatcagacacaacctgagcctgcacagcaagttcatcagagtgcagaacgagggcaccggcaagagcagctggtggatgctgaaccccgagggcggcaagagcggcaagagccccagaagaagagccgccagcatggacaacaacagcaagttcgccaagagcagaagcagagccgccaagaagaaggccagcctgcagagcggccaggagggcgccggcgacagccccggcagccagttcagcaagtggcccgccagccccggcagccacagcaacgacgacttcgacaactggagcaccttcagacccagaaccagcagcaacgccagcaccatcagcggcagactgagccccatcatgaccgagcaggacgacctgggcgagggcgacgtgcacagcatggtgtacccccccagcgccgccaagatggccagcaccctgcccagcctgagcgagatcagcaaccccgagaacatggagaacctgctggacaacctgaacctgctgagcagccccaccagcctgaccgtgagcacccagagcagccccggcaccatgatgcagcagaccccctgctacagcttcgccccccccaacaccagcctgaacagccccagccccaactaccagaagtacacctacggccagagcagcatgagccccctgccccagatgcccatccagaccctgcaggacaacaagagcagctacggcggcatgagccagtacaactgcgcccccggcctgctgaaggagctgctgaccagcgacagccccccccacaacgacatcatgacccccgtggaccccggcgtggcccagcccaacagcagagtgctgggccagaacgtgatgatgggccccaacagcgtgatgagcacctacggcagccaggccagccacaacaagatgatgaaccccagcagccacacccaccccggccacgcccagcagaccagcgccgtgaacggcagacccctgccccacaccgtgagcaccatgccccacaccagcggcatgaacagactgacccaggtgaagacccccgtgcaggtgcccctgccccaccccatgcagatgagcgccctgggcggctacagcagcgtgagcagctgcaacggctacggcagaatgggcctgctgcaccaggagaagctgcccagcgacctggacggcatgttcatcgagagactggactgcgacatggagagcatcatcagaaacgacctgatggacggcgacaccctggacttcaacttcgacaacgtgctgcccaaccagagcttcccccacagcgtgaagaccaccacccacagctgggtgagcggctag

SEQ ID NO: 10785 - DNA, 2022 bp, Artificial Sequence
  Description of Artificial Sequence: Synthetic coding sequence
atggccgaggcccccgccagccccgcccccctgagccccctggaggtggagctggaccccgagttcgagccccagagcagacccagaagctgcacctggcccctgcagagacccgagctgcaggccagccccgccaagcccagcggcgagaccgccgccgacagcatgatccccgaggaggaggacgacgaggacgacgaggacggcggcggcagagccggcagcgccatggccatcggcggcggcggcggcagcggcaccctgggcagcggcctgctgctggaggacagcgccagagtgctggcccccggcggccaggaccccggcagcggccccgccaccgccgccggcggcctgagcggcggcacccaggccctgctgcagccccagcagcccctgccccccccccagcccggcgccgccggcggcagcggccagcccagaaagtgcagcagcagaagaaacgcctggggcaacctgagctacgccgacctgatcaccagagccatcgagagcagccccgacaagagactgaccctgagccagatctacgagtggatggtgagatgcgtgccctacttcaaggacaagggcgacagcaacagcagcgccggctggaagaacagcatcagacacaacctgagcctgcacagcagattcatgagagtgcagaacgagggcaccggcaagagcagctggtggatcatcaaccccgacggcggcaagagcggcaaggcccccagaagaagagccgtgagcatggacaacagcaacaagtacaccaagagcagaggcagagccgccaagaagaaggccgccctgcagaccgcccccgagagcgccgacgacagccccagccagctgagcaagtggcccggcagccccaccagcagaagcagcgacgagctggacgcctggaccgacttcagaagcagaaccaacagcaacgccagcaccgtgagcggcagactgagccccatcatggccagcaccgagctggacgaggtgcaggacgacgacgcccccctgagccccatgctgtacagcagcagcgccagcctgagccccagcgtgagcaagccctgcaccgtggagctgcccagactgaccgacatggccggcaccatgaacctgaacgacggcctgaccgagaacctgatggacgacctgctggacaacatcaccctgccccccagccagcccagccccaccggcggcctgatgcagagaagcagcagcttcccctacaccaccaagggcagcggcctgggcagccccaccagcagcttcaacagcaccgtgttcggccccagcagcctgaacagcctgagacagagccccatgcagaccatccaggagaacaagcccgccaccttcagcagcatgagccactacggcaaccagaccctgcaggacctgctgaccagcgacagcctgagccacagcgacgtgatgatgacccagagcgaccccctgatgagccaggccagcaccgccgtgagcgcccagaacagcagaagaaacgtgatgctgagaaacgaccccatgatgagcttcgccgcccagcccaaccagggcagcctggtgaaccagaacctgctgcaccaccagcaccagacccagggcgccctgggcggcagcagagccctgagcaacagcgtgagcaacatgggcctgagcgagagcagcagcctgggcagcgccaagcaccagcagcagagccccgtgagccagagcatgcagaccctgagcgacagcctgagcggcagcagcctgtacagcaccagcgccaacctgcccgtgatgggccacgagaagttccccagcgacctggacctggacatgttcaacggcagcctggagtgcgacatggagagcatcatcagaagcgagctgatggacgccgacggcctggacttcaacttcgacagcctgatcagcacccagaacgtggtgggcctgaacgtgggcaacttcaccggcgccaagcaggccagcagccagagctgggtgcccggctag

SEQ ID NO: 10786 - DNA, 2022 bp, Artificial Sequence; identical to SEQ ID NO: 10785
  Description of Artificial Sequence: Synthetic coding sequence

SEQ ID NO: 10787 - DNA, 1302 bp, Artificial Sequence
  Description of Artificial Sequence: Synthetic coding sequence
atgagagtgcagaacgagggcaccggcaagagcagctggtggatcatcaaccccgacggcggcaagagcggcaaggcccccagaagaagagccgtgagcatggacaacagcaacaagtacaccaagagcagaggcagagccgccaagaagaaggccgccctgcagaccgcccccgagagcgccgacgacagccccagccagctgagcaagtggcccggcagccccaccagcagaagcagcgacgagctggacgcctggaccgacttcagaagcagaaccaacagcaacgccagcaccgtgagcggcagactgagccccatcatggccagcaccgagctggacgaggtgcaggacgacgacgcccccctgagccccatgctgtacagcagcagcgccagcctgagccccagcgtgagcaagccctgcaccgtggagctgcccagactgaccgacatggccggcaccatgaacctgaacgacggcctgaccgagaacctgatggacgacctgctggacaacatcaccctgccccccagccagcccagccccaccggcggcctgatgcagagaagcagcagcttcccctacaccaccaagggcagcggcctgggcagccccaccagcagcttcaacagcaccgtgttcggccccagcagcctgaacagcctgagacagagccccatgcagaccatccaggagaacaagcccgccaccttcagcagcatgagccactacggcaaccagaccctgcaggacctgctgaccagcgacagcctgagccacagcgacgtgatgatgacccagagcgaccccctgatgagccaggccagcaccgccgtgagcgcccagaacagcagaagaaacgtgatgctgagaaacgaccccatgatgagcttcgccgcccagcccaaccagggcagcctggtgaaccagaacctgctgcaccaccagcaccagacccagggcgccctgggcggcagcagagccctgagcaacagcgtgagcaacatgggcctgagcgagagcagcagcctgggcagcgccaagcaccagcagcagagccccgtgagccagagcatgcagaccctgagcgacagcctgagcggcagcagcctgtacagcaccagcgccaacctgcccgtgatgggccacgagaagttccccagcgacctggacctggacatgagcatgggcgcctggaacgtgacctggagccccctgagcgtggtgaacagctggatgctgatgggctggatcctgaccctgatccccagcagcccccacagaatgctgctggtgtag

SEQ ID NO: 10788 - DNA, 1362 bp, Artificial Sequence
  Description of Artificial Sequence: Synthetic coding sequence
atgagagtgcagaacgagggcaccggcaagagcagctggtggatcatcaaccccgacggcggcaagagcggcaaggcccccagaagaagagccgtgagcatggacaacagcaacaagtacaccaagagcagaggcagagccgccaagaagaaggccgccctgcagaccgcccccgagagcgccgacgacagccccagccagctgagcaagtggcccggcagccccaccagcagaagcagcgacgagctggacgcctggaccgacttcagaagcagaaccaacagcaacgccagcaccgtgagcggcagactgagccccatcatggccagcaccgagctggacgaggtgcaggacgacgacgcccccctgagccccatgctgtacagcagcagcgccagcctgagccccagcgtgagcaagccctgcaccgtggagctgcccagactgaccgacatggccggcaccatgaacctgaacgacggcctgaccgagaacctgatggacgacctgctggacaacatcaccctgccccccagccagcccagccccaccggcggcctgatgcagagaagcagcagcttcccctacaccaccaagggcagcggcctgggcagccccaccagcagcttcaacagcaccgtgttcggccccagcagcctgaacagcctgagacagagccccatgcagaccatccaggagaacaagcccgccaccttcagcagcatgagccactacggcaaccagaccctgcaggacctgctgaccagcgacagcctgagccacagcgacgtgatgatgacccagagcgaccccctgatgagccaggccagcaccgccgtgagcgcccagaacagcagaagaaacgtgatgctgagaaacgaccccatgatgagcttcgccgcccagcccaaccagggcagcctggtgaaccagaacctgctgcaccaccagcaccagacccagggcgccctgggcggcagcagagccctgagcaacagcgtgagcaacatgggcctgagcgagagcagcagcctgggcagcgccaagcaccagcagcagagccccgtgagccagagcatgcagaccctgagcgacagcctgagcggcagcagcctgtacagcaccagcgccaacctgcccgtgatgggccacgagaagttccccagcgacctggacctggacatgttcaacggcagcctggagtgcgacatggagagcatcatcagaagcgagctgatggacgccgacggcctggacttcaacttcgacagcctgatcagcacccagaacgtggtgggcctgaacgtgggcaacttcaccggcgccaagcaggccagcagccagagctgggtgcccggctag

SEQ ID NO: 10789 - DNA, 444 bp, Artificial Sequence
  Description of Artificial Sequence: Synthetic coding sequence
atgagcttcagattcggccagcacctgatcaagcccagcgtggtgttcctgaagaccgagctgagcttcgccctggtgaacagaaagcccgtggtgcccggccacgtgctggtgtgccccctgagacccgtggagagattccacgacctgagacccgacgaggtggccgacctgttccagaccacccagagagtgggcaccgtggtggagaagcacttccacggcaccagcctgaccttcagcatgcaggacggccccgaggccggccagaccgtgaagcacgtgcacgtgcacgtgctgcccagaaaggccggcgacttccacagaaacgacagcatctacgaggagctgcagaagcacgacaaggaggacttccccgccagctggagaagcgaggaggagatggccgccgaggccgccgccctgagagtgtacttccagtag

SEQ ID NO: 10790 - DNA, 444 bp, Artificial Sequence; identical to SEQ ID NO: 10789
  Description of Artificial Sequence: Synthetic coding sequence

SEQ ID NO: 10791 - DNA, 444 bp, Artificial Sequence; identical to SEQ ID NO: 10789
  Description of Artificial Sequence: Synthetic coding sequence

SEQ ID NO: 10792 - DNA, 240 bp, Artificial Sequence
  Description of Artificial Sequence: Synthetic coding sequence
atgagcttcagattcggccagcacctgatcaagcccagcgtggtgttcctgaagaccgagctgagcttcgccctggtgaacagaaagcccgtggtgcccggccacgtgctggtgtgccccctgagacccgtggagagattccacgacctgagacccgacgaggtggccgacctgttccagaccacccagagagtgggcaccgtggtggagaagcacttccacggcaccagcctgacctag

SEQ ID NO: 10793 - DNA, 444 bp, Artificial Sequence; identical to SEQ ID NO: 10789
  Description of Artificial Sequence: Synthetic coding sequence

SEQ ID NO: 10794 - DNA, 1725 bp, Artificial Sequence
  Description of Artificial Sequence: Synthetic coding sequence
atgagagaccccggcgccgccgcccccctgagcagcctgggcctgtgcgccctggtgctggccctgctgggcgccctgagcgccggcgccggcgcccagccctaccacggcgagaagggcatcagcgtgcccgaccacggcttctgccagcccatcagcatccccctgtgcaccgacatcgcctacaaccagaccatcctgcccaacctgctgggccacaccaaccaggaggacgccggcctggaggtgcaccagttctaccccctggtgaaggtgcagtgcagccccgagctgagattcttcctgtgcagcatgtacgcccccgtgtgcaccgtgctggaccaggccatccccccctgcagaagcctgtgcgagagagccagacagggctgcgaggccctgatgaacaagttcggcttccagtggcccgagagactgagatgcgagaacttccccgtgcacggcgccggcgagatctgcgtgggccagaacaccagcgacggcagcggcggccccggcggcggccccaccgcctaccccaccgccccctacctgcccgacctgcccttcaccgccctgccccccggcgccagcgacggcagaggcagacccgccttccccttcagctgccccagacagctgaaggtgcccccctacctgggctacagattcctgggcgagagagactgcggcgccccctgcgagcccggcagagccaacggcctgatgtacttcaaggaggaggagagaagattcgccagactgtgggtgggcgtgtggagcgtgctgtgctgcgccagcaccctgttcaccgtgctgacctacctggtggacatgagaagattcagctaccccgagagacccatcatcttcctgagcggctgctacttcatggtggccgtggcccacgtggccggcttcctgctggaggacagagccgtgtgcgtggagagattcagcgacgacggctacagaaccgtggcccagggcaccaagaaggagggctgcaccatcctgttcatggtgctgtacttcttcggcatggccagcagcatctggtgggtgatcctgagcctgacctggttcctggccgccggcatgaagtggggccacgaggccatcgaggccaacagccagtacttccacctggccgcctgggccgtgcccgccgtgaagaccatcaccatcctggccatgggccaggtggacggcgacctgctgagcggcgtgtgctacgtgggcctgagcagcgtggacgccctgagaggcttcgtgctggcccccctgttcgtgtacctgttcatcggcaccagcttcctgctggccggcttcgtgagcctgttcagaatcagaaccatcatgaagcacgacggcaccaagaccgagaagctggagaagctgatggtgagaatcggcgtgttcagcgtgctgtacaccgtgcccgccaccatcgtgctggcctgctacttctacgagcaggccttcagagagcactgggagagaacctggctgctgcagacctgcaagagctacgccgtgccctgcccccccggccacttcccccccatgagccccgacttcaccgtgttcatgatcaagtacctgatgaccatgatcgtgggcatcaccaccggcttctggatctggagcggcaagaccctgcagagctggagaagattctaccacagactgagccacagcagcaagggcgagaccgccgtgtag

SEQ ID NO: 10795 - DNA, 654 bp, Artificial Sequence
  Description of Artificial Sequence: Synthetic coding sequence
atgagcttcagaggcggcggcagaggcggcttcaacagaggcggcggcggcggcggcttcaacagaggcggcagcagcaaccacttcagaggcggcggcggcggcggcggcggcggcaacttcagaggcggcggcagaggcggcttcggcagaggcggcggcagaggcggcttcaacaagggccaggaccagggcccccccgagagagtggtgctgctgggcgagttcctgcacccctgcgaggacgacatcgtgtgcaagtgcaccaccgacgagaacaaggtgccctacttcaacgcccccgtgtacctggagaacaaggagcagatcggcaaggtggacgagatcttcggccagctgagagacttctacttcagcgtgaagctgagcgagaacatgaaggccagcagcttcaagaagctgcagaagttctacatcgacccctacaagctgctgcccctgcagagattcctgcccagaccccccggcgagaagggcccccccagaggcggcggcagaggcggcagaggcggcggcagaggcggcggcggcagaggcggcggcagaggcggcggcttcagaggcggcagaggcggcggcggcggcggcttcagaggcggcagaggcggcggcttcagaggcagaggccactag

SEQ ID NO: 10796 - DNA, 1533 bp, Artificial Sequence
  Description of Artificial Sequence: Synthetic coding sequence
atgtacagagccctgagactgctggccagaagcagacccctggtgagagcccccgccgccgccctggccagcgcccccggcctgggcggcgccgccgtgcccagcttctggccccccaacgccgccagaatggccagccagaacagcttcagaatcgagtacgacaccttcggcgagctgaaggtgcccaacgacaagtactacggcgcccagaccgtgagaagcaccatgaacttcaagatcggcggcgtgaccgagagaatgcccacccccgtgatcaaggccttcggcatcctgaagagagccgccgccgaggtgaaccaggactacggcctggaccccaagatcgccaacgccatcatgaaggccgccgacgaggtggccgagggcaagctgaacgaccacttccccctggtggtgtggcagaccggcagcggcacccagaccaacatgaacgtgaacgaggtgatcagcaacagagccatcgagatgctgggcggcgagctgggcagcaagatccccgtgcaccccaacgaccacgtgaacaagagccagagcagcaacgacaccttccccaccgccatgcacatcgccgccgccatcgaggtgcacgaggtgctgctgcccggcctgcagaagctgcacgacgccctggacgccaagagcaaggagttcgcccagatcatcaagatcggcagaacccacacccaggacgccgtgcccctgaccctgggccaggagttcagcggctacgtgcagcaggtgaagtacgccatgaccagaatcaaggccgccatgcccagaatctacgagctggccgccggcggcaccgccgtgggcaccggcctgaacaccagaatcggcttcgccgagaaggtggccgccaaggtggccgccctgaccggcctgcccttcgtgaccgcccccaacaagttcgaggccctggccgcccacgacgccctggtggagctgagcggcgccatgaacaccaccgcctgcagcctgatgaagatcgccaacgacatcagattcctgggcagcggccccagaagcggcctgggcgagctgatcctgcccgagaacgagcccggcagcagcatcatgcccggcaaggtgaaccccacccagtgcgaggccatgaccatggtggccgcccaggtgatgggcaaccacgtggccgtgaccgtgggcggcagcaacggccacttcgagctgaacgtgttcaagcccatgatgatcaagaacgtgctgcacagcgccagactgctgggcgacgccagcgtgagcttcaccgagaactgcgtggtgggcatccaggccaacaccgagagaatcaacaagctgatgaacgagagcctgatgctggtgaccgccctgaacccccacatcggctacgacaaggccgccaagatcgccaagaccgcccacaagaacggcagcaccctgaaggagaccgccatcgagctgggctacctgaccgccgagcagttcgacgagtgggtgaagcccaaggacatgctgggccccaagtag

SEQ ID NO: 10797 - DNA, 537 bp, Artificial Sequence
  Description of Artificial Sequence: Synthetic coding sequence
atgagccccagcggcagactgtgcctgctgaccatcgtgggcctgatcctgcccaccagaggccagaccctgaaggacaccaccagcagcagcagcgccgacagcaccatcatggacatccaggtgcccaccagagcccccgacgccgtgtacaccgagctgcagcccaccagccccacccccacctggcccgccgacgagaccccccagccccagacccagacccagcagctggagggcaccgacggccccctggtgaccgaccccgagacccacaagagcaccaaggccgcccaccccaccgacgacaccaccaccctgagcgagagacccagccccagcaccgacgtgcagaccgacccccagaccctgaagcccagcggcttccacgaggacgaccccttcttctacgacgagcacaccctgagaaagagaggcctgctggtggccgccgtgctgttcatcaccggcatcatcatcctgaccagcggcaagtgcagacagctgagcagactgtgcagaaacagatgcagatag

SEQ ID NO: 10798 - DNA, 324 bp, Artificial Sequence
  Description of Artificial Sequence: Synthetic coding sequence
atgcagaccctgagcaacatcccctgcttctgcctgcacggcagcctgctgcccagcaccgacctggccaccctgagcgcccaccccaccgacgacaccaccaccctgagcgagagacccagccccagcaccgacgtgcagaccgacccccagaccctgaagcccagcggcttccacgaggacgaccccttcttctacgacgagcacaccctgagaaagagaggcctgctggtggccgccgtgctgttcatcaccggcatcatcatcctgaccagcggcaagtgcagacagctgagcagactgtgcagaaacagatgcagatag

SEQ ID NO: 10799 - DNA, 291 bp, Artificial Sequence
  Description of Artificial Sequence: Synthetic coding sequence
atgagccccagcggcagactgtgcctgctgaccatcgtgggcctgatcctgcccaccagaggccagaccctgaaggacaccaccagcagcagcagcgccgacagcaccatcatggacatccaggtgcccaccagagcccccgacgccgtgtacaccgagctgcagcccaccagccccacccccacctggcccgccgacggcgcctacatcaccgcctacggcgtgacccacttcctgatgaacatgctggccgtgagcagcttcttctgcctgcacaccgccccccagtag

SEQ ID NO: 10800 - DNA, 537 bp, Artificial Sequence; identical to SEQ ID NO: 10797
  Description of Artificial Sequence: Synthetic coding sequence

SEQ ID NO: 10801 - DNA, 537 bp, Artificial Sequence; identical to SEQ ID NO: 10797
  Description of Artificial Sequence: Synthetic coding sequence

SEQ ID NO: 10802 - DNA, 537 bp, Artificial Sequence; identical to SEQ ID NO: 10797
  Description of Artificial Sequence: Synthetic coding sequence

SEQ ID NO: 10803 - DNA, 585 bp, Artificial Sequence
  Description of Artificial Sequence: Synthetic coding sequence
atgagccccagcggcagactgtgcctgctgaccatcgtgggcctgatcctgcccaccagaggccagaccctgaaggacaccaccagcagcagcagcgccgacagcaccatcatggacatccaggtgcccaccagagcccccgacgccgtgtacaccgagctgcagcccaccagccccacccccacctggcccgccgacgagaccccccagccccagacccagacccagcagctggagggcaccgacggccccctggtgaccgaccccgagacccacaagagcaccaaggccgcccaccccaccgacgacaccaccaccctgagcgagagacccagccccagcaccgacgtgcagaccgacccccagaccctgaagcccagcggcttccacgaggacgaccccttcttctacgacgagcacaccctgagaaagagaggcctgctggtggccgccgtgctgttcatcaccggcatcatcatcctgaccagcgagaactggggctgggtgggcagaacccccagacccggcggcggcctgatgaccgagggctgggtgctgaagggcccctgggccatcctgttctag

SEQ ID NO: 10804 - DNA, 1518 bp, Artificial Sequence
  Description of Artificial Sequence: Synthetic coding sequence
atgagcaacatctgccagagactgtgggagtacctggagccctacctgccctgcctgagcaccgaggccgacaagagcaccgtgatcgagaaccccggcgccctgtgcagcccccagagccagagacacggccactacttcgtggccctgttcgactaccaggccagaaccgccgaggacctgagcttcagagccggcgacaagctgcaggtgctggacaccctgcacgagggctggtggttcgccagacacctggagaagagaagagacggcagcagccagcagctgcagggctacatccccagcaactacgtggccgaggacagaagcctgcaggccgagccctggttcttcggcgccatcggcagaagcgacgccgagaagcagctgctgtacagcgagaacaagaccggcagcttcctgatcagagagagcgagagccagaagggcgagttcagcctgagcgtgctggacggcgccgtggtgaagcactacagaatcaagagactggacgagggcggcttcttcctgaccagaagaagaatcttcagcaccctgaacgagttcgtgagccactacaccaagaccagcgacggcctgtgcgtgaagctgggcaagccctgcctgaagatccaggtgcccgcccccttcgacctgagctacaagaccgtggaccagtgggagatcgacagaaacagcatccagctgctgaagagactgggcagcggccagttcggcgaggtgtgggagggcctgtggaacaacaccacccccgtggccgtgaagaccctgaagcccggcagcatggaccccaacgacttcctgagagaggcccagatcatgaagaacctgagacaccccaagctgatccagctgtacgccgtgtgcaccctggaggaccccatctacatcatcaccgagctgatgagacacggcagcctgcaggagtacctgcagaacgacaccggcagcaagatccacctgacccagcaggtggacatggccgcccaggtggccagcggcatggcctacctggagagcagaaactacatccacagagacctggccgccagaaacgtgctggtgggcgagcacaacatctacaaggtggccgacttcggcctggccagagtgttcaaggtggacaacgaggacatctacgagagcagacacgagatcaagctgcccgtgaagtggaccgcccccgaggccatcagaagcaacaagttcagcatcaagagcgacgtgtggagcttcggcatcctgctgtacgagatcatcacctacggcaagatgccctacagcggcatgaccggcgcccaggtgatccagatgctggcccagaactacagactgccccagcccagcaactgcccccagcagttctacaacatcatgctggagtgctggaacgccgagcccaaggagagacccaccttcgagaccctgagatggaagctggaggactacttcgagaccgacagcagctacagcgacgccaacaacttcatcagatag

SEQ ID NO: 10805 - DNA, 1092 bp, Artificial Sequence
  Description of Artificial Sequence: Synthetic coding sequence
atggacagcaccagcctgctgcccaacccctggatcagagtgctggacggcgccgtggtgaagcactacagaatcaagagactggacgagggcggcttcttcctgaccagaagaagaatcttcagcaccctgaacgagttcgtgagccactacaccaagaccagcgacggcctgtgcgtgaagctgggcaagccctgcctgaagatccaggtgcccgcccccttcgacctgagctacaagaccgtggaccagtgggagatcgacagaaacagcatccagctgctgaagagactgggcagcggccagttcggcgaggtgtgggagggcctgtggaacaacaccacccccgtggccgtgaagaccctgaagcccggcagcatggaccccaacgacttcctgagagaggcccagatcatgaagaacctgagacaccccaagctgatccagctgtacgccgtgtgcaccctggaggaccccatctacatcatcaccgagctgatgagacacggcagcctgcaggagtacctgcagaacgacaccggcagcaagatccacctgacccagcaggtggacatggccgcccaggtggccagcggcatggcctacctggagagcagaaactacatccacagagacctggccgccagaaacgtgctggtgggcgagcacaacatctacaaggtggccgacttcggcctggccagagtgttcaaggtggacaacgaggacatctacgagagcagacacgagatcaagctgcccgtgaagtggaccgcccccgaggccatcagaagcaacaagttcagcatcaagagcgacgtgtggagcttcggcatcctgctgtacgagatcatcacctacggcaagatgccctacagcggcatgaccggcgcccaggtgatccagatgctggcccagaactacagactgccccagcccagcaactgcccccagcagttctacaacatcatgctggagtgctggaacgccgagcccaaggagagacccaccttcgagaccctgagatggaagctggaggactacttcgagaccgacagcagctacagcgacgccaacaacttcatcagatag

SEQ ID NO: 10806 - DNA, 1128 bp, Artificial Sequence
  Description of Artificial Sequence: Synthetic coding sequence
atgagaagcgtggcccccagcggccccaagatgggcaacatcaccgccgacaacagcagcatgagctgcaccatcgaccacaccatccaccagaccctggcccccgtggtgtacgtgaccgtgctggtggtgggcttccccgccaactgcctgagcctgtacttcggctacctgcagatcaaggccagaaacgagctgggcgtgtacctgtgcaacctgaccgtggccgacctgttctacatctgcagcctgcccttctggctgcagtacgtgctgcagcacgacaactggagccacggcgacctgagctgccaggtgtgcggcatcctgctgtacgagaacatctacatcagcgtgggcttcctgtgctgcatcagcgtggacagatacctggccgtggcccaccccttcagattccaccagttcagaaccctgaaggccgccgtgggcgtgagcgtggtgatctgggccaaggagctgctgaccagcatctacttcctgatgcacgaggaggtgatcgaggacgagaaccagcacagagtgtgcttcgagcactaccccatccaggcctggcagagagccatcaactactacagattcctggtgggcttcctgttccccatctgcctgctgctggccagctaccagggcatcctgagagccgtgagaagaagccacggcacccagaagagcagaaaggaccagatccagagactggtgctgagcaccgtggtgatcttcctggcctgcttcctgccctaccacgtgctgctgctggtgagaagcgtgtgggaggccagctgcgacttcgccaagggcgtgttcaacgcctaccacttcagcctgctgctgaccagcttcaactgcgtggccgaccccgtgctgtactgcttcgtgagcgagaccacccacagagacctggccagactgagaggcgcctgcctggccttcctgacctgcagcagaaccggcagagccagagaggcctaccccctgggcgcccccgaggccagcggcaagagcggcgcccagggcgaggagcccgagctgctgaccaagctgcaccccgccttccagacccccaacagccccggcagcggcggcttccccaccggcagactggcctag

SEQ ID NO: 10807 - DNA, 1017 bp, Artificial Sequence
  Description of Artificial Sequence: Synthetic coding sequence
atgggcaacatcaccgccgacaacagcagcatgagctgcaccatcgaccacaccatccaccagaccctggcccccgtggtgtacgtgaccgtgctggtggtgggcttccccgccaactgcctgagcctgtacttcggctacctgcagatcaaggccagaaacgagctgggcgtgtacctgtgcaacctgaccgtggccgacctgttctacatctgcagcctgcccttctggctgcagtacgtgctgcagcacgacaactggagccacggcgacctgagctgccaggtgtgcggcatcctgctgtacgagaacatctacatcagcgtgggcttcctgtgctgcatcagcgtggacagatacctggccgtggcccaccccttcagattccaccagttcagaaccctgaaggccgccgtgggcgtgagcgtggtgatctgggccaaggagctgctgaccagcatctacttcctgatgcacgaggaggtgatcgaggacgagaaccagcacagagtgtgcttcgagcactaccccatccaggcctggcagagagccatcaactactacagattcctggtgggcttcctgttccccatctgcctgctgctggccagctaccagggcatcctgagagccgtgagaagaagccacggcacccagaagagcagaaaggaccagatccagagactggtgctgagcaccgtggtgatcttcctggcctgcttcctgccctaccacgtgctgctgctggtgagaagcgtgtgggaggccagctgcgacttcgccaagggcgtgttcaacgcctaccacttcagcctgctgctgaccagcttcaactgcgtggccgaccccgtgctgtactgcttcgtgagcgagaccacccacagagacctggccagactgagaggcgcctgcctggccttcctgacctgcagcagaaccggcagagccagagaggcctaccccctgggcgcccccgaggccagcggcaagagcggcgcccagggcgaggagccctag

SEQ ID NO: 10808 - DNA, 1098 bp, Artificial Sequence
  Description of Artificial Sequence: Synthetic coding sequence
atgggcaacatcaccgccgacaacagcagcatgagctgcaccatcgaccacaccatccaccagaccctggcccccgtggtgtacgtgaccgtgctggtggtgggcttccccgccaactgcctgagcctgtacttcggctacctgcagatcaaggccagaaacgagctgggcgtgtacctgtgcaacctgaccgtggccgacctgttctacatctgcagcctgcccttctggctgcagtacgtgctgcagcacgacaactggagccacggcgacctgagctgccaggtgtgcggcatcctgctgtacgagaacatctacatcagcgtgggcttcctgtgctgcatcagcgtggacagatacctggccgtggcccaccccttcagattccaccagttcagaaccctgaaggccgccgtgggcgtgagcgtggtgatctgggccaaggagctgctgaccagcatctacttcctgatgcacgaggaggtgatcgaggacgagaaccagcacagagtgtgcttcgagcactaccccatccaggcctggcagagagccatcaactactacagattcctggtgggcttcctgttccccatctgcctgctgctggccagctaccagggcatcctgagagccgtgagaagaagccacggcacccagaagagcagaaaggaccagatccagagactggtgctgagcaccgtggtgatcttcctggcctgcttcctgccctaccacgtgctgctgctggtgagaagcgtgtgggaggccagctgcgacttcgccaagggcgtgttcaacgcctaccacttcagcctgctgctgaccagcttcaactgcgtggccgaccccgtgctgtactgcttcgtgagcgagaccacccacagagacctggccagactgagaggcgcctgcctggccttcctgacctgcagcagaaccggcagagccagagaggcctaccccctgggcgcccccgaggccagcggcaagagcggcgcccagggcgaggagcccgagctgctgaccaagctgcaccccgccttccagacccccaacagccccggcagcggcggcttccccaccggcagactggcctag

SEQ ID NO: 10809 - DNA, 1098 bp, Artificial Sequence; identical to SEQ ID NO: 10808
  Description of Artificial Sequence: Synthetic coding sequence

SEQ ID NO: 10810 - DNA, 2100 bp, Artificial Sequence
  Description of Artificial Sequence: Synthetic coding sequence
atgaccctgagaagaaagtgcaacgaggacgacgaggtgttcttcggccccttcggccacaaggagagatgcatcgccgccagcctggagctgaacaaccccgtgcccgagcagccccccctgcccaccagcgagagccccttcgcctggagccccctggccggcgagaagttcgtggaggtgtacaaggaggcccacctgctggccctgcacatcgagagcagcagcagaaaccaggccgcccaggccgccaagcccgaggaccccagaagccagggcgtggagagattcatccaggagagcaagctgaagatcaacctgttcgagaaggagaaggagatgaagaagagccccaccagcctgaagagagagacctactacctgagcgacagccccctgctgggcccccccgtgggcgagcccagactgctggccagcagccccgccctgcccagcagcggcgcccaggccagactgaccagagcccccggccccccccacagcgcccacgccctgcccagagagagctgcaccgcccacgccgccagccaggccgccacccagagaaagcccggcaccaagctgctgctgcccagagccgccagcgtgagaggcagaagcatccccggcgccgccgagaagcccaagaaggagatccccgccagccccagcagaaccaagatccccgccgagaaggagagccacagagacgtgctgcccgacaagcccgcccccggcgccgtgaacgtgcccgccgccggcagccacctgggccagggcaagagagccatccccgtgcccaacaagctgggcctgaagaagaccctgctgaaggcccccggcagcaccagcaacctggccagaaagagcagcagcggccccgtgtggagcggcgccagcagcgcctgcaccagccccgccgtgggcaaggccaagagcagcgagttcgccagcatccccgccaacagcagcagacccctgagcaacatcagcaagagcggcagaatgggccccgccatgctgagacccgccctgcccgccggccccgtgggcgccagcagctggcaggccaagagagtggacgtgagcgagctggccgccgagcagctgaccgccccccccagcgccagccccacccagccccagacccccgagggcggcggccagtggctgaacagcagctgcgcctggagcgagagcagccagctgaacaagaccagaagcatcagaagaagagacagctgcctgaacagcaagaccaaggtgatgcccacccccaccaaccagttcaagatccccaagttcagcatcggcgacagccccgacagcagcacccccaagctgagcagagcccagagaccccagagctgcaccagcgtgggcagagtgaccgtgcacagcacccccgtgagaagaagcagcggccccgccccccagagcctgctgagcgcctggagagtgagcgccctgcccacccccgccagcagaagatgcagcggcctgccccccatgacccccaagaccatgcccagagccgtgggcagccccctgtgcgtgcccgccagaagaagaagcagcgagcccagaaagaacagcgccatgagaaccgagcccaccagagagagcaacagaaagaccgacagcagactggtggacgtgagccccgacagaggcagcccccccagcagagtgccccaggccctgaacttcagccccgaggagagcgacagcaccttcagcaagagcaccgccaccgaggtggccagagaggaggccaagcccggcggcgacgccgcccccagcgaggccctgctggtggacatcaagctggagcccctggccgtgacccccgacgccgccagccagcccctgatcgacctgcccctgatcgacttctgcgacacccccgaggcccacgtggccgtgggcagcgagagcagacccctgatcgacctgatgaccaacacccccgacatgaacaagaacgtggccaagcccagccccgtggtgggccagctgatcgacctgagcagccccctgatccagctgagccccgaggccgacaaggagaacgtggacagccccctgctgaagttctag

SEQ ID NO: 10811 - DNA, 2220 bp, Artificial Sequence
  Description of Artificial Sequence: Synthetic coding sequence
atggagggcggcggcggcagagacgagcccagcgcctgcagagccggcgacgtgaacatggacgaccccaagaaggaggacatcctgctgctggccgacgagaagttcgacttcgacctgagcctgagcagcagcagcgccaacgaggacgacgaggtgttcttcggccccttcggccacaaggagagatgcatcgccgccagcctggagctgaacaaccccgtgcccgagcagccccccctgcccaccagcgagagccccttcgcctggagccccctggccggcgagaagttcgtggaggtgtacaaggaggcccacctgctggccctgcacatcgagagcagcagcagaaaccaggccgcccaggccgccaagcccgaggaccccagaagccagggcgtggagagattcatccaggagagcaagctgaagatcaacctgttcgagaaggagaaggagatgaagaagagccccaccagcctgaagagagagacctactacctgagcgacagccccctgctgggcccccccgtgggcgagcccagactgctggccagcagccccgccctgcccagcagcggcgcccaggccagactgaccagagcccccggccccccccacagcgcccacgccctgcccagagagagctgcaccgcccacgccgccagccaggccgccacccagagaaagcccggcaccaagctgctgctgcccagagccgccagcgtgagaggcagaagcatccccggcgccgccgagaagcccaagaaggagatccccgccagccccagcagaaccaagatccccgccgagaaggagagccacagagacgtgctgcccgacaagcccgcccccggcgccgtgaacgtgcccgccgccggcagccacctgggccagggcaagagagccatccccgtgcccaacaagctgggcctgaagaagaccctgctgaaggcccccggcagcaccagcaacctggccagaaagagcagcagcggccccgtgtggagcggcgccagcagcgcctgcaccagccccgccgtgggcaaggccaagagcagcgagttcgccagcatccccgccaacagcagcagacccctgagcaacatcagcaagagcggcagaatgggccccgccatgctgagacccgccctgcccgccggccccgtgggcgccagcagctggcaggccaagagagtggacgtgagcgagctggccgccgagcagctgaccgccccccccagcgccagccccacccagccccagacccccgagggcggcggccagtggctgaacagcagctgcgcctggagcgagagcagccagctgaacaagaccagaagcatcagaagaagagacagctgcctgaacagcaagaccaaggtgatgcccacccccaccaaccagttcaagatccccaagttcagcatcggcgacagccccgacagcagcacccccaagctgagcagagcccagagaccccagagctgcaccagcgtgggcagagtgaccgtgcacagcacccccgtgagaagaagcagcggccccgccccccagagcctgctgagcgcctggagagtgagcgccctgcccacccccgccagcagaagatgcagcggcctgccccccatgacccccaagaccatgcccagagccgtgggcagccccctgtgcgtgcccgccagaagaagaagcagcgagcccagaaagaacagcgccatgagaaccgagcccaccagagagagcaacagaaagaccgacagcagactggtggacgtgagccccgacagaggcagcccccccagcagagtgccccaggccctgaacttcagccccgaggagagcgacagcaccttcagcaagagcaccgccaccgaggtggccagagaggaggccaagcccggcggcgacgccgcccccagcgaggccctgctggtggacatcaagctggagcccctggccgtgacccccgacgccgccagccagcccctgatcgacctgcccctgatcgacttctgcgacacccccgaggcccacgtggccgtgggcagcgagagcagacccctgatcgacctgatgaccaacacccccgacatgaacaagaacgtggccaagcccagccccgtggtgggccagctgatcgacctgagcagccccctgatccagctgagccccgaggccgacaaggagaacgtggacagccccctgctgaagttctag

SEQ ID NO: 10812 - DNA, 1149 bp, Artificial Sequence
  Description of Artificial Sequence: Synthetic coding sequence
atgggcgactggagcgccctgggcaagctgctggacaaggtgcaggcctacagcaccgccggcggcaaggtgtggctgagcgtgctgttcatcttcagaatcctgctgctgggcaccgccgtggagagcgcctggggcgacgagcagagcgccttcagatgcaacacccagcagcccggctgcgagaacgtgtgctacgacaagagcttccccatcagccacgtgagattctgggtgctgcagatcatcttcgtgagcgtgcccaccctgctgtacctggcccacgtgttctacgtgatgagaaaggaggagaagctgaacaagaaggaggaggagctgaaggtggcccagaccgacggcgtgaacgtggacatgcacctgaagcagatcgagatcaagaagttcaagtacggcatcgaggagcacggcaaggtgaagatgagaggcggcctgctgagaacctacatcatcagcatcctgttcaagagcatcttcgaggtggccttcctgctgatccagtggtacatctacggcttcagcctgagcgccgtgtacacctgcaagagagacccctgcccccaccaggtggactgcttcctgagcagacccaccgagaagaccatcttcatcatcttcatgctggtggtgagcctggtgagcctggccctgaacatcatcgagctgttctacgtgttcttcaagggcgtgaaggacagagtgaagggcaagagcgacccctaccacgccaccagcggcgccctgagccccgccaaggactgcggcagccagaagtacgcctacttcaacggctgcagcagccccaccgcccccctgagccccatgagcccccccggctacaagctggtgaccggcgacagaaacaacagcagctgcagaaactacaacaagcaggccagcgagcagaactgggccaactacagcgccgagcagaacagaatgggccaggccggcagcaccatcagcaacagccacgcccagcccttcgacttccccgacgacaaccagaacagcaagaagctggccgccggccacgagctgcagcccctggccatcgtggaccagagacccagcagcagagccagcagcagagccagcagcagacccagacccgacgacctggagatctag

SEQ ID NO: 10813 - DNA, 1101 bp, Artificial Sequence
  Description of Artificial Sequence: Synthetic coding sequence
atgggcgactggagcgccctgggcaagctgctggacaaggtgcaggcctacagcaccgccggcggcaaggtgtggctgagcgcctggggcgacgagcagagcgccttcagatgcaacacccagcagcccggctgcgagaacgtgtgctacgacaagagcttccccatcagccacgtgagattctgggtgctgcagatcatcttcgtgagcgtgcccaccctgctgtacctggcccacgtgttctacgtgatgagaaaggaggagaagctgaacaagaaggaggaggagctgaaggtggcccagaccgacggcgtgaacgtggacatgcacctgaagcagatcgagatcaagaagttcaagtacggcatcgaggagcacggcaaggtgaagatgagaggcggcctgctgagaacctacatcatcagcatcctgttcaagagcatcttcgaggtggccttcctgctgatccagtggtacatctacggcttcagcctgagcgccgtgtacacctgcaagagagacccctgcccccaccaggtggactgcttcctgagcagacccaccgagaagaccatcttcatcatcttcatgctggtggtgagcctggtgagcctggccctgaacatcatcgagctgttctacgtgttcttcaagggcgtgaaggacagagtgaagggcaagagcgacccctaccacgccaccagcggcgccctgagccccgccaaggactgcggcagccagaagtacgcctacttcaacggctgcagcagccccaccgcccccctgagccccatgagcccccccggctacaagctggtgaccggcgacagaaacaacagcagctgcagaaactacaacaagcaggccagcgagcagaactgggccaactacagcgccgagcagaacagaatgggccaggccggcagcaccatcagcaacagccacgcccagcccttcgacttccccgacgacaaccagaacagcaagaagctggccgccggccacgagctgcagcccctggccatcgtggaccagagacccagcagcagagccagcagcagagccagcagcagacccagacccgacgacctggagatctag

SEQ ID NO: 10814 - DNA, 2673 bp, Artificial Sequence
  Description of Artificial Sequence: Synthetic coding sequence
atggacagcaacaccgcccccctgggccccagctgcccccagcccccccccgccccccagccccaggccagaagcagactgaacgccaccgccagcctggagcaggagagaagcgagagacccagagcccccggcccccaggccggccccggccccggcgtgagagacgccgccgcccccgccgagccccaggcccagcacaccagaagcagagagagagccgacggcaccggccccaccaagggcgacatggagatccccttcgaggaggtgctggagagagccaaggccggcgaccccaaggcccagaccgaggtgggcaagcactacctgcagctggccggcgacaccgacgaggagctgaacagctgcaccgccgtggactggctggtgctggccgccaagcagggcagaagagaggccgtgaagctgctgagaagatgcctggccgacagaagaggcatcaccagcgagaacgagagagaggtgagacagctgagcagcgagaccgacctggagagagccgtgagaaaggccgccctggtgatgtactggaagctgaaccccaagaagaagaagcaggtggccgtggccgagctgctggagaacgtgggccaggtgaacgagcacgacggcggcgcccagcccggccccgtgcccaagagcctgcagaagcagagaagaatgctggagagactggtgagcagcgagagcaagaactacatcgccctggacgacttcgtggagatcaccaagaagtacgccaagggcgtgatccccagcagcctgttcctgcaggacgacgaggacgacgacgagctggccggcaagagccccgaggacctgcccctgagactgaaggtggtgaagtaccccctgcacgccatcatggagatcaaggagtacctgatcgacatggccagcagagccggcatgcactggctgagcaccatcatccccacccaccacatcaacgccctgatcttcttcttcatcgtgagcaacctgaccatcgacttcttcgccttcttcatccccctggtgatcttctacctgagcttcatcagcatggtgatctgcaccctgaaggtgttccaggacagcaaggcctgggagaacttcagaaccctgaccgacctgctgctgagattcgagcccaacctggacgtggagcaggccgaggtgaacttcggctggaaccacctggagccctacgcccacttcctgctgagcgtgttcttcgtgatcttcagcttccccatcgccagcaaggactgcatcccctgcagcgagctggccgtgatcaccggcttcttcaccgtgaccagctacctgagcctgagcacccacgccgagccctacaccagaagagccctggccaccgaggtgaccgccggcctgctgagcctgctgcccagcatgcccctgaactggccctacctgaaggtgctgggccagaccttcatcaccgtgcccgtgggccacctggtggtgctgaacgtgagcgtgccctgcctgctgtacgtgtacctgctgtacctgttcttcagaatggcccagctgagaaacttcaagggcacctactgctacctggtgccctacctggtgtgcttcatgtggtgcgagctgagcgtggtgatcctgctggagagcaccggcctgggcctgctgagagccagcatcggctacttcctgttcctgttcgccctgcccatcctggtggccggcctggccctggtgggcgtgctgcagttcgccagatggttcaccagcctggagctgaccaagatcgccgtgaccgtggccgtgtgcagcgtgcccctgctgctgagatggtggaccaaggccagcttcagcgtggtgggcatggtgaagagcctgaccagaagcagcatggtgaagctgatcctggtgtggctgaccgccatcgtgctgttctgctggttctacgtgtacagaagcgagggcatgaaggtgtacaacagcaccctgacctggcagcagtacggcgccctgtgcggccccagagcctggaaggagaccaacatggccagaacccagatcctgtgcagccacctggagggccacagagtgacctggaccggcagattcaagtacgtgagagtgaccgacatcgacaacagcgccgagagcgccatcaacatgctgcccttcttcatcggcgactggatgagatgcctgtacggcgaggcctaccccgcctgcagccccggcaacaccagcaccgccgaggaggagctgtgcagactgaagctgctggccaagcacccctgccacatcaagaagttcgacagatacaagttcgagatcaccgtgggcatgcccttcagcagcggcgccgacggcagcagaagcagagaggaggacgacgtgaccaaggacatcgtgctgagagccagcagcgagttcaagagcgtgctgctgagcctgagacagggcagcctgatcgagttcagcaccatcctggagggcagactgggcagcaagtggcccgtgttcgagctgaaggccatcagctgcctgaactgcatggcccagctgagccccaccagaagacacgtgaagatcgagcacgactggagaagcaccgtgcacggcgccgtgaagttcgccttcgacttcttcttcttccccttcctgagcgccgcctag

SEQ ID NO: 10815 - DNA, 654 bp, Artificial Sequence; identical to SEQ ID NO: 10795
  Description of Artificial Sequence: Synthetic coding sequence

SEQ ID NO: 10816 - DNA, 1590 bp, Artificial Sequence
  Description of Artificial Sequence: Synthetic coding sequence
atgggctgcgtgttctgcaagaagctggagcccgtggccaccgccaaggaggacgccggcctggagggcgacttcagaagctacggcgccgccgaccactacggccccgaccccaccaaggccagacccgccagcagcttcgcccacatccccaactacagcaacttcagcagccaggccatcaaccccggcttcctggacagcggcaccatcagaggcgtgagcggcatcggcgtgaccctgttcatcgccctgtacgactacgaggccagaaccgaggacgacctgaccttcaccaagggcgagaagttccacatcctgaacaacaccgagggcgactggtgggaggccagaagcctgagcagcggcaagaccggctgcatccccagcaactacgtggcccccgtggacagcatccaggccgaggagtggtacttcggcaagatcggcagaaaggacgccgagagacagctgctgagccccggcaacccccagggcgccttcctgatcagagagagcgagaccaccaagggcgcctacagcctgagcatcagagactgggaccagaccagaggcgaccacgtgaagcactacaagatcagaaagctggacatgggcggctactacatcaccaccagagtgcagttcaacagcgtgcaggagctggtgcagcactacatggaggtgaacgacggcctgtgcaacctgctgatcgccccctgcaccatcatgaagccccagaccctgggcctggccaaggacgcctgggagatcagcagaagcagcatcaccctggagagaagactgggcaccggctgcttcggcgacgtgtggctgggcacctggaacggcagcaccaaggtggccgtgaagaccctgaagcccggcaccatgagccccaaggccttcctggaggaggcccaggtgatgaagctgctgagacacgacaagctggtgcagctgtacgccgtggtgagcgaggagcccatctacatcgtgaccgagttcatgtgccacggcagcctgctggacttcctgaagaaccccgagggccaggacctgagactgccccagctggtggacatggccgcccaggtggccgagggcatggcctacatggagagaatgaactacatccacagagacctgagagccgccaacatcctggtgggcgagagactggcctgcaagatcgccgacttcggcctggccagactgatcaaggacgacgagtacaacccctgccagggcagcaagttccccatcaagtggaccgcccccgaggccgccctgttcggcagattcaccatcaagagcgacgtgtggagcttcggcatcctgctgaccgagctgatcaccaagggcagaatcccctaccccggcatgaacaagagagaggtgctggagcaggtggagcagggctaccacatgccctgcccccccggctgccccgccagcctgtacgaggccatggagcagacctggagactggaccccgaggagagacccaccttcgagtacctgcagagcttcctggaggactacttcaccagcgccgagccccagtaccagcccggcgaccagacctag

SEQ ID NO: 10817 - DNA, 1590 bp, Artificial Sequence; identical to SEQ ID NO: 10816
  Description of Artificial Sequence: Synthetic coding sequence

SEQ ID NO: 10818 - DNA, 1590 bp, Artificial Sequence; identical to SEQ ID NO: 10816
  Description of Artificial Sequence: Synthetic coding sequence

SEQ ID NO: 10819 - DNA, 1590 bp, Artificial Sequence; identical to SEQ ID NO: 10816
  Description of Artificial Sequence: Synthetic coding sequence

SEQ ID NO: 10820 - DNA, 942 bp, Artificial Sequence
  Description of Artificial Sequence: Synthetic coding sequence
atgggctgcgtgttctgcaagaagctggagcccgtggccaccgccaaggaggacgccggcctggagggcgacttcagaagctacggcgccgccgaccactacggccccgaccccaccaaggccagacccgccagcagcttcgcccacatccccaactacagcaacttcagcagccaggccatcaaccccggcttcctggacagcggcaccatcagaggcgtgagcggcatcggcgtgaccctgttcatcgccctgtacgactacgaggccagaaccgaggacgacctgaccttcaccaagggcgagaagttccacatcctgaacaacaccgagggcgactggtgggaggccagaagcctgagcagcggcaagaccggctgcatccccagcaactacgtggcccccgtggacagcatccaggccgaggagtggtacttcggcaagatcggcagaaaggacgccgagagacagctgctgagccccggcaacccccagggcgccttcctgatcagagagagcgagaccaccaagggcgcctacagcctgagcatcagagactgggaccagaccagaggcgaccacgtgaagcactacaagatcagaaagctggacatgggcggctactacatcaccaccagagtgcagttcaacagcgtgcaggagctggtgcagcactacatggaggtgaacgacggcctgtgcaacctgctgatcgccccctgcaccatcatgaagccccagaccctgggcctggccaaggacgcctgggagatcagcagaagcagcatcaccctggagagaagactgggcaccggctgcttcggcgacgtgtggctgggcacctggaacggcagcaccaaggtggccgtgaagaccctgaagcccggcaccatgagccccaaggccttcctggaggaggcccaggtgatgaagctgctgtag

SEQ ID NO: 10821 - DNA, 1392 bp, Artificial Sequence
  Description of Artificial Sequence: Synthetic coding sequence
atgggctgcgtgttctgcaagaagctggagcccgtggccaccgccaaggaggacgccggcctggagggcgacttcagaagctacggcgccgccgaccactacggccccgaccccaccaaggccagacccgccagcagcttcgcccacatccccaactacagcaacttcagcagccaggccatcaaccccggcttcctggacagcggcaccatcagaggcgtgagcggcatcggcgtgaccctgttcatcgccctgtacgactacgaggccagaaccgaggacgacctgaccttcaccaagggcgagaagttccacatcctgaacaacaccgagggcgcctacagcctgagcatcagagactgggaccagaccagaggcgaccacgtgaagcactacaagatcagaaagctggacatgggcggctactacatcaccaccagagtgcagttcaacagcgtgcaggagctggtgcagcactacatggaggtgaacgacggcctgtgcaacctgctgatcgccccctgcaccatcatgaagccccagaccctgggcctggccaaggacgcctgggagatcagcagaagcagcatcaccctggagagaagactgggcaccggctgcttcggcgacgtgtggctgggcacctggaacggcagcaccaaggtggccgtgaagaccctgaagcccggcaccatgagccccaaggccttcctggaggaggcccaggtgatgaagctgctgagacacgacaagctggtgcagctgtacgccgtggtgagcgaggagcccatctacatcgtgaccgagttcatgtgccacggcagcctgctggacttcctgaagaaccccgagggccaggacctgagactgccccagctggtggacatggccgcccaggtggccgagggcatggcctacatggagagaatgaactacatccacagagacctgagagccgccaacatcctggtgggcgagagactggcctgcaagatcgccgacttcggcctggccagactgatcaaggacgacgagtacaacccctgccagggcagcaagttccccatcaagtggaccgcccccgaggccgccctgttcggcagattcaccatcaagagcgacgtgtggagcttcggcatcctgctgaccgagctgatcaccaagggcagaatcccctaccccggcatgaacaagagagaggtgctggagcaggtggagcagggctaccacatgccctgcccccccggctgccccgccagcctgtacgaggccatggagcagacctggagactggaccccgaggagagacccaccttcgagtacctgcagagcttcctggaggactacttcaccagcgccgagccccagtaccagcccggcgaccagacctag

SEQ ID NO: 10822 - DNA, 1005 bp, Artificial Sequence
  Description of Artificial Sequence: Synthetic coding sequence
atggagttccccggcctgggcagcctgggcaccagcgagcccctgccccagttcgtggaccccgccctggtgagcagcacccccgagagcggcgtgttcttccccagcggccccgagggcctggacgccgccgccagcagcaccgcccccagcaccgccaccgccgccgccgccgccctggcctactacagagacgccgaggcctacagacacagccccgtgttccaggtgtaccccctgctgaactgcatggagggcatccccggcggcagcccctacgccggctgggcctacggcaagaccggcctgtaccccgccagcaccgtgtgccccaccagagaggacagccccccccaggccgtggaggacctggacggcaagggcagcaccagcttcctggagaccctgaagaccgagagactgagccccgacctgctgaccctgggccccgccctgcccagcagcctgcccgtgcccaacagcgcctacggcggccccgacttcagcagcaccttcttcagccccaccggcagccccctgaacagcgccgcctacagcagccccaagctgagaggcaccctgcccctgcccccctgcgaggccagagagtgcgtgaactgcggcgccaccgccacccccctgtggagaagagacagaaccggccactacctgtgcaacgcctgcggcctgtaccacaagatgaacggccagaacagacccctgatcagacccaagaagagactgatcgtgagcaagagagccggcacccagtgcaccaactgccagaccaccaccaccaccctgtggagaagaaacgccagcggcgaccccgtgtgcaacgcctgcggcctgtactacaagctgcaccagcactactgcggcggcagcgcccagctgatgagagcccagagcatggccagcagaggcggcgtggtgagcttcagcagctgcagccagaacagcggccagcccaagagcctgggccccagacaccccctggcctag

SEQ ID NO: 10823 - DNA, 1242 bp, Artificial Sequence
  Description of Artificial Sequence: Synthetic coding sequence
atggagttccccggcctgggcagcctgggcaccagcgagcccctgccccagttcgtggaccccgccctggtgagcagcacccccgagagcggcgtgttcttccccagcggccccgagggcctggacgccgccgccagcagcaccgcccccagcaccgccaccgccgccgccgccgccctggcctactacagagacgccgaggcctacagacacagccccgtgttccaggtgtaccccctgctgaactgcatggagggcatccccggcggcagcccctacgccggctgggcctacggcaagaccggcctgtaccccgccagcaccgtgtgccccaccagagaggacagccccccccaggccgtggaggacctggacggcaagggcagcaccagcttcctggagaccctgaagaccgagagactgagccccgacctgctgaccctgggccccgccctgcccagcagcctgcccgtgcccaacagcgcctacggcggccccgacttcagcagcaccttcttcagccccaccggcagccccctgaacagcgccgcctacagcagccccaagctgagaggcaccctgcccctgcccccctgcgaggccagagagtgcgtgaactgcggcgccaccgccacccccctgtggagaagagacagaaccggccactacctgtgcaacgcctgcggcctgtaccacaagatgaacggccagaacagacccctgatcagacccaagaagagactgatcgtgagcaagagagccggcacccagtgcaccaactgccagaccaccaccaccaccctgtggagaagaaacgccagcggcgaccccgtgtgcaacgcctgcggcctgtactacaagctgcaccaggtgaacagacccctgaccatgagaaaggacggcatccagaccagaaacagaaaggccagcggcaagggcaagaagaagagaggcagcagcctgggcggcaccggcgccgccgagggccccgccggcggcttcatggtggtggccggcggcagcggcagcggcaactgcggcgaggtggccagcggcctgaccctgggcccccccggcaccgcccacctgtaccagggcctgggccccgtggtgctgagcggccccgtgagccacctgatgcccttccccggccccctgctgggcagccccaccggcagcttccccaccggccccatgccccccaccaccagcaccaccgtggtggcccccctgagcagctag

SEQ ID NO: 10824 - DNA, 369 bp, Artificial Sequence
  Description of Artificial Sequence: Synthetic coding sequence
tgacagaacagacccctgatcagacccaagaagagactgatcgtgagcaagagagccggcacccagtgcaccaactgccagaccaccaccaccaccctgtggagaagaaacgccagcggcgaccccgtgtgcaacgcctgcggcctgtactacaagctgcaccaggtgaacagacccctgaccatgagaaaggacggcatccagaccagaaacagaaaggccagcggcaagggcaagaagaagagaggcagcagcctgggcggcaccggcgccgccgagggccccgccctgctgtggtggctgagaagcgcccacgagggcaccgagcacggcctgcagagaagaggcggcgtgctgctgctgctgtag

SEQ ID NO: 10825 - DNA, 1332 bp, Artificial Sequence
  Description of Artificial Sequence: Synthetic coding sequence
atggaggtgaccgccgaccagcccagatgggtgagccaccaccaccccgccgtgctgaacggccagcaccccgacacccaccaccccggcctgagccacagctacatggacgccgcccagtaccccctgcccgaggaggtggacgtgctgttcaacatcgacggccagggcaaccacgtgcccccctactacggcaacagcgtgagagccaccgtgcagagatacccccccacccaccacggcagccaggtgtgcagaccccccctgctgcacggcagcctgccctggctggacggcggcaaggccctgggcagccaccacaccgccagcccctggaacctgagccccttcagcaagaccagcatccaccacggcagccccggccccctgagcgtgtacccccccgccagcagcagcagcctgagcggcggccacgccagcccccacctgttcaccttcccccccaccccccccaaggacgtgagccccgaccccagcctgagcacccccggcagcgccggcagcgccagacaggacgagaaggagtgcctgaagtaccaggtgcccctgcccgacagcatgaagctggagagcagccacagcagaggcagcatgaccgccctgggcggcgccagcagcagcacccaccaccccatcaccacctaccccccctacgtgcccgagtacagcagcggcctgttcccccccagcagcctgctgggcggcagccccaccggcttcggctgcaagagcagacccaaggccagaagcagcaccggcagagagtgcgtgaactgcggcgccaccagcacccccctgtggagaagagacggcaccggccactacctgtgcaacgcctgcggcctgtaccacaagatgaacggccagaacagacccctgatcaagcccaagagaagactgagcgccgccagaagagccggcaccagctgcgccaactgccagaccaccaccaccaccctgtggagaagaaacgccaacggcgaccccgtgtgcaacgcctgcggcctgtactacaagctgcacaacatcaacagacccctgaccatgaagaaggagggcatccagaccagaaacagaaagatgagcagcaagagcaagaagtgcaagaaggtgcacgacagcctggaggacttccccaagaacagcagcttcaaccccgccgccctgagcagacacatgagcagcctgagccacatcagccccttcagccacagcagccacatgctgaccacccccacccccatgcacccccccagcagcctgagcttcggcccccaccaccccagcagcatggtgaccgccatgggctag

SEQ ID NO: 10826 - DNA, 1335 bp, Artificial Sequence
  Description of Artificial Sequence: Synthetic coding sequence
atggaggtgaccgccgaccagcccagatgggtgagccaccaccaccccgccgtgctgaacggccagcaccccgacacccaccaccccggcctgagccacagctacatggacgccgcccagtaccccctgcccgaggaggtggacgtgctgttcaacatcgacggccagggcaaccacgtgcccccctactacggcaacagcgtgagagccaccgtgcagagatacccccccacccaccacggcagccaggtgtgcagaccccccctgctgcacggcagcctgccctggctggacggcggcaaggccctgggcagccaccacaccgccagcccctggaacctgagccccttcagcaagaccagcatccaccacggcagccccggccccctgagcgtgtacccccccgccagcagcagcagcctgagcggcggccacgccagcccccacctgttcaccttcccccccaccccccccaaggacgtgagccccgaccccagcctgagcacccccggcagcgccggcagcgccagacaggacgagaaggagtgcctgaagtaccaggtgcccctgcccgacagcatgaagctggagagcagccacagcagaggcagcatgaccgccctgggcggcgccagcagcagcacccaccaccccatcaccacctaccccccctacgtgcccgagtacagcagcggcctgttcccccccagcagcctgctgggcggcagccccaccggcttcggctgcaagagcagacccaaggccagaagcagcaccgagggcagagagtgcgtgaactgcggcgccaccagcacccccctgtggagaagagacggcaccggccactacctgtgcaacgcctgcggcctgtaccacaagatgaacggccagaacagacccctgatcaagcccaagagaagactgagcgccgccagaagagccggcaccagctgcgccaactgccagaccaccaccaccaccctgtggagaagaaacgccaacggcgaccccgtgtgcaacgcctgcggcctgtactacaagctgcacaacatcaacagacccctgaccatgaagaaggagggcatccagaccagaaacagaaagatgagcagcaagagcaagaagtgcaagaaggtgcacgacagcctggaggacttccccaagaacagcagcttcaaccccgccgccctgagcagacacatgagcagcctgagccacatcagccccttcagccacagcagccacatgctgaccacccccacccccatgcacccccccagcagcctgagcttcggcccccaccaccccagcagcatggtgaccgccatgggctag

SEQ ID NO: 10827 - DNA, 393 bp, Artificial Sequence
  Description of Artificial Sequence: Synthetic coding sequence
atggaggtgaccgccgaccagcccagatgggtgagccaccaccaccccgccgtgctgaacggccagcaccccgacacccaccaccccggcctgagccacagctacatggacgccgcccagtaccccctgcccgaggaggtggacgtgctgttcaacatcgacggccagggcaaccacgtgcccccctactacggcaacagcgtgagagccaccgtgcagagatacccccccacccaccacggcagccaggtgtgcagaccccccctgctgcacggcagcctgccctggctggacggcggcaaggccctgggcagccaccacaccgccagcccctggaacctgagaccctgcctgcagtgcctgtgggccctgctgcaggccagccagtgctag

SEQ ID NO: 10828 - DNA, 798 bp, Artificial Sequence
  Description of Artificial Sequence: Synthetic coding sequence
atgagaagagccgagctggccggcctgaagaccatggcctgggtgcccgccgagagcgccgtggaggagctgatgcccagactgctgcccgtggagccctgcgacctgaccgagggcttcgaccccagcgtgccccccagaaccccccaggagtacctgagaagagtgcagatcgaggccgcccagtgccccgacgtggtggtggcccagatcgaccccaagaagctgaagagaaagcagagcgtgaacatcagcctgagcggctgccagcccgcccccgagggctacagccccaccctgcagtggcagcagcagcaggtggcccagttcagcaccgtgagacagaacgtgaacaagcacagaagccactggaagagccagcagctggacagcaacgtgaccatgcccaagagcgaggacgaggagggctggaagaagttctgcctgggcgagaagctgtgcgccgacggcgccgtgggccccgccaccaacgagagccccggcatcgactacgtgcaggccaccgtgaccagcgtgctggagtacctgagcaactggttcggcgagagagacttcacccccgagctgggcagatggctgtacgccctgctggcctgcctggagaagcccctgctgcccgaggcccacagcctgatcagacagctggccagaagatgcagcgaggtgagactgctggtggacagcaaggacgacgagagagtgcccgccctgaacctgctgatctgcctggtgagcagatacttcgaccagagagacctggccgacgagcccagctag

SEQ ID NO: 10829 - DNA, 843 bp, Artificial Sequence
  Description of Artificial Sequence: Synthetic coding sequence
atgagaagagccgagctggccggcctgaagaccatggcctgggtgcccgccgagagcgccgtggaggagctgatgcccagactgctgcccgtggagccctgcgacctgaccgagggcttcgaccccagcgtgccccccagaaccccccaggagtacctgagaagagtgcagatcgaggccgcccagtgccccgacgtggtggtggcccagatcgaccccaagaagctgaagagaaagcagagcgtgaacatcagcctgagcggctgccagcccgcccccgagggctacagccccaccctgcagtggcagcagcagcaggtggcccagttcagcaccgtgagacagaacgtgaacaagcacagaagccactggaagagccagcagctggacagcaacgtgaccatgcccaagagcgaggacgaggagggctggaagaagttctgcctgggcgagaagctgtgcgccgacggcgccgtgggccccgccaccaacgagagccccggcatcgactacgtgcagatcggcttcccccccctgctgagcatcgtgagcagaatgaaccaggccaccgtgaccagcgtgctggagtacctgagcaactggttcggcgagagagacttcacccccgagctgggcagatggctgtacgccctgctggcctgcctggagaagcccctgctgcccgaggcccacagcctgatcagacagctggccagaagatgcagcgaggtgagactgctggtggacagcaaggacgacgagagagtgcccgccctgaacctgctgatctgcctggtgagcagatacttcgaccagagagacctggccgacgagcccagctag

SEQ ID NO: 10830 - DNA, 753 bp, Artificial Sequence
  Description of Artificial Sequence: Synthetic coding sequence
atgagaagagccgagctggccggcctgaagaccatggcctgggtgcccgccgagagcgccgtggaggagctgatgcccagactgctgcccgtggagccctgcgacctgaccgagggcttcgaccccagcgtgccccccagaaccccccaggagtacctgagaagagtgcagatcgaggccgcccagtgccccgacgtggtggtggcccagatcgaccccaagaagctgaagagaaagcagagcgtgaacatcagcctgagcggctgccagcccgcccccgagggctacagccccaccctgcagtggcagcagcagcaggtggcccagttcagcaccgtgagacagaacgtgaacaagcacagaagccactggaagagccagcagctggacagcaacgtgaccatgcccaagagcgaggacgaggagggctggaagaagttctgcctgggcgagaagctgtgcgccgacggcgccgtgggccccgccaccaacgagagccccggcatcgactacgtgcagatcggcttcccccccctgctgagcatcgtgagcagaatgaaccaggccaccgtgaccagcgtgctggagtacctgagcaactggttcggcgagagagacttcacccccgagctgggcagatggctgtacgccctgctggcctgcctggagaagcccctgctgcccgaggcccacagcctgatcagacagctggccagaagatgcagcgaggtgagactgctggtggtgttctag

SEQ ID NO: 10831 - DNA, 768 bp, Artificial Sequence
  Description of Artificial Sequence: Synthetic coding sequence
atggacgtgatggacggctgccagttcagccccagcgagtacttctacgacggcagctgcatccccagccccgagggcgagttcggcgacgagttcgtgcccagagtggccgccttcggcgcccacaaggccgagctgcagggcagcgacgaggacgagcacgtgagagcccccaccggccaccaccaggccggccactgcctgatgtgggcctgcaaggcctgcaagagaaagagcaccaccatggacagaagaaaggccgccaccatgagagagagaagaagactgaagaaggtgaaccaggccttcgagaccctgaagagatgcaccaccaccaaccccaaccagagactgcccaaggtggagatcctgagaaacgccatcagatacatcgagagcctgcaggagctgctgagagagcaggtggagaactactacagcctgcccggccagagctgcagcgagcccaccagccccaccagcaactgcagcgacggcatgcccgagtgcaacagccccgtgtggagcagaaagagcagcaccttcgacagcatctactgccccgacgtgagcaacgtgtacgccaccgacaagaacagcctgagcagcctggactgcctgagcaacatcgtggacagaatcaccagcagcgagcagcccggcctgcccctgcaggacctggccagcctgagccccgtggccagcaccgacagccagcccgccacccccggcgccagcagcagcagactgatctaccacgtgctgtag

SEQ ID NO: 10832 - DNA, 1725 bp, Artificial Sequence
  Description of Artificial Sequence: Synthetic coding sequence
ctgagccccagcctgggcttccccgcccagatgaaccaccagaagggccccagccccagcttcggcgtgcagccctgcggcccccacgacagcgccagaggcggcatgatcccccacccccagagcagaggccccttccccacctgccagctgaagagcgagctggacatgctggtgggcaagtgcagagaggagcccctggagggcgacatgagcagccccaacagcaccggcatccaggaccccctgctgggcatgctggacggcagagaggacctggagagagaggagaagagagagcccgagagcgtgtacgagaccgactgcagatgggacggctgcagccaggagttcgacagccaggagcagctggtgcaccacatcaacagcgagcacatccacggcgagagaaaggagttcgtgtgccactggggcggctgcagcagagagctgagacccttcaaggcccagtacatgctggtggtgcacatgagaagacacaccggcgagaagccccacaagtgcaccttcgagggctgcagaaagagctacagcagactggagaacctgaagacccacctgagaagccacaccggcgagaagccctacatgtgcgagcacgagggctgcagcaaggccttcagcaacgccagcgacagagccaagcaccagaacagaacccacagcaacgagaagccctacgtgtgcaagctgcccggctgcaccaagagatacaccgaccccagcagcctgagaaagcacgtgaagaccgtgcacggccccgacgcccacgtgaccaagagacacagaggcgacggccccctgcccagagcccccagcatcagcaccgtggagcccaagagagagagagagggcggccccatcagagaggagagcagactgaccgtgcccgagggcgccatgcccccccacccccagcccctgttcagccactacccccagcccagccccccccagtacctgcagagcggcccctacacccagcccccccccgactacctgcccagcgagcccagaccctgcctggacttcgacagccccacccacagcaccggccagctgaaggcccagctggtgtgcaactacgtgcagagccagcaggagctgctgtgggagggcggcggcagagaggacgcccccgcccaggagcccagctaccagagccccaagttcctgggcggcagccaggtgagccccagcagagccaaggcccccgtgaacacctacggccccggcttcggccccaacctgcccaaccacaagagcggcagctaccccacccccagcccctgccacgagaacttcgtggtgggcgccaacagagccagccacagagccgccgccccccccagactgctgccccccctgcccacctgctacggccccctgaaggtgggcggcaccaaccccagctgcggccaccccgaggtgggcagactgggcggcggccccgccctgtaccccccccccgagggccaggtgtgcaaccccctggacagcctggacctggacaacacccagctggacttcgtggccatcctggacgagccccagggcctgagccccccccccagccacgaccagagaggcagcagcggccacacccccccccccagcggcccccccaacatggccgtgggcaacatgagcgtgctgctgagaagcctgcccggcgagaccgagttcctgaacagcagcgcctag

SEQ ID NO: 10833 - DNA, 390 bp, Artificial Sequence
  Description of Artificial Sequence: Synthetic coding sequence
atgttcaacagcatgacccccccccccatcagcagctacggcgagccctgctgcctgagacccctgcccagccagggcgcccccagcgtgggcaccgagggcctgagcggcccccccttctgccaccaggccaacctgatgagcggcccccacagctacggccccgccagagagaccaacagctgcaccgagggccccctgttcagcagccccagaagcgccgtgaagctgaccaagaagagagccctgagcatcagccccctgagcgacgccagcctggacctgcagaccgtgatcagaaccagccccagcagcctggtggccttcatcaacagcagatgcaccagccccggcggcagctacggccacctgagcatcggcaccatgtag

SEQ ID NO: 10834 - DNA, 3198 bp, Artificial Sequence
  Description of Artificial Sequence: Synthetic coding sequence
atgttcaacagcatgacccccccccccatcagcagctacggcgagccctgctgcctgagacccctgcccagccagggcgcccccagcgtgggcaccgaggtgaagctgaccaagaagagagccctgagcatcagccccctgagcgacgccagcctggacctgcagaccgtgatcagaaccagccccagcagcctggtggccttcatcaacagcagatgcaccagccccggcggcagctacggccacctgagcatcggcaccatgagccccagcctgggcttccccgcccagatgaaccaccagaagggccccagccccagcttcggcgtgcagccctgcggcccccacgacagcgccagaggcggcatgatcccccacccccagagcagaggccccttccccacctgccagctgaagagcgagctggacatgctggtgggcaagtgcagagaggagcccctggagggcgacatgagcagccccaacagcaccggcatccaggaccccctgctgggcatgctggacggcagagaggacctggagagagaggagaagagagagcccgagagcgtgtacgagaccgactgcagatgggacggctgcagccaggagttcgacagccaggagcagctggtgcaccacatcaacagcgagcacatccacggcgagagaaaggagttcgtgtgccactggggcggctgcagcagagagctgagacccttcaaggcccagtacatgctggtggtgcacatgagaagacacaccggcgagaagccccacaagtgcaccttcgagggctgcagaaagagctacagcagactggagaacctgaagacccacctgagaagccacaccggcgagaagccctacatgtgcgagcacgagggctgcagcaaggccttcagcaacgccagcgacagagccaagcaccagaacagaacccacagcaacgagaagccctacgtgtgcaagctgcccggctgcaccaagagatacaccgaccccagcagcctgagaaagcacgtgaagaccgtgcacggccccgacgcccacgtgaccaagagacacagaggcgacggccccctgcccagagcccccagcatcagcaccgtggagcccaagagagagagagagggcggccccatcagagaggagagcagactgaccgtgcccgagggcgccatgaagccccagcccagccccggcgcccagagcagctgcagcagcgaccacagccccgccggcagcgccgccaacaccgacagcggcgtggagatgaccggcaacgccggcggcagcaccgaggacctgagcagcctggacgagggcccctgcatcgccggcaccggcctgagcaccctgagaagactggagaacctgagactggaccagctgcaccagctgagacccatcggcaccagaggcctgaagctgcccagcctgagccacaccggcaccaccgtgagcagaagagtgggcccccccgtgagcctggagagaagaagcagcagcagcagcagcatcagcagcgcctacaccgtgagcagaagaagcagcctggccagccccttcccccccggcagcccccccgagaacggcgccagcagcctgcccggcctgatgcccgcccagcactacctgctgagagccagatacgccagcgccagaggcggcggcaccagccccaccgccgccagcagcctggacagaatcggcggcctgcccatgcccccctggagaagcagagccgagtaccccggctacaaccccaacgccggcgtgaccagaagagccagcgaccccgcccaggccgccgacagacccgcccccgccagagtgcagagattcaagagcctgggctgcgtgcacaccccccccaccgtggccggcggcggccagaacttcgacccctacctgcccaccagcgtgtacagcccccagccccccagcatcaccgagaacgccgccatggacgccagaggcctgcaggaggagcccgaggtgggcaccagcatggtgggcagcggcctgaacccctacatggacttcccccccaccgacaccctgggctacggcggccccgagggcgccgccgccgagccctacggcgccagaggccccggcagcctgcccctgggccccggcccccccaccaactacggccccaacccctgcccccagcaggccagctaccccgaccccacccaggagacctggggcgagttccccagccacagcggcctgtaccccggccccaaggccctgggcggcacctacagccagtgccccagactggagcactacggccaggtgcaggtgaagcccgagcagggctgccccgtgggcagcgacagcaccggcctggccccctgcctgaacgcccaccccagcgagggccccccccacccccagcccctgttcagccactacccccagcccagccccccccagtacctgcagagcggcccctacacccagcccccccccgactacctgcccagcgagcccagaccctgcctggacttcgacagccccacccacagcaccggccagctgaaggcccagctggtgtgcaactacgtgcagagccagcaggagctgctgtgggagggcggcggcagagaggacgcccccgcccaggagcccagctaccagagccccaagttcctgggcggcagccaggtgagccccagcagagccaaggcccccgtgaacacctacggccccggcttcggccccaacctgcccaaccacaagagcggcagctaccccacccccagcccctgccacgagaacttcgtggtgggcgccaacagagccagccacagagccgccgccccccccagactgctgccccccctgcccacctgctacggccccctgaaggtgggcggcaccaaccccagctgcggccaccccgaggtgggcagactgggcggcggccccgccctgtaccccccccccgagggccaggtgtgcaaccccctggacagcctggacctggacaacacccagctggacttcgtggccatcctggacgagccccagggcctgagccccccccccagccacgaccagagaggcagcagcggccacacccccccccccagcggcccccccaacatggccgtgggcaacatgagcgtgctgctgagaagcctgcccggcgagaccgagttcctgaacagcagcgcctag

SEQ ID NO: 10835 - DNA, 528 bp, Artificial Sequence
  Description of Artificial Sequence: Synthetic coding sequence
atgagccccagcctgggcttccccgcccagatgaaccaccagaagggccccagccccagcttcggcgtgcagccctgcggcccccacgacagcgccagaggcggcatgatcccccacccccagagcagaggccccttccccacctgccagctgaagagcgagctggacatgctggtgggcaagtgcagagaggagcccctggagggcgacatgagcagccccaacagcaccggcatccaggaccccctgctgggcatgctggacggcagagaggacctggagagagaggagaagagagagcccgagagcgtgtacgagaccgactgcagatgggacggctgcagccaggagttcgacagccaggagcagctggtgcaccacatcaacagcgagcacatccacggcgagagaaaggagttcgtgtgccactggggcggctgcagcagagagctgagacccttcaaggcccagtacatgctggtggtgcacatgagaagacacaccggcgagaagccccacaagtgctag

SEQ ID NO: 10836 - DNA, 2937 bp, Artificial Sequence
  Description of Artificial Sequence: Synthetic coding sequence
atgagccccagcctgggcttccccgcccagatgaaccaccagaagggccccagccccagcttcggcgtgcagccctgcggcccccacgacagcgccagaggcggcatgatcccccacccccagagcagaggccccttccccacctgccagctgaagagcgagctggacatgctggtgggcaagtgcagagaggagcccctggagggcgacatgagcagccccaacagcaccggcatccaggaccccctgctgggcatgctggacggcagagaggacctggagagagaggagaagagagagcccgagagcgtgtacgagaccgactgcagatgggacggctgcagccaggagttcgacagccaggagcagctggtgcaccacatcaacagcgagcacatccacggcgagagaaaggagttcgtgtgccactggggcggctgcagcagagagctgagacccttcaaggcccagtacatgctggtggtgcacatgagaagacacaccggcgagaagccccacaagtgcaccttcgagggctgcagaaagagctacagcagactggagaacctgaagacccacctgagaagccacaccggcgagaagccctacatgtgcgagcacgagggctgcagcaaggccttcagcaacgccagcgacagagccaagcaccagaacagaacccacagcaacgagaagccctacgtgtgcaagctgcccggctgcaccaagagatacaccgaccccagcagcctgagaaagcacgtgaagaccgtgcacggccccgacgcccacgtgaccaagagacacagaggcgacggccccctgcccagagcccccagcatcagcaccgtggagcccaagagagagagagagggcggccccatcagagaggagagcagactgaccgtgcccgagggcgccatgaagccccagcccagccccggcgcccagagcagctgcagcagcgaccacagccccgccggcagcgccgccaacaccgacagcggcgtggagatgaccggcaacgccggcggcagcaccgaggacctgagcagcctggacgagggcccctgcatcgccggcaccggcctgagcaccctgagaagactggagaacctgagactggaccagctgcaccagctgagacccatcggcaccagaggcctgaagctgcccagcctgagccacaccggcaccaccgtgagcagaagagtgggcccccccgtgagcctggagagaagaagcagcagcagcagcagcatcagcagcgcctacaccgtgagcagaagaagcagcctggccagccccttcccccccggcagcccccccgagaacggcgccagcagcctgcccggcctgatgcccgcccagcactacctgctgagagccagatacgccagcgccagaggcggcggcaccagccccaccgccgccagcagcctggacagaatcggcggcctgcccatgcccccctggagaagcagagccgagtaccccggctacaaccccaacgccggcgtgaccagaagagccagcgaccccgcccaggccgccgacagacccgcccccgccagagtgcagagattcaagagcctgggctgcgtgcacaccccccccaccgtggccggcggcggccagaacttcgacccctacctgcccaccagcgtgtacagcccccagccccccagcatcaccgagaacgccgccatggacgccagaggcctgcaggaggagcccgaggtgggcaccagcatggtgggcagcggcctgaacccctacatggacttcccccccaccgacaccctgggctacggcggccccgagggcgccgccgccgagccctacggcgccagaggccccggcagcctgcccctgggccccggcccccccaccaactacggccccaacccctgcccccagcaggccagctaccccgaccccacccaggagacctggggcgagttccccagccacagcggcctgtaccccggccccaaggccctgggcggcacctacagccagtgccccagactggagcactacggccaggtgcaggtgaagcccgagcagggctgccccgtgggcagcgacagcaccggcctggccccctgcctgaacgcccaccccagcgagggccccccccacccccagcccctgttcagccactacccccagcccagccccccccagtacctgcagagcggcccctacacccagcccccccccgactacctgcccagcgagcccagaccctgcctggacttcgacagccccacccacagcaccggccagctgaaggcccagctggtgtgcaactacgtgcagagccagcaggagctgctgtgggagggcggcggcagagaggacgcccccgcccaggagcccagctaccagagccccaagttcctgggcggcagccaggtgagccccagcagagccaaggcccccgtgaacacctacggccccggcttcggccccaacctgcccaaccacaagagcggcagctaccccacccccagcccctgccacgagaacttcgtggtgggcgccaacagagccagccacagagccgccgccccccccagactgctgccccccctgcccacctgctacggccccctgaaggtgggcggcaccaaccccagctgcggccaccccgaggtgggcagactgggcggcggccccgccctgtaccccccccccgagggccaggtgtgcaaccccctggacagcctggacctggacaacacccagctggacttcgtggccatcctggacgagccccagggcctgagccccccccccagccacgaccagagaggcagcagcggccacacccccccccccagcggcccccccaacatggccgtgggcaacatgagcgtgctgctgagaagcctgcccggcgagaccgagttcctgaacagcagcgcctag

SEQ ID NO: 10837 - DNA, 135 bp, Artificial Sequence
  Description of Artificial Sequence: Synthetic coding sequence
atgagcggcccccacagctacggccccgccagagagaccaacagctgcaccgagggccccctgttcagcagccccagaagcgccgtgaagctgaccaagaagagagccctgagcatcagccccctgagcgactag

SEQ ID NO: 10838 - DNA, 3198 bp, Artificial Sequence; identical to SEQ ID NO: 10834
  Description of Artificial Sequence: Synthetic coding sequence

SEQ ID NO: 10839 - DNA, 1548 bp, Artificial Sequence
  Description of Artificial Sequence: Synthetic coding sequence
atggccgagcaggtggccctgagcagaacccaggtgtgcggcatcctgagagaggagctgttccagggcgacgccttccaccagagcgacacccacatcttcatcatcatgggcgccagcggcgacctggccaagaagaagatctaccccaccatctggtggctgttcagagacggcctgctgcccgagaacaccttcatcgtgggctacgccagaagcagactgaccgtggccgacatcagaaagcagagcgagcccttcttcaaggccacccccgaggagaagctgaagctggaggacttcttcgccagaaacagctacgtggccggccagtacgacgacgccgccagctaccagagactgaacagccacatgaacgccctgcacctgggcagccaggccaacagactgttctacctggccctgccccccaccgtgtacgaggccgtgaccaagaacatccacgagagctgcatgagccagatcggctggaacagaatcatcgtggagaagcccttcggcagagacctgcagagcagcgacagactgagcaaccacatcagcagcctgttcagagaggaccagatctacagaatcgaccactacctgggcaaggagatggtgcagaacctgatggtgctgagattcgccaacagaatcttcggccccatctggaacagagacaacatcgcctgcgtgatcctgaccttcaaggagcccttcggcaccgagggcagaggcggctacttcgacgagttcggcatcatcagagacgtgatgcagaaccacctgctgcagatgctgtgcctggtggccatggagaagcccgccagcaccaacagcgacgacgtgagagacgagaaggtgaaggtgctgaagtgcatcagcgaggtgcaggccaacaacgtggtgctgggccagtacgtgggcaaccccgacggcgagggcgaggccaccaagggctacctggacgaccccaccgtgcccagaggcagcaccaccgccaccttcgccgccgtggtgctgtacgtggagaacgagagatgggacggcgtgcccttcatcctgagatgcggcaaggccctgaacgagagaaaggccgaggtgagactgcagttccacgacgtggccggcgacatcttccaccagcagtgcaagagaaacgagctggtgatcagagtgcagcccaacgaggccgtgtacaccaagatgatgaccaagaagcccggcatgttcttcaaccccgaggagagcgagctggacctgacctacggcaacagatacaagaacgtgaagctgcccgacgcctacgagagactgatcctggacgtgttctgcggcagccagatgcacttcgtgagaagcgacgagctgagagaggcctggagaatcttcacccccctgctgcaccagatcgagctggagaagcccaagcccatcccctacatctacggcagcagaggccccaccgaggccgacgagctgatgaagagagtgggcttccagtacgagggcacctacaagtgggtgaacccccacaagctgtag

SEQ ID NO: 10840 - DNA, 1686 bp, Artificial Sequence
  Description of Artificial Sequence: Synthetic coding sequence
atggccgagcaggtggccctgagcagaacccaggtgtgcggcatcctgagagaggagctgttccagggcgacgccttccaccagagcgacacccacatcttcatcatcatgggcgccagcggcgacctggccaagaagaagatctaccccaccatctggtggctgttcagagacggcctgctgcccgagaacaccttcatcgtgggctacgccagaagcagactgaccgtggccgacatcagaaagcagagcgagcccttcttcaaggccacccccgaggagaagctgaagctggaggacttcttcgccagaaacagctacgtggccggccagtacgacgacgccgccagctaccagagactgaacagccacatgaacgccctgcacctgggcagccaggccaacagactgttctacctggccctgccccccaccgtgtacgaggccgtgaccaagaacatccacgagagctgcatgagccagatcggctggaacagaatcatcgtggagaagcccttcggcagagacctgcagagcagcgacagactgagcaaccacatcagcagcctgttcagagaggaccagatctacagaatcgaccactacctgggcaaggagatggtgcagaacctgatggtgctgagattcgccaacagaatcttcggccccatctggaacagagacaacatcgcctgcgtgatcctgaccttcaaggagcccttcggcaccgagggcagaggcggctacttcgacgagttcggcatcatcagaggccccggcagacagggcggcagcggcagcgagagctgcagcctgagcctgggcagcctggtgtggggcccccacgccctggagcccggcgagcagggcggcgagctgagaagagccctggccagcagcgtgcccagagacgtgatgcagaaccacctgctgcagatgctgtgcctggtggccatggagaagcccgccagcaccaacagcgacgacgtgagagacgagaaggtgaaggtgctgaagtgcatcagcgaggtgcaggccaacaacgtggtgctgggccagtacgtgggcaaccccgacggcgagggcgaggccaccaagggctacctggacgaccccaccgtgcccagaggcagcaccaccgccaccttcgccgccgtggtgctgtacgtggagaacgagagatgggacggcgtgcccttcatcctgagatgcggcaaggccctgaacgagagaaaggccgaggtgagactgcagttccacgacgtggccggcgacatcttccaccagcagtgcaagagaaacgagctggtgatcagagtgcagcccaacgaggccgtgtacaccaagatgatgaccaagaagcccggcatgttcttcaaccccgaggagagcgagctggacctgacctacggcaacagatacaagaacgtgaagctgcccgacgcctacgagagactgatcctggacgtgttctgcggcagccagatgcacttcgtgagaagcgacgagctgagagaggcctggagaatcttcacccccctgctgcaccagatcgagctggagaagcccaagcccatcccctacatctacggcagcagaggccccaccgaggccgacgagctgatgaagagagtgggcttccagtacgagggcacctacaagtgggtgaacccccacaagctgtag

SEQ ID NO: 10841 - DNA, 1638 bp, Artificial Sequence
  Description of Artificial Sequence: Synthetic coding sequence
atgggcagaagaggcagcgcccccggcaacggcagaaccctgagaggctgcgagagaggcggcagaagaagaagaagcgccgacagcgtgatggccgagcaggtggccctgagcagaacccaggtgtgcggcatcctgagagaggagctgttccagggcgacgccttccaccagagcgacacccacatcttcatcatcatgggcgccagcggcgacctggccaagaagaagatctaccccaccatctggtggctgttcagagacggcctgctgcccgagaacaccttcatcgtgggctacgccagaagcagactgaccgtggccgacatcagaaagcagagcgagcccttcttcaaggccacccccgaggagaagctgaagctggaggacttcttcgccagaaacagctacgtggccggccagtacgacgacgccgccagctaccagagactgaacagccacatgaacgccctgcacctgggcagccaggccaacagactgttctacctggccctgccccccaccgtgtacgaggccgtgaccaagaacatccacgagagctgcatgagccagatcggctggaacagaatcatcgtggagaagcccttcggcagagacctgcagagcagcgacagactgagcaaccacatcagcagcctgttcagagaggaccagatctacagaatcgaccactacctgggcaaggagatggtgcagaacctgatggtgctgagattcgccaacagaatcttcggccccatctggaacagagacaacatcgcctgcgtgatcctgaccttcaaggagcccttcggcaccgagggcagaggcggctacttcgacgagttcggcatcatcagagacgtgatgcagaaccacctgctgcagatgctgtgcctggtggccatggagaagcccgccagcaccaacagcgacgacgtgagagacgagaaggtgaaggtgctgaagtgcatcagcgaggtgcaggccaacaacgtggtgctgggccagtacgtgggcaaccccgacggcgagggcgaggccaccaagggctacctggacgaccccaccgtgcccagaggcagcaccaccgccaccttcgccgccgtggtgctgtacgtggagaacgagagatgggacggcgtgcccttcatcctgagatgcggcaaggccctgaacgagagaaaggccgaggtgagactgcagttccacgacgtggccggcgacatcttccaccagcagtgcaagagaaacgagctggtgatcagagtgcagcccaacgaggccgtgtacaccaagatgatgaccaagaagcccggcatgttcttcaaccccgaggagagcgagctggacctgacctacggcaacagatacaagaacgtgaagctgcccgacgcctacgagagactgatcctggacgtgttctgcggcagccagatgcacttcgtgagaagcgacgagctgagagaggcctggagaatcttcacccccctgctgcaccagatcgagctggagaagcccaagcccatcccctacatctacggcagcagaggccccaccgaggccgacgagctgatgaagagagtgggcttccagtacgagggcacctacaagtgggtgaacccccacaagctgtag

SEQ ID NO: 10842 - DNA, 1548 bp, Artificial Sequence; identical to SEQ ID NO: 10839
  Description of Artificial Sequence: Synthetic coding sequence

SEQ ID NO: 10843 - DNA, 771 bp, Artificial Sequence
  Description of Artificial Sequence: Synthetic coding sequence
atggccgagcaggtggccctgagcagaacccaggtgtgcggcatcctgagagaggagctgttccagggcgacgccttccaccagagcgacacccacatcttcatcatcatgggcgccagcggcgacctggccaagaagaagatctaccccaccatctggtggctgttcagagacggcctgctgcccgagaacaccttcatcgtgggctacgccagaagcagactgaccgtggccgacatcagaaagcagagcgagcccttcttcaaggccacccccgaggagaagctgaagctggaggacttcttcgccagaaacagctacgtggccggccagtacgacgacgccgccagctaccagagactgaacagccacatgaacgccctgcacctgggcagccaggccaacagactgttctacctggccctgccccccaccgtgtacgaggccgtgaccaagaacatccacgagagctgcatgagccagatcggctggaacagaatcatcgtggagaagcccttcggcagagacctgcagagcagcgacagactgagcaaccacatcagcagcctgttcagagaggaccagatctacagaatcgaccactacctgggcaaggagatggtgcagaacctgatggtgctgagattcgccaacagaatcttcggccccatctggaacagagacaacatcgcctgcgtgatcctgaccttcaaggagcccttcggcaccgagggcagaggcggctacttcgacgagttcggcatcatctag

SEQ ID NO: 10844 - DNA, 681 bp, Artificial Sequence
  Description of Artificial Sequence: Synthetic coding sequence
  Description of Combined DNA/RNA Molecule: Synthetic coding sequence
atggccagactgctgcaggccagctgcctgctgagcctgctgctggccggcttcgtgagccagagcagaggccaggagaagagcaagatggactgccacggcggcatcagcggcaccatctacgagtacggcgccctgaccatcgacggcgaggagtacatccccttcaagcagtacgccggcaagtacgtgctgttcgtgaacgtggccagctacugaggcctgaccggccagtacatcgagctgaacgccctgcaggaggagctggcccccttcggcctggtgatcctgggcttcccctgcaaccagttcggcaagcaggagcccggcgagaacagcgagatcctgcccaccctgaagtacgtgagacccggcggcggcttcgtgcccaacttccagctgttcgagaagggcgacgtgaacggcgagaaggagcagaagttctacaccttcctgaagaacagctgcccccccaccagcgagctgctgggcaccagcgacagactgttctgggagcccatgaaggtgcacgacatcagatggaacttcgagaagttcctggtgggccccgacggcatccccatcatgagatggcaccacagaaccaccgtgagcaacgtgaagatggacatcctgagctacatgagaagacaggccgccctgggcgtgaagagaaagtag

SEQ ID NO: 10845 - DNA, 219 bp, Artificial Sequence
  Description of Artificial Sequence: Synthetic coding sequence
atggccagactgctgcaggccagctgcctgctgagcctgctgctggccggcttcgtgagccagagcagaggccaggagaagagcaagatggactgccacggcggcatcagcggcaccatctacgagtacggcgccctgaccatcgacggcgaggagtacatccccttcaagcagtacgccggcaagtacgtgctgttcgtgaacgtggccagctactag

SEQ ID NO: 10846 - DNA, 633 bp, Artificial Sequence
  Description of Artificial Sequence: Synthetic coding sequence
atgcccccctacaccgtggtgtacttccccgtgagaggcagatgcgccgccctgagaatgctgctggccgaccagggccagagctggaaggaggaggtggtgaccgtggagacctggcaggagggcagcctgaaggccagctgcctgtacggccagctgcccaagttccaggacggcgacctgaccctgtaccagagcaacaccatcctgagacacctgggcagaaccctgggcctgtacggcaaggaccagcaggaggccgccctggtggacatggtgaacgacggcgtggaggacctgagatgcaagtacatcagcctgatctacaccaactacgaggccggcaaggacgactacgtgaaggccctgcccggccagctgaagcccttcgagaccctgctgagccagaaccagggcggcaagaccttcatcgtgggcgaccagatcagcttcgccgactacaacctgctggacctgctgctgatccacgaggtgctggcccccggctgcctggacgccttccccctgctgagcgcctacgtgggcagactgagcgccagacccaagctgaaggccttcctggccagccccgagtacgtgaacctgcccatcaacggcaacggcaagcagtag

SEQ ID NO: 10847 - DNA, 2184 bp, Artificial Sequence
  Description of Artificial Sequence: Synthetic coding sequence
atggccttccagaaggccgtgaagggcaccatcctggtgggcggcggcgccctggccaccgtgctgggcctgagccagttcgcccactacagaagaaagcagatgaacctggcctacgtgaaggccgccgactgcatcagcgagcccgtgaacagagagccccccagcagagaggcccagctgctgaccctgcagaacaccagcgagttcgacatcctggtgatcggcggcggcgccaccggcagcggctgcgccctggacgccgtgaccagaggcctgaagaccgccctggtggagagagacgacttcagcagcggcaccagcagcagaagcaccaagctgatccacggcggcgtgagatacctgcagaaggccatcatgaagctggacatcgagcagtacagaatggtgaaggaggccctgcacgagagagccaacctgctggagatcgccccccacctgagcgcccccctgcccatcatgctgcccgtgtacaagtggtggcagctgccctactactgggtgggcatcaagctgtacgacctggtggccggcagcaactgcctgaagagcagctacgtgctgagcaagagcagagccctggagcacttccccatgctgcagaaggacaagctggtgggcgccatcgtgtactacgacggccagcacaacgacgccagaatgaacctggccatcgccctgaccgccgccagatacggcgccgccaccgccaactacatggaggtggtgagcctgctgaagaagaccgacccccagaccggcaaggtgagagtgagcggcgccagatgcaaggacgtgctgaccggccaggagttcgacgtgagagccaagtgcgtgatcaacgccaccggccccttcaccgacagcgtgagaaagatggacgacaaggacgccgccgccatctgccagcccagcgccggcgtgcacatcgtgatgcccggctactacagccccgagagcatgggcctgctggaccccgccaccagcgacggcagagtgatcttcttcctgccctggcagaagatgaccatcgccggcaccaccgacacccccaccgacgtgacccaccaccccatccccagcgaggaggacatcaacttcatcctgaacgaggtgagaaactacctgagctgcgacgtggaggtgagaagaggcgacgtgctggccgcctggagcggcatcagacccctggtgaccgaccccaagagcgccgacacccagagcatcagcagaaaccacgtggtggacatcagcgagagcggcctgatcaccatcgccggcggcaagtggaccacctacagaagcatggccgaggacaccatcaacgccgccgtgaagacccacaacctgaaggccggccccagcagaaccgtgggcctgttcctgcagggcggcaaggactggagccccaccctgtacatcagactggtgcaggactacggcctggagagcgaggtggcccagcacctggccgccacctacggcgacaaggccttcgaggtggccaagatggccagcgtgaccggcaagagatggcccatcgtgggcgtgagactggtgagcgagttcccctacatcgaggccgaggtgaagtacggcatcaaggagtacgcctgcaccgccgtggacatgatcagcagaagaaccagactggccttcctgaacgtgcaggccgccgaggaggccctgcccagaatcgtggagctgatgggcagagagctgaactgggacgactacaagaagcaggagcagctggagaccgccagaaagttcctgtactacgagatgggctacaagagcagaagcgagcagctgaccgacagaagcgagatcagcctgctgcccagcgacatcgacagatacaagaagagattccacaagttcgacgccgaccagaagggcttcatcaccatcgtggacgtgcagagagtgctggagagcatcaacgtgcagatggacgagaacaccctgcacgagatcctgaacgaggtggacctgaacaagaacggccaggtggagctgaacgagttcctgcagctgatgagcgccatccagaagggcagagtgagcggcagcagactggccatcctgatgaagaccgccgaggagaacctggacagaagagtgcccatccccgtggacagaagctgcggcggcctgtag

SEQ ID NO: 10848 - DNA, 1503 bp, Artificial Sequence
  Description of Artificial Sequence: Synthetic coding sequence
atgaacctggccatcgccctgaccgccgccagatacggcgccgccaccgccaactacatggaggtggtgagcctgctgaagaagaccgacccccagaccggcaaggtgagagtgagcggcgccagatgcaaggacgtgctgaccggccaggagttcgacgtgagagccaagtgcgtgatcaacgccaccggccccttcaccgacagcgtgagaaagatggacgacaaggacgccgccgccatctgccagcccagcgccggcgtgcacatcgtgatgcccggctactacagccccgagagcatgggcctgctggaccccgccaccagcgacggcagagtgatcttcttcctgccctggcagaagatgaccatcgccggcaccaccgacacccccaccgacgtgacccaccaccccatccccagcgaggaggacatcaacttcatcctgaacgaggtgagaaactacctgagctgcgacgtggaggtgagaagaggcgacgtgctggccgcctggagcggcatcagacccctggtgaccgaccccaagagcgccgacacccagagcatcagcagaaaccacgtggtggacatcagcgagagcggcctgatcaccatcgccggcggcaagtggaccacctacagaagcatggccgaggacaccatcaacgccgccgtgaagacccacaacctgaaggccggccccagcagaaccgtgggcctgttcctgcagggcggcaaggactggagccccaccctgtacatcagactggtgcaggactacggcctggagagcgaggtggcccagcacctggccgccacctacggcgacaaggccttcgaggtggccaagatggccagcgtgaccggcaagagatggcccatcgtgggcgtgagactggtgagcgagttcccctacatcgaggccgaggtgaagtacggcatcaaggagtacgcctgcaccgccgtggacatgatcagcagaagaaccagactggccttcctgaacgtgcaggccgccgaggaggccctgcccagaatcgtggagctgatgggcagagagctgaactgggacgactacaagaagcaggagcagctggagaccgccagaaagttcctgtactacgagatgggctacaagagcagaagcgagcagctgaccgacagaagcgagatcagcctgctgcccagcgacatcgacagatacaagaagagattccacaagttcgacgccgaccagaagggcttcatcaccatcgtggacgtgcagagagtgctggagagcatcaacgtgcagatggacgagaacaccctgcacgagatcctgaacgaggtggacctgaacaagaacggccaggtggagctgaacgagttcctgcagctgatgagcgccatccagaagggcagagtgagcggcagcagactggccatcctgatgaagaccgccgaggagaacctggacagaagagtgcccatccccgtggacagaagctgcggcggcctgtag

SEQ ID NO: 10849 - DNA, 2184 bp, Artificial Sequence; identical to SEQ ID NO: 10847
  Description of Artificial Sequence: Synthetic coding sequence

SEQ ID NO: 10850 - DNA, 2184 bp, Artificial Sequence; identical to SEQ ID NO: 10847
  Description of Artificial Sequence: Synthetic coding sequence

SEQ ID NO: 10851 - DNA, 330 bp, Artificial Sequence
  Description of Artificial Sequence: Synthetic coding sequence
atggccttccagaaggccgtgaagggcaccatcctggtgggcggcggcgccctggccaccgtgctgggcctgagccagttcgcccactacagaagaaagcagatgaacctggcctacgtgaaggccgccgactgcatcagcgagcccgtgaacagagagccccccagcagagaggcccagctgctgaccctgcagaacaccagcgagttcgacatcctggtgatcggcggcggcgccaccggcagcggctgcgccctggacgccgtgaccagaggcctgaagaccgccctggtggagagagacgacttcagcagcggcaccagcagctag

SEQ ID NO: 10852 - DNA, 2184 bp, Artificial Sequence; identical to SEQ ID NO: 10847
  Description of Artificial Sequence: Synthetic coding sequence

SEQ ID NO: 10853 - DNA, 1140 bp, Artificial Sequence
  Description of Artificial Sequence: Synthetic coding sequence
atggccttccagaaggccgtgaagggcaccatcctggtgggcggcggcgccctggccaccgtgctgggcctgagccagttcgcccactacagaagaaagcagatgaacctggcctacgtgaaggccgccgactgcatcagcgagcccgtgaacagagagccccccagcagagaggcccagctgctgaccctgcagaacaccagcgagttcgacatcctggtgatcggcggcggcgccaccggcagcggctgcgccctggacgccgtgaccagaggcctgaagaccgccctggtggagagagacgacttcagcagcggcaccagcagcagaagcaccaagctgatccacggcggcgtgagatacctgcagaaggccatcatgaagctggacatcgagcagtacagaatggtgaaggaggccctgcacgagagagccaacctgctggagatcgccccccacctgagcgcccccctgcccatcatgctgcccgtgtacaagtggtggcagctgccctactactgggtgggcatcaagctgtacgacctggtggccggcagcaactgcctgaagagcagctacgtgctgagcaagagcagagccctggagcacttccccatgctgcagaaggacaagctggtgggcgccatcgtgtactacgacggccagcacaacgacgccagaatgaacctggccatcgccctgaccgccgccagatacggcgccgccaccgccaactacatggaggtggtgagcctgctgaagaagaccgacccccagaccggcaaggtgagagtgagcggcgccagatgcaaggacgtgctgaccggccaggagttcgacgtgagagccaagtgcgtgatcaacgccaccggccccttcaccgacagcgtgagaaagatggacgacaaggacgccgccgccatctgccagcccagcgccggcgtgcacatcgtgatgcccggctactacagccccgagagcatgggcctgctggaccccgccaccagcgacggcagagtgatcttcttcctgccctggcagaagatgaccatcgccggcaccaccgacacccccaccgacgtgacccaccaccccatccccagcgaggaggacatcaacttcatcctgaacgaggtgtag

SEQ ID NO: 10854 - DNA, 1263 bp, Artificial Sequence
  Description of Artificial Sequence: Synthetic coding sequence
atgagcggcagacccagaaccaccagcttcgccgagagctgcaagcccgtgcagcagcccagcgccttcggcagcatgaaggtgagcagagacaaggacggcagcaaggtgaccaccgtggtggccacccccggccagggccccgacagaccccaggaggtgagctacaccgacaccaaggtgatcggcaacggcagcttcggcgtggtgtaccaggccaagctgtgcgacagcggcgagctggtggccatcaagaaggtgctgcaggacaagagattcaagaacagagagctgcagatcatgagaaagctggaccactgcaacatcgtgagactgagatacttcttctacagcagcggcgagaagaaggacgaggtgtacctgaacctggtgctggactacgtgcccgagaccgtgtacagagtggccagacactacagcagagccaagcagaccctgcccgtgatctacgtgaagctgtacatgtaccagctgttcagaagcctggcctacatccacagcttcggcatctgccacagagacatcaagccccagaacctgctgctggaccccgacaccgccgtgctgaagctgtgcgacttcggcagcgccaagcagctggtgagaggcgagcccaacgtgagctacatctgcagcagatactacagagcccccgagctgatcttcggcgccaccgactacaccagcagcatcgacgtgtggagcgccggctgcgtgctggccgagctgctgctgggccagcccatcttccccggcgacagcggcgtggaccagctggtggagatcatcaaggtgctgggcacccccaccagagagcagatcagagagatgaaccccaactacaccgagttcaagttcccccagatcaaggcccacccctggaccaaggtgttcagacccagaaccccccccgaggccatcgccctgtgcagcagactgctggagtacacccccaccgccagactgacccccctggaggcctgcgcccacagcttcttcgacgagctgagagaccccaacgtgaagctgcccaacggcagagacacccccgccctgttcaacttcaccacccaggagctgagcagcaacccccccctggccaccatcctgatccccccccacgccagaatccaggccgccgccagcacccccaccaacgccaccgccgccagcgacgccaacaccggcgacagaggccagaccaacaacgccgccagcgccagcgccagcaacagcacctag

SEQ ID NO: 10855 - DNA, 1302 bp, Artificial Sequence
  Description of Artificial Sequence: Synthetic coding sequence
atgagcggcagacccagaaccaccagcttcgccgagagctgcaagcccgtgcagcagcccagcgccttcggcagcatgaaggtgagcagagacaaggacggcagcaaggtgaccaccgtggtggccacccccggccagggccccgacagaccccaggaggtgagctacaccgacaccaaggtgatcggcaacggcagcttcggcgtggtgtaccaggccaagctgtgcgacagcggcgagctggtggccatcaagaaggtgctgcaggacaagagattcaagaacagagagctgcagatcatgagaaagctggaccactgcaacatcgtgagactgagatacttcttctacagcagcggcgagaagaaggacgaggtgtacctgaacctggtgctggactacgtgcccgagaccgtgtacagagtggccagacactacagcagagccaagcagaccctgcccgtgatctacgtgaagctgtacatgtaccagctgttcagaagcctggcctacatccacagcttcggcatctgccacagagacatcaagccccagaacctgctgctggaccccgacaccgccgtgctgaagctgtgcgacttcggcagcgccaagcagctggtgagaggcgagcccaacgtgagctacatctgcagcagatactacagagcccccgagctgatcttcggcgccaccgactacaccagcagcatcgacgtgtggagcgccggctgcgtgctggccgagctgctgctgggccagcccatcttccccggcgacagcggcgtggaccagctggtggagatcatcaaggtgctgggcacccccaccagagagcagatcagagagatgaaccccaactacaccgagttcaagttcccccagatcaaggcccacccctggaccaaggacagcagcggcaccggccacttcaccagcggcgtgagagtgttcagacccagaaccccccccgaggccatcgccctgtgcagcagactgctggagtacacccccaccgccagactgacccccctggaggcctgcgcccacagcttcttcgacgagctgagagaccccaacgtgaagctgcccaacggcagagacacccccgccctgttcaacttcaccacccaggagctgagcagcaacccccccctggccaccatcctgatccccccccacgccagaatccaggccgccgccagcacccccaccaacgccaccgccgccagcgacgccaacaccggcgacagaggccagaccaacaacgccgccagcgccagcgccagcaacagcacctag

SEQ ID NO: 10856 - DNA, 315 bp, Artificial Sequence
  Description of Artificial Sequence: Synthetic coding sequence
atgaaccccaactacaccgagttcaagttcccccagatcaaggcccacccctggaccaaggtgttcagacccagaaccccccccgaggccatcgccctgtgcagcagactgctggagtacacccccaccgccagactgacccccctggaggcctgcgcccacagcttcttcgacgagctgagagaccccaacgtgaagctgcccaacggcagagacacccccgccctgttcaacttcaccacccaggacgccaacaccggcgacagaggccagaccaacaacgccgccagcgccagcgccagcaacagcacctag

SEQ ID NO: 10857 - DNA, 837 bp, Artificial Sequence
  Description of Artificial Sequence: Synthetic coding sequence
atggaggagaacatggaggagggccagacccagaagggctgcttcgagtgctgcatcaagtgcctgggcggcatcccctacgccagcctgatcgccaccatcctgctgtacgccggcgtggccctgttctgcggctgcggccacgaggccctgagcggcaccgtgaacatcctgcagacctacttcgagatggccagaaccgccggcgacaccctggacgtgttcaccatgatcgacatcttcaagtacgtgatctacggcatcgccgccgccttcttcgtgtacggcatcctgctgatggtggagggcttcttcaccaccggcgccatcaaggacctgtacggcgacttcaagatcaccacctgcggcagatgcgtgagcgcctggttcatcatgctgacctacctgttcatgctggcctggctgggcgtgaccgccttcaccagcctgcccgtgtacatgtacttcaacctgtggaccatctgcagaaacaccaccctggtggagggcgccaacctgtgcctggacctgagacagttcggcatcgtgaccatcggcgaggagaagaagatctgcaccgtgagcgagaacttcctgagaatgtgcgagagcaccgagctgaacatgaccttccacctgttcatcgtggccctggccggcgccggcgccgccgtgatcgccatggtgcactacctgatggtgctgagcgccaactgggcctacgtgaaggacgcctgcagaatgcagaagtacgaggacatcaagagcaaggaggagcaggagctgcacgacatccacagcaccagaagcaaggagagactgaacgcctacacctag

SEQ ID NO: 10858 - DNA, 837 bp, Artificial Sequence; identical to SEQ ID NO: 10857
  Description of Artificial Sequence: Synthetic coding sequence

SEQ ID NO: 10859 - DNA, 33 bp, Artificial Sequence
  Description of Artificial Sequence: Synthetic coding sequence
atggaggagaacatggaggagggccagacctag

SEQ ID NO: 10860 - DNA, 804 bp, Artificial Sequence
  Description of Artificial Sequence: Synthetic coding sequence
atgggctgcttcgagtgctgcatcaagtgcctgggcggcatcccctacgccagcctgatcgccaccatcctgctgtacgccggcgtggccctgttctgcggctgcggccacgaggccctgagcggcaccgtgaacatcctgcagacctacttcgagatggccagaaccgccggcgacaccctggacgtgttcaccatgatcgacatcttcaagtacgtgatctacggcatcgccgccgccttcttcgtgtacggcatcctgctgatggtggagggcttcttcaccaccggcgccatcaaggacctgtacggcgacttcaagatcaccacctgcggcagatgcgtgagcgcctggttcatcatgctgacctacctgttcatgctggcctggctgggcgtgaccgccttcaccagcctgcccgtgtacatgtacttcaacctgtggaccatctgcagaaacaccaccctggtggagggcgccaacctgtgcctggacctgagacagttcggcatcgtgaccatcggcgaggagaagaagatctgcaccgtgagcgagaacttcctgagaatgtgcgagagcaccgagctgaacatgaccttccacctgttcatcgtggccctggccggcgccggcgccgccgtgatcgccatggtgcactacctgatggtgctgagcgccaactgggcctacgtgaaggacgcctgcagaatgcagaagtacgaggacatcaagagcaaggaggagcaggagctgcacgacatccacagcaccagaagcaaggagagactgaacgcctacacctag

SEQ ID NO: 10861 - DNA, 390 bp, Artificial Sequence
  Description of Artificial Sequence: Synthetic coding sequence
atggaggagaacatggaggagggccagacccagaagggctgcttcgagtgctgcatcaagtgcctgggcggcatcccctacgccagcctgatcgccaccatcctgctgtacgccggcgtggccctgttctgcggctgcggccacgaggccctgagcggcaccgtgaacatcctgcagacctacttcgagatggccagaaccgccggcgacaccctggacgtgttcaccatgatcgacatcttcaagtacgtgatctacggcatcgccgccgccttcttcgtgtacggcatcctgctgatggtggagggcttcttcaccaccggcgccatcaaggacctgtacggcgacttcaagatcaccacctgcggcagatgcgtgagcgcctggtag

SEQ ID NO: 10862 - DNA, 816 bp, Artificial Sequence
  Description of Artificial Sequence: Synthetic coding sequence
atgaccgacctggagggctgcttcgagtgctgcatcaagtgcctgggcggcatcccctacgccagcctgatcgccaccatcctgctgtacgccggcgtggccctgttctgcggctgcggccacgaggccctgagcggcaccgtgaacatcctgcagacctacttcgagatggccagaaccgccggcgacaccctggacgtgttcaccatgatcgacatcttcaagtacgtgatctacggcatcgccgccgccttcttcgtgtacggcatcctgctgatggtggagggcttcttcaccaccggcgccatcaaggacctgtacggcgacttcaagatcaccacctgcggcagatgcgtgagcgcctggttcatcatgctgacctacctgttcatgctggcctggctgggcgtgaccgccttcaccagcctgcccgtgtacatgtacttcaacctgtggaccatctgcagaaacaccaccctggtggagggcgccaacctgtgcctggacctgagacagttcggcatcgtgaccatcggcgaggagaagaagatctgcaccgtgagcgagaacttcctgagaatgtgcgagagcaccgagctgaacatgaccttccacctgttcatcgtggccctggccggcgccggcgccgccgtgatcgccatggtgcactacctgatggtgctgagcgccaactgggcctacgtgaaggacgcctgcagaatgcagaagtacgaggacatcaagagcaaggaggagcaggagctgcacgacatccacagcaccagaagcaaggagagactgaacgcctacacctag

SEQ ID NO: 10863 - DNA, 1206 bp, Artificial Sequence
  Description of Artificial Sequence: Synthetic coding sequence
atgatgggcctgggcaacggcagaagaagcatgaagagcccccccctggtgctggccgccctggtggcctgcatcatcgtgctgggcttcaactactggatcgccagcagcagaagcgtggacctgcagaccagaatcatggagctggagggcagagtgagaagagccgccgccgagagaggcgccgtggagctgaagaagaacgagttccagggcgagctggagaagcagagagagcagctggacaagatccagagcagccacaacttccagctggagagcgtgaacaagctgtaccaggacgagaaggccgtgctggtgaacaacatcaccaccggcgagagactgatcagagtgctgcaggaccagctgaagaccctgcagagaaactacggcagactgcagcaggacgtgctgcagttccagaagaaccagaccaacctggagagaaagttcagctacgacctgagccagtgcatcaaccagatgaaggaggtgaaggagcagtgcgaggagagaatcgaggaggtgaccaagaagggcaacgaggccgtggccagcagagacctgagcgagaacaacgaccagagacagcagctgcaggccctgagcgagccccagcccagactgcaggccgccggcctgccccacaccgaggtgccccagggcaagggcaacgtgctgggcaacagcaagagccagacccccgcccccagcagcgaggtggtgctggacagcaagagacaggtggagaaggaggagaccaacgagatccaggtggtgaacgaggagccccagagagacagactgccccaggagcccggcagagagcaggtggtggaggacagacccgtgggcggcagaggcttcggcggcgccggcgagctgggccagaccccccaggtgcaggccgccctgagcgtgagccaggagaaccccgagatggagggccccgagagagaccagctggtgatccccgacggccaggaggaggagcaggaggccgccggcgagggcagaaaccagcagaagctgagaggcgaggacgactacaacatggacgagaacgaggccgagagcgagaccgacaagcaggccgccctggccggcaacgacagaaacatcgacgtgttcaacgtggaggaccagaagagagacaccatcaacctgctggaccagagagagaagagaaaccacaccctgtag

SEQ ID NO: 10864 - DNA, 1206 bp, Artificial Sequence; identical to SEQ ID NO: 10863
  Description of Artificial Sequence: Synthetic coding sequence

SEQ ID NO: 10865 - DNA, 243 bp, Artificial Sequence
  Description of Artificial Sequence: Synthetic coding sequence
atgatgggcctgggcaacggcagaagaagcatgaagagcccccccctggtgctggccgccctggtggcctgcatcatcgtgctgggcttcaactactggatcgccagcagcagaagcgtggacctgcagaccagaatcatggagctggagggcagagtgagaagagccgccgccgagagaggcgccgtggagctgaagaagaacgagttccagggcgagctggagaagcagagagagcagtag

SEQ ID NO: 10866 - DNA, 366 bp, Artificial Sequence
  Description of Artificial Sequence: Synthetic coding sequence
atgatgggcctgggcaacggcagaagaagcatgaagagcccccccctggtgctggccgccctggtggcctgcatcatcgtgctgggcttcaactactggatcgccagcagcagaagcgtggacctgcagaccagaatcatggagctggagggcagagtgagaagagccgccgccgagagaggcgccgtggagctgaagaagaacgagttccagggcgagctggagaagcagagagagcagctggacaagatccagagcagccacaacttccagctggagagcgtgaacaagctgtaccaggacgagaaggccgtgctggtgaacaacatcaccaccggcgagagactgatcagagtgctgcagtag

SEQ ID NO: 10867 - DNA, 279 bp, Artificial Sequence
  Description of Artificial Sequence: Synthetic coding sequence
atgaagcccatccagaagctgctggccggcctgatcctgctgacctggtgcgtggagggctgcagcagccagcactggagctacggcctgagacccggcggcaagagagacgccgagaacctgatcgacagcttccaggagatcgtgaaggaggtgggccagctggccgagacccagagattcgagtgcaccacccaccagcccagaagccccctgagagacctgaagggcgccctggagagcctgatcgaggaggagaccggccagaagaagatctag

SEQ ID NO: 10868 - DNA, 279 bp, Artificial Sequence; identical to SEQ ID NO: 10867
  Description of Artificial Sequence: Synthetic coding sequence

SEQ ID NO: 10869 - DNA, 774 bp, Artificial Sequence
  Description of Artificial Sequence: Synthetic coding sequence
atgcccgccagcatgttcagcatcgacaacatcctggccgccagacccagatgcaaggacagcgtgctgcccgtggcccacagcgccgccgcccccgtggtgttccccgccctgcacggcgacagcctgtacggcgccagcggcggcgccagcagcgactacggcgccttctaccccagacccgtggcccccggcggcgccggcctgcccgccgccgtgagcggcagcagactgggctacaacaactacttctacggccagctgcacgtgcaggccgcccccgtgggccccgcctgctgcggcgccgtgccccccctgggcgcccagcagtgcagctgcgtgcccaccccccccggctacgagggccccggcagcgtgctggtgagccccgtgccccaccagatgctgccctacatgaacgtgggcaccctgagcagaaccgagctgcagctgctgaaccagctgcactgcagaagaaagagaagacacagaaccatcttcaccgacgagcagctggaggccctggagaacctgttccaggagaccaagtaccccgacgtgggcaccagagagcagctggccagaaaggtgcacctgagagaggagaaggtggaggtgtggttcaagaacagaagagccaagtggagaagacagaagagaagcagcagcgaggagagcgagaacgccgagaagtggaacaagaccagcagcagcaaggccagccccgagaagagagaggaggagggcaagagcgacctggacagcgacagctag

SEQ ID NO: 10870 - DNA, 654 bp, Artificial Sequence
  Description of Artificial Sequence: Synthetic coding sequence
atggcctaccccggctacggcggcggcttcggcaacttcagcatccaggtgcccggcatgcagatgggccagcccgtgcccgagaccggccccgccatcctgctggacggctacagcggccccgcctacagcgacacctacagcagcgccggcgacagcgtgtacacctacttcagcgccgtggccggccaggacggcgaggtggacgccgaggagctgcagagatgcctgacccagagcggcatcaacggcacctacagccccttcagcctggagacctgcagaatcatgatcgccatgctggacagagaccacaccggcaagatgggcttcaacgccttcaaggagctgtgggccgccctgaacgcctggaaggagaacttcatgaccgtggaccaggacggcagcggcaccgtggagcaccacgagctgagacaggccatcggcctgatgggctacagactgagcccccagaccctgaccaccatcgtgaagagatacagcaagaacggcagaatcttcttcgacgactacgtggcctgctgcgtgaagctgagagccctgaccgacttcttcagaaagagagaccacctgcagcagggcagcgccaacttcatctacgacgacttcctgcagggcaccatggccatctag

SEQ ID NO: 10871 - DNA, 438 bp, Artificial Sequence
  Description of Artificial Sequence: Synthetic coding sequence
atggccacctgggccctgctgctgctggccgccatgctgctgggcaaccccggcctggtgttcagcagactgagccccgagtactacgacctggccagagcccacctgagagacgaggagaagagctgcccctgcctggcccaggagggcccccagggcgacctgctgaccaagacccaggagctgggcagagactacagaacctgcctgaccatcgtgcagaagctgaagaagatggtggacaagcccacccagagaagcgtgagcaacgccgccaccagagtgtgcagaaccggcagaagcagatggagagacgtgtgcagaaacttcatgagaagataccagagcagagtgacccagggcctggtggccggcgagaccgcccagcagatctgcgaggacctgagactgtgcatccccagcaccggccccctgtag

SEQ ID NO: 10872 - DNA, 393 bp, Artificial Sequence
  Description of Artificial Sequence: Synthetic coding sequence
atggagggcctggtgttcagcagactgagccccgagtactacgacctggccagagcccacctgagagacgaggagaagagctgcccctgcctggcccaggagggcccccagggcgacctgctgaccaagacccaggagctgggcagagactacagaacctgcctgaccatcgtgcagaagctgaagaagatggtggacaagcccacccagagaagcgtgagcaacgccgccaccagagtgtgcagaaccggcagaagcagatggagagacgtgtgcagaaacttcatgagaagataccagagcagagtgacccagggcctggtggccggcgagaccgcccagcagatctgcgaggacctgagactgtgcatccccagcaccggccccctgtag

SEQ ID NO: 10873 - DNA, 555 bp, Artificial Sequence
  Description of Artificial Sequence: Synthetic coding sequence
atgagcagaaccgcctacaccgtgggcgccctgctgctgctgctgggcaccctgctgcccgccgccgagggcaagaagaagggcagccagggcgccatccccccccccgacaaggcccagcacaacgacagcgagcagacccagagcccccagcagcccggcagcagaaacagaggcagaggccagggcagaggcaccgccatgcccggcgaggaggtgctggagagcagccaggaggccctgcacgtgaccgagagaaagtacctgaagagagactggtgcaagacccagcccctgaagcagaccatccacgaggagggctgcaacagcagaaccatcatcaacagattctgctacggccagtgcaacagcttctacatccccagacacatcagaaaggaggagggcagcttccagagctgcagcttctgcaagcccaagaagttcaccaccatgatggtgaccctgaactgccccgagctgcagccccccaccaagaagaagagagtgaccagagtgaagcagtgcagatgcatcagcatcgacctggactag

SEQ ID NO: 10874 - DNA, 432 bp, Artificial Sequence
  Description of Artificial Sequence: Synthetic coding sequence
atgagcagaaccgcctacaccgtgggcgccctgctgctgctgctgggcaccctgctgcccgccgccgagggcaagaagaagggcagccagggcgccatccccccccccgacaaggccctgcacgtgaccgagagaaagtacctgaagagagactggtgcaagacccagcccctgaagcagaccatccacgaggagggctgcaacagcagaaccatcatcaacagattctgctacggccagtgcaacagcttctacatccccagacacatcagaaaggaggagggcagcttccagagctgcagcttctgcaagcccaagaagttcaccaccatgatggtgaccctgaactgccccgagctgcagccccccaccaagaagaagagagtgaccagagtgaagcagtgcagatgcatcagcatcgacctggactag

SEQ ID NO: 10875 - DNA, 432 bp, Artificial Sequence; identical to SEQ ID NO: 10874
  Description of Artificial Sequence: Synthetic coding sequence

SEQ ID NO: 10876 - DNA, 396 bp, Artificial Sequence
  Description of Artificial Sequence: Synthetic coding sequence
atgaccctggaggagttcagcgccggcgagcagaagaccgagagcgaccccgacaacgtggtgctgtgcctgctggccgccgacgaggacgacgacagagacgtggccctgcagatccacttcaccctgatccaggccttctgctgcgagaacgacatcaacatcctgagagtgagcaaccccggcagactggccgagctgctgctgctggagaccgacgccggccccgccgccagcgagggcgccgagcagccccccgacctgcactgcgtgctggtgaccaacccccacagcagccagtggaaggaccccgccctgagccagctgatctgcttctgcagagagagcagatacatggaccagtgggtgcccgtgatcaacctgcccgagagatag

SEQ ID NO: 10877 - DNA, 498 bp, Artificial Sequence
  Description of Artificial Sequence: Synthetic coding sequence
atgaccctggaggagttcagcgccggcgagcagaagaccgagagaatggacaaggtgggcgacgccctggaggaggtgctgagcaaggccctgagccagagaaccatcaccgtgggcgtgtacgaggccgccaagctgctgaacgtggaccccgacaacgtggtgctgtgcctgctggccgccgacgaggacgacgacagagacgtggccctgcagatccacttcaccctgatccaggccttctgctgcgagaacgacatcaacatcctgagagtgagcaaccccggcagactggccgagctgctgctgctggagaccgacgccggccccgccgccagcgagggcgccgagcagccccccgacctgcactgcgtgctggtgaccaacccccacagcagccagtggaaggaccccgccctgagccagctgatctgcttctgcagagagagcagatacatggaccagtgggtgcccgtgatcaacctgcccgagagatag

SEQ ID NO: 10878 - DNA, 3693 bp, Artificial Sequence
  Description of Artificial Sequence: Synthetic coding sequence
atgagcgccctgtgctggggcagaggcgccgccggcctgaagagagccctgagaccctgcggcagacccggcctgcccggcaaggagggcaccgccggcggcgtgtgcggccccagaagaagcagcagcgccagcccccaggagcaggaccaggacagaagaaaggactggggccacgtggagctgctggaggtgctgcaggccagagtgagacagctgcaggccgagagcgtgagcgaggtggtggtgaacagagtggacgtggccagactgcccgagtgcggcagcggcgacggcagcctgcagccccccagaaaggtgcagatgggcgccaaggacgccacccccgtgccctgcggcagatgggccaagatcctggagaaggacaagagaacccagcagatgagaatgcagagactgaaggccaagctgcagatgcccttccagagcggcgagttcaaggccctgaccagaagactgcaggtggagcccagactgctgagcaagcagatggccggctgcctggaggactgcaccagacaggcccccgagagcccctgggaggagcagctggccagactgctgcaggaggcccccggcaagctgagcctggacgtggagcaggcccccagcggccagcacagccaggcccagctgagcggccagcagcagagactgctggccttcttcaagtgctgcctgctgaccgaccagctgcccctggcccaccacctgctggtggtgcaccacggccagagacagaagagaaagctgctgaccctggacatgtacaacgccgtgatgctgggctgggccagacagggcgccttcaaggagctggtgtacgtgctgttcatggtgaaggacgccggcctgacccccgacctgctgagctacgccgccgccctgcagtgcatgggcagacaggaccaggacgccggcaccatcgagagatgcctggagcagatgagccaggagggcctgaagctgcaggccctgttcaccgccgtgctgctgagcgaggaggacagagccaccgtgctgaaggccgtgcacaaggtgaagcccaccttcagcctgcccccccagctgcccccccccgtgaacaccagcaagctgctgagagacgtgtacgccaaggacggcagagtgagctaccccaagctgcacctgcccctgaagaccctgcagtgcctgttcgagaagcagctgcacatggagctggccagcagagtgtgcgtggtgagcgtggagaagcccaccctgcccagcaaggaggtgaagcacgccagaaagaccctgaagaccctgagagaccagtgggagaaggccctgtgcagagccctgagagagaccaagaacagactggagagagaggtgtacgagggcagattcagcctgtaccccttcctgtgcctgctggacgagagagaggtggtgagaatgctgctgcaggtgctgcaggccctgcccgcccagggcgagagcttcaccaccctggccagagagctgagcgccagaaccttcagcagacacgtggtgcagagacagagagtgagcggccaggtgcaggccctgcagaaccactacagaaagtacctgtgcctgctggccagcgacgccgaggtgcccgagccctgcctgcccagacagtactgggaggagctgggcgcccccgaggccctgagagagcagccctggcccctgcccgtgcagatggagctgggcaagctgctggccgagatgctggtgcaggccacccagatgccctgcagcctggacaagccccacagaagcagcagactggtgcccgtgctgtaccacgtgtacagcttcagaaacgtgcagcagatcggcatcctgaagccccaccccgcctacgtgcagctgctggagaaggccgccgagcccaccctgaccttcgaggccgtggacgtgcccatgctgtgcccccccctgccctggaccagcccccacagcggcgccttcctgctgagccccaccaagctgatgagaaccgtggagggcgccacccagcaccaggagctgctggagacctgcccccccaccgccctgcacggcgccctggacgccctgacccagctgggcaactgcgcctggagagtgaacggcagagtgctggacctggtgctgcagctgttccaggccaagggctgcccccagctgggcgtgcccgccccccccagcgaggccccccagccccccgaggcccacctgccccacagcgccgcccccgccagaaaggccgagctgagaagagagctggcccactgccagaaggtggccagagagatgcacagcctgagagccgaggccctgtacagactgagcctggcccagcacctgagagacagagtgttctggctgccccacaacatggacttcagaggcagaacctacccctgccccccccacttcaaccacctgggcagcgacgtggccagagccctgctggagttcgcccagggcagacccctgggcccccacggcctggactggctgaagatccacctggtgaacctgaccggcctgaagaagagagagcccctgagaaagagactggccttcgccgaggaggtgatggacgacatcctggacagcgccgaccagcccctgaccggcagaaagtggtggatgggcgccgaggagccctggcagaccctggcctgctgcatggaggtggccaacgccgtgagagccagcgaccccgccgcctacgtgagccacctgcccgtgcaccaggacggcagctgcaacggcctgcagcactacgccgccctgggcagagacagcgtgggcgccgccagcgtgaacctggagcccagcgacgtgccccaggacgtgtacagcggcgtggccgcccaggtggaggtgttcagaagacaggacgcccagagaggcatgagagtggcccaggtgctggagggcttcatcaccagaaaggtggtgaagcagaccgtgatgaccgtggtgtacggcgtgaccagatacggcggcagactgcagatcgagaagagactgagagagctgagcgacttcccccaggagttcgtgtgggaggccagccactacctggtgagacaggtgttcaagagcctgcaggagatgttcagcggcaccagagccatccagcactggctgaccgagagcgccagactgatcagccacatgggcagcgtggtggagtgggtgacccccctgggcgtgcccgtgatccagccctacagactggacagcaaggtgaagcagatcggcggcggcatccagagcatcacctacacccacaacggcgacatcagcagaaagcccaacaccagaaagcagaagaacggcttcccccccaacttcatccacagcctggacagcagccacatgatgctgaccgccctgcactgctacagaaagggcctgaccttcgtgagcgtgcacgactgctactggacccacgccgccgacgtgagcgtgatgaaccaggtgtgcagagagcagttcgtgagactgcacagcgagcccatcctgcaggacctgagcagattcctggtgaagagattctgcagcgagccccagaagatcctggaggccagccagctgaaggagaccctgcaggccgtgcccaagcccggcgccttcgacctggagcaggtgaagagaagcacctacttcttcagctag

SEQ ID NO: 10879 - DNA, 480 bp, Artificial Sequence
  Description of Artificial Sequence: Synthetic coding sequence
atgaccctggaggaggtgagaggccaggacaccgtgcccgagagcaccgccagaatgcagggcgccggcaaggccctgcacgagctgctgctgagcgcccagagacagggctgcctgaccgccggcgtgtacgagagcgccaaggtgctgaacgtggaccccgacaacgtgaccttctgcgtgctggccgccggcgaggaggacgagggcgacatcgccctgcagatccacttcaccctgatccaggccttctgctgcgagaacgacatcgacatcgtgagagtgggcgacgtgcagagactggccgccatcgtgggcgccggcgaggaggccggcgcccccggcgacctgcactgcatcctgatcagcaaccccaacgaggacgcctggaaggaccccgccctggagaagctgagcctgttctgcgaggagagcagaagcgtgaacgactgggtgcccagcatcaccctgcccgagtag

SEQ ID NO: 10880 - DNA, 426 bp, Artificial Sequence
  Description of Artificial Sequence: Synthetic coding sequence
atgcagggcgccggcaaggccctgcacgagctgctgctgagcgcccagagacagggctgcctgaccgccggcgtgtacgagagcgccaaggtgctgaacgtggaccccgacaacgtgaccttctgcgtgctggccgccggcgaggaggacgagggcgacatcgccctgcagatccacttcaccctgatccaggccttctgctgcgagaacgacatcgacatcgtgagagtgggcgacgtgcagagactggccgccatcgtgggcgccggcgaggaggccggcgcccccggcgacctgcactgcatcctgatcagcaaccccaacgaggacgcctggaaggaccccgccctggagaagctgagcctgttctgcgaggagagcagaagcgtgaacgactgggtgcccagcatcaccctgcccgagtag

SEQ ID NO: 10881 - DNA, 2085 bp, Artificial Sequence
  Description of Artificial Sequence: Synthetic coding sequence
atgcagcccgccatccaggtgtggttcggcgaggacctgcccctgagccccagaagccccctgacccccagacacggccccggcctggccaacgtgtgccagtacgacgagtggatcgccgtgagacacgaggccaccctgctgcccatgcaggaggacctgagcatctggctgagcggcctgctgggcatcaaggtgaaggccgagaagctgctggaggagctggacaacggcgtgctgctgtgccagctgatcgacgtgctgcagaacatggtgaagacctgcaacagcgaggagagcggcaacttccccatgagaaaggtgccctgcaagaaggacgccgccagcggcagcttcttcgccagagacaacaccgccaacttcctgcactggtgcagagacatcggcgtggacgagacctacctgttcgagagcgagggcctggtgctgcacaaggaccccagacaggtgtacctgtgcctgctggagatcggcagaatcgtgagcagatacggcgtggagccccccgtgctggtgaagctggagaaggagatcgagctggaggagaccctgctgaacaccagcggccccgaggacagcatcagcatccccaagagctgctgcagacacgaggagctgcacgaggccgtgaagcacatcgccgaggaccccccctgcagctgcagccacagattcagcatcgagtacctgagcgagggcagatacagactgggcgacaagatcctgttcatcagaatgctgcacggcaagcacgtgatggtgagagtgggcggcggctgggacaccctgcagggcttcctgctgaagtacgacccctgcagaatcctgcagttcgccaccctggagcagaagatcctggccttccagaagggcgtgagcaacgagagcgtgcccgacagccccgccagaaccccccagccccccgagatgaaccccctgagcgccgtgaacatgttccagaagcagaacagcaagcccagcgtgcccgtgagcatccccaagagcaaggagaagcagggcagaccccccggcgccctggtgcccgccagcagcctgaagggcggcaacctgggcagcatgagcgtgagaagcaagctgcccaacagccccgccgccagcagccaccccaagctgaagagcagcaagggcatcaccaagaagccccaggcccccagcaacaacgccagcagcagcctggccagcctgaaccccgtgggcaagaacaccagcagccccgccctgcccagaaccgccccctgcatcagcgagagccccagaaagtgcatcagcagccccaacacccccaaggccaaggtgatccccgcccagaacagcgccgacctgcccgagagcaccctgctgcccaacaagtgcagcggcaagacccagcccaagtacctgaagcacaaccacatcagcagcagagacaacgccgtgagccacctggccgcccacagcaacagcagcagcaagtgccccaagctgcccaaggccaacatccccgtgagacccaagcccagcttccagagcagcgccaagatgaccaagaccagcagcaagaccatcgccaccggcctgggcacccagagccagcccagcgacggcgccccccaggccaagcccgtgcccgcccagaagctgaagagcgccctgaacctgaaccagcccgtgagcgtgagcagcgtgagccccgtgaaggccacccagaagagcaaggacaagaacatcgtgagcgccaccaagaagcagccccagaacaagagcgccttccagaagaccggccccagcagcctgaagagccccggcagaacccccctgagcatcgtgagcctgccccagagcagcaccaagacccagaccgcccccaagagcgcccagaccgtggccaagagccagcacagcaccaagggcccccccagaagcggcaagacccccgccagcatcagaaagccccccagcagcgtgaaggacgccgacagcggcgacaagaagcccaccgccaagaagaaggaggacgacgaccactacttcgtgatgaccggcagcaagaagcccagaaagtag

SEQ ID NO: 10882 - DNA, 2085 bp, Artificial Sequence; identical to SEQ ID NO: 10881
  Description of Artificial Sequence: Synthetic coding sequence

SEQ ID NO: 10883 - DNA, 2085 bp, Artificial Sequence; identical to SEQ ID NO: 10881
  Description of Artificial Sequence: Synthetic coding sequence

SEQ ID NO: 10884 - DNA, 150 bp, Artificial Sequence
  Description of Artificial Sequence: Synthetic coding sequence
atgcagcccgccatccaggtgtggttcggcgaggacctgcccctgagccccagaagccccctgacccccagacacggccccggcctggccaacgtgtgccagtacgacgagtggatcgccgtgagacacgaggccaccctgctgccctag

SEQ ID NO: 10885 - DNA, 1611 bp, Artificial Sequence
  Description of Artificial Sequence: Synthetic coding sequence
atgaacgccagcctggagagcctgtacagcgcctgcagcatgcagagcgacaccgtgcccctgctgcagaacggccagcacgccagaagccagcccagagccagcggcccccccagaagcatccagccccaggtgagccccagacagagagtgcagagaagccagcccgtgcacatcctggccgtgagaagactgcaggaggaggaccagcagttcagaaccagcagcctgcccgccatccccaaccccttccccgagctgtgcggccccggcagcccccccgtgctgacccccggcagcctgccccccagccaggccgccgccaagcaggacgtgaaggtgttcagcgaggacggcaccagcaaggtggtggagatcctggccgacatgaccgccagagacctgtgccagctgctggtgtacaagagccactgcgtggacgacaacagctggaccctggtggagcaccacccccacctgggcctggagagatgcctggaggaccacgagctggtggtgcaggtggagagcaccatggccagcgagagcaagttcctgttcagaaagaactacgccaagtacgagttcttcaagaaccccatgaacttcttccccgagcagatggtgacctggtgccagcagagcaacggcagccagacccagctgctgcagaacttcctgaacagcagcagctgccccgagatccagggcttcctgcacgtgaaggagctgggcaagaagagctggaagaagctgtacgtgtgcctgagaagaagcggcctgtactgcagcaccaagggcaccagcaaggagcccagacacctgcagctgctggccgacctggaggacagcaacatcttcagcctgatcgccggcagaaagcagtacaacgcccccaccgaccacggcctgtgcatcaagcccaacaaggtgagaaacgagaccaaggagctgagactgctgtgcgccgaggacgagcagaccagaacctgctggatgaccgccttcagactgctgaagtacggcatgctgctgtaccagaactacagaatcccccagcagagaaaggccctgctgagccccttcagcacccccgtgagaagcgtgagcgagaacagcctggtggccatggacttcagcggccagaccggcagagtgatcgagaaccccgccgaggcccagagcgccgccctggaggagggccacgcctggagaaagagaagcaccagaatgaacatcctgggcagccagagccccctgcaccccagcaccctgagcaccgtgatccacagaacccagcactggttccacggcagaatcagcagagaggagagccacagaatcatcaagcagcagggcctggtggacggcctgttcctgctgagagacagccagagcaaccccaaggccttcgtgctgaccctgtgccaccaccagaagatcaagaacttccagatcctgccctgcgaggacgacggccagaccttcttcagcctggacgacggcaacaccaagttcagcgacctgatccagctggtggacttctaccagctgaacaagggcgtgctgccctgcaagctgaagcaccactgcatcagagtggccctgtag

SEQ ID NO: 10886 - DNA, 1647 bp, Artificial Sequence
  Description of Artificial Sequence: Synthetic coding sequence
atggccctggccggctgccccgacagcttcctgcaccacccctactaccaggacaaggtggagcagacccccagaagccagcaggaccccgccggccccggcctgcccgcccagagcgacagactggccaaccaccaggaggacgacgtggacctggaggccctggtgaacgacatgaacgccagcctggagagcctgtacagcgcctgcagcatgcagagcgacaccgtgcccctgctgcagaacggccagcacgccagaagccagcccagagccagcggcccccccagaagcatccagccccaggtgagccccagacagagagtgcagagaagccagcccgtgcacatcctggccgtgagaagactgcaggaggaggaccagcagttcagaaccagcagcctgcccgccatccccaaccccttccccgagctgtgcggccccggcagcccccccgtgctgacccccggcagcctgccccccagccaggccgccgccaagcaggacgtgaaggtgttcagcgaggacggcaccagcaaggtggtggagatcctggccgacatgaccgccagagacctgtgccagctgctggtgtacaagagccactgcgtggacgacaacagctggaccctggtggagcaccacccccacctgggcctggagagatgcctggaggaccacgagctggtggtgcaggtggagagcaccatggccagcgagagcaagttcctgttcagaaagaactacgccaagtacgagttcttcaagaaccccatgaacttcttccccgagcagatggtgacctggtgccagcagagcaacggcagccagacccagctgctgcaggagcccagacacctgcagctgctggccgacctggaggacagcaacatcttcagcctgatcgccggcagaaagcagtacaacgcccccaccgaccacggcctgtgcatcaagcccaacaaggtgagaaacgagaccaaggagctgagactgctgtgcgccgaggacgagcagaccagaacctgctggatgaccgccttcagactgctgaagtacggcatgctgctgtaccagaactacagaatcccccagcagagaaaggccctgctgagccccttcagcacccccgtgagaagcgtgagcgagaacagcctggtggccatggacttcagcggccagaccggcagagtgatcgagaaccccgccgaggcccagagcgccgccctggaggagggccacgcctggagaaagagaagcaccagaatgaacatcctgggcagccagagccccctgcaccccagcaccctgagcaccgtgatccacagaacccagcactggttccacggcagaatcagcagagaggagagccacagaatcatcaagcagcagggcctggtggacggcctgttcctgctgagagacagccagagcaaccccaaggccttcgtgctgaccctgtgccaccaccagaagatcaagaacttccagatcctgccctgcgaggacgacggccagaccttcttcagcctggacgacggcaacaccaagttcagcgacctgatccagctggtggacttctaccagctgaacaagggcgtgctgccctgcaagctgaagcaccactgcatcagagtggccctgtag

SEQ ID NO: 10887 - DNA, 381 bp, Artificial Sequence
  Description of Artificial Sequence: Synthetic coding sequence
atgaacatcctgggcagccagagccccctgcaccccagcaccctgagcaccgtgatccacagaacccagcactggttccacggcagaatcagcagagaggagagccacagaatcatcaagcagcagggcctggtggacggcctgttcctgctgagagacagccagagcaaccccaaggccttcgtgctgaccctgtgccaccaccagaagatcaagaacttccagatcctgccctgcgaggacgacggccagaccttcttcagcctggacgacggcaacaccaagttcagcgacctgatccagctggtggacttctaccagctgaacaagggcgtgctgccctgcaagctgaagcaccactgcatcagagtggccctgtag

SEQ ID NO: 10888 - DNA, 1611 bp, Artificial Sequence; identical to SEQ ID NO: 10885
  Description of Artificial Sequence: Synthetic coding sequence

SEQ ID NO: 10889 - DNA, 1785 bp, Artificial Sequence
  Description of Artificial Sequence: Synthetic coding sequence
atggccctggccggctgccccgacagcttcctgcaccacccctactaccaggacaaggtggagcagacccccagaagccagcaggaccccgccggccccggcctgcccgcccagagcgacagactggccaaccaccaggaggacgacgtggacctggaggccctggtgaacgacatgaacgccagcctggagagcctgtacagcgcctgcagcatgcagagcgacaccgtgcccctgctgcagaacggccagcacgccagaagccagcccagagccagcggcccccccagaagcatccagccccaggtgagccccagacagagagtgcagagaagccagcccgtgcacatcctggccgtgagaagactgcaggaggaggaccagcagttcagaaccagcagcctgcccgccatccccaaccccttccccgagctgtgcggccccggcagcccccccgtgctgacccccggcagcctgccccccagccaggccgccgccaagcaggacgtgaaggtgttcagcgaggacggcaccagcaaggtggtggagatcctggccgacatgaccgccagagacctgtgccagctgctggtgtacaagagccactgcgtggacgacaacagctggaccctggtggagcaccacccccacctgggcctggagagatgcctggaggaccacgagctggtggtgcaggtggagagcaccatggccagcgagagcaagttcctgttcagaaagaactacgccaagtacgagttcttcaagaaccccatgaacttcttccccgagcagatggtgacctggtgccagcagagcaacggcagccagacccagctgctgcagaacttcctgaacagcagcagctgccccgagatccagggcttcctgcacgtgaaggagctgggcaagaagagctggaagaagctgtacgtgtgcctgagaagaagcggcctgtactgcagcaccaagggcaccagcaaggagcccagacacctgcagctgctggccgacctggaggacagcaacatcttcagcctgatcgccggcagaaagcagtacaacgcccccaccgaccacggcctgtgcatcaagcccaacaaggtgagaaacgagaccaaggagctgagactgctgtgcgccgaggacgagcagaccagaacctgctggatgaccgccttcagactgctgaagtacggcatgctgctgtaccagaactacagaatcccccagcagagaaaggccctgctgagccccttcagcacccccgtgagaagcgtgagcgagaacagcctggtggccatggacttcagcggccagaccggcagagtgatcgagaaccccgccgaggcccagagcgccgccctggaggagggccacgcctggagaaagagaagcaccagaatgaacatcctgggcagccagagccccctgcaccccagcaccctgagcaccgtgatccacagaacccagcactggttccacggcagaatcagcagagaggagagccacagaatcatcaagcagcagggcctggtggacggcctgttcctgctgagagacagccagagcaaccccaaggccttcgtgctgaccctgtgccaccaccagaagatcaagaacttccagatcctgccctgcgaggacgacggccagaccttcttcagcctggacgacggcaacaccaagttcagcgacctgatccagctggtggacttctaccagctgaacaagggcgtgctgccctgcaagctgaagcaccactgcatcagagtggccctgtag

SEQ ID NO: 10890 - DNA, 1785 bp, Artificial Sequence; identical to SEQ ID NO: 10889
  Description of Artificial Sequence: Synthetic coding sequence

SEQ ID NO: 10891 - DNA, 1611 bp, Artificial Sequence; identical to SEQ ID NO: 10885
  Description of Artificial Sequence: Synthetic coding sequence

SEQ ID NO: 10892 - DNA, 1611 bp, Artificial Sequence; identical to SEQ ID NO: 10885
  Description of Artificial Sequence: Synthetic coding sequence

SEQ ID NO: 10893 - DNA, 1767 bp, Artificial Sequence
  Description of Artificial Sequence: Synthetic coding sequence
atgcaggccgccggccccctgttcagaagcaaggacaaggtggagcagacccccagaagccagcaggaccccgccggccccggcctgcccgcccagagcgacagactggccaaccaccaggaggacgacgtggacctggaggccctggtgaacgacatgaacgccagcctggagagcctgtacagcgcctgcagcatgcagagcgacaccgtgcccctgctgcagaacggccagcacgccagaagccagcccagagccagcggcccccccagaagcatccagccccaggtgagccccagacagagagtgcagagaagccagcccgtgcacatcctggccgtgagaagactgcaggaggaggaccagcagttcagaaccagcagcctgcccgccatccccaaccccttccccgagctgtgcggccccggcagcccccccgtgctgacccccggcagcctgccccccagccaggccgccgccaagcaggacgtgaaggtgttcagcgaggacggcaccagcaaggtggtggagatcctggccgacatgaccgccagagacctgtgccagctgctggtgtacaagagccactgcgtggacgacaacagctggaccctggtggagcaccacccccacctgggcctggagagatgcctggaggaccacgagctggtggtgcaggtggagagcaccatggccagcgagagcaagttcctgttcagaaagaactacgccaagtacgagttcttcaagaaccccatgaacttcttccccgagcagatggtgacctggtgccagcagagcaacggcagccagacccagctgctgcagaacttcctgaacagcagcagctgccccgagatccagggcttcctgcacgtgaaggagctgggcaagaagagctggaagaagctgtacgtgtgcctgagaagaagcggcctgtactgcagcaccaagggcaccagcaaggagcccagacacctgcagctgctggccgacctggaggacagcaacatcttcagcctgatcgccggcagaaagcagtacaacgcccccaccgaccacggcctgtgcatcaagcccaacaaggtgagaaacgagaccaaggagctgagactgctgtgcgccgaggacgagcagaccagaacctgctggatgaccgccttcagactgctgaagtacggcatgctgctgtaccagaactacagaatcccccagcagagaaaggccctgctgagccccttcagcacccccgtgagaagcgtgagcgagaacagcctggtggccatggacttcagcggccagaccggcagagtgatcgagaaccccgccgaggcccagagcgccgccctggaggagggccacgcctggagaaagagaagcaccagaatgaacatcctgggcagccagagccccctgcaccccagcaccctgagcaccgtgatccacagaacccagcactggttccacggcagaatcagcagagaggagagccacagaatcatcaagcagcagggcctggtggacggcctgttcctgctgagagacagccagagcaaccccaaggccttcgtgctgaccctgtgccaccaccagaagatcaagaacttccagatcctgccctgcgaggacgacggccagaccttcttcagcctggacgacggcaacaccaagttcagcgacctgatccagctggtggacttctaccagctgaacaagggcgtgctgccctgcaagctgaagcaccactgcatcagagtggccctgtag

SEQ ID NO: 10894 - DNA, 1611 bp, Artificial Sequence; identical to SEQ ID NO: 10885
  Description of Artificial Sequence: Synthetic coding sequence

SEQ ID NO: 10895 - DNA, 1611 bp, Artificial Sequence; identical to SEQ ID NO: 10885
  Description of Artificial Sequence: Synthetic coding sequence

SEQ ID NO: 10896 - DNA, 345 bp, Artificial Sequence
  Description of Artificial Sequence: Synthetic coding sequence
atgcaggccgccggccccctgttcagaagcaaggacaaggtggagcagacccccagaagccagcaggaccccgccggccccggcctgcccgcccagagcgacagactggccaaccaccaggaggacgacgtggacctggaggccctggtgaacgacatgaacgccagcctggagagcctgtacagcgcctgcagcatgcagagcgacaccgtgcccctgctgcagaacggccagcacgccagaagccagcccagagccagcggcccccccagaagcatccagccccaggtgagccccagacagagagtgcagagaagccagcccgtgcacatcctggccgtgtag

SEQ ID NO: 10897 - DNA, 1767 bp, Artificial Sequence; identical to SEQ ID NO: 10893
  Description of Artificial Sequence: Synthetic coding sequence

SEQ ID NO: 10898 - DNA, 531 bp, Artificial Sequence
  Description of Artificial Sequence: Synthetic coding sequence
atggaggccatcgccaagtacgacttcaaggccaccgccgacgacgagctgagcttcaagagaggcgacatcctgaaggtgctgaacgaggagtgcgaccagaactggtacaaggccgagctgaacggcaaggacggcttcatccccaagaactacatcgagatgaagccccaccccttcggcaacgacgtgcagcacttcaaggtgctgagagacggcgccggcaagtacttcctgtgggtggtgaagttcaacagcctgaacgagctggtggactaccacagaagcaccagcgtgagcagaaaccagcagatcttcctgagagacatcgagcaggtgccccagcagcccacctacgtgcaggccctgttcgacttcgacccccaggaggacggcgagctgggcttcagaagaggcgacttcatccacgtgatggacaacagcgaccccaactggtggaagggcgcctgccacggccagaccggcatgttccccagaaactacgtgacccccgtgaacagaaacgtgtag

SEQ ID NO: 10899 - DNA, 654 bp, Artificial Sequence
  Description of Artificial Sequence: Synthetic coding sequence
atggaggccatcgccaagtacgacttcaaggccaccgccgacgacgagctgagcttcaagagaggcgacatcctgaaggtgctgaacgaggagtgcgaccagaactggtacaaggccgagctgaacggcaaggacggcttcatccccaagaactacatcgagatgaagccccacccctggttcttcggcaagatccccagagccaaggccgaggagatgctgagcaagcagagacacgacggcgccttcctgatcagagagagcgagagcgcccccggcgacttcagcctgagcgtgaagttcggcaacgacgtgcagcacttcaaggtgctgagagacggcgccggcaagtacttcctgtgggtggtgaagttcaacagcctgaacgagctggtggactaccacagaagcaccagcgtgagcagaaaccagcagatcttcctgagagacatcgagcaggtgccccagcagcccacctacgtgcaggccctgttcgacttcgacccccaggaggacggcgagctgggcttcagaagaggcgacttcatccacgtgatggacaacagcgaccccaactggtggaagggcgcctgccacggccagaccggcatgttccccagaaactacgtgacccccgtgaacagaaacgtgtag

SEQ ID NO: 10900 - DNA, 654 bp, Artificial Sequence; identical to SEQ ID NO: 10899
  Description of Artificial Sequence: Synthetic coding sequence

SEQ ID NO: 10901 - DNA, 654 bp, Artificial Sequence; identical to SEQ ID NO: 10899
  Description of Artificial Sequence: Synthetic coding sequence

SEQ ID NO: 10902 - DNA, 222 bp, Artificial Sequence
  Description of Artificial Sequence: Synthetic coding sequence
atgcccgccctgcacatcgaggacctgcccgagaaggagaagctgaagatggaggtggagcagctgagaaaggaggtgaagctgcagagacagcaggtgagcaagtgcagcgaggagatcaagaactacatcgaggagagaagcggcgaggaccccctggtgaagggcatccccgaggacaagaaccccttcaaggagaagggcagctgcgtgatcagctag

SEQ ID NO: 10903 - DNA, 432 bp, Artificial Sequence
  Description of Artificial Sequence: Synthetic coding sequence
atgagcggcagaggcaagaccggcggcaaggccagagccaaggccaagagcagaagcagcagagccggcctgcagttccccgtgggcagagtgcacagactgctgagaaagggccactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcggcgtgaccatcgcccagggcggcgtgctgcccaacatccaggccgtgctgctgcccaagaagaccagcgccaccgtgggccccaaggcccccagcggcggcaagaaggccacccaggccagccaggagtactag

SEQ ID NO: 10904 - DNA, 432 bp, Artificial Sequence; identical to SEQ ID NO: 10903
  Description of Artificial Sequence: Synthetic coding sequence

SEQ ID NO: 10905 - DNA, 276 bp, Artificial Sequence
  Description of Artificial Sequence: Synthetic coding sequence
atgtgcccctgccccctgcacagaggcagaggcccccccgccgtgtgcgcctgcagcgccggcagactgggcctgagaagcagcgccgcccagctgaccgccgccagactgaaggccctgggcgacgagctgcaccagagaaccatgtggagaagaagagccagaagcagaagagcccccgcccccggcgccctgcccacctactggccctggctgtgcgccgccgcccaggtggccgccctggccgcctggctgctgggcagaagaaacctgtag

SEQ ID NO: 10906 - DNA, 618 bp, Artificial Sequence
  Description of Artificial Sequence: Synthetic coding sequence
atgaccgagagaagagtgcccttcagcctgctgagaggccccagctgggaccccttcagagactggtacccccacagcagactgttcgaccaggccttcggcctgcccagactgcccgaggagtggagccagtggctgggcggcagcagctggcccggctacgtgagacccctgccccccgccgccatcgagagccccgccgtggccgcccccgcctacagcagagccctgagcagacagctgagcagcggcgtgagcgagatcagacacaccgccgacagatggagagtgagcctggacgtgaaccacttcgcccccgacgagctgaccgtgaagaccaaggacggcgtggtggagatcaccggcaagcacgaggagagacaggacgagcacggctacatcagcagatgcttcaccagaaagtacaccctgccccccggcgtggaccccacccaggtgagcagcagcctgagccccgagggcaccctgaccgtggaggcccccatgcccaagctggccacccagagcaacgagatcaccatccccgtgaccttcgagagcagagcccagctgggcggccccgaggccgccaagagcgacgagaccgccgccaagtag

SEQ ID NO: 10907 - DNA, 513 bp, Artificial Sequence
  Description of Artificial Sequence: Synthetic coding sequence
atgaccgagagaagagtgcccttcagcctgctgagaggccccagctggcccggctacgtgagacccctgccccccgccgccatcgagagccccgccgtggccgcccccgcctacagcagagccctgagcagacagctgagcagcggcgtgagcgagatcagacacaccgccgacagatggagagtgagcctggacgtgaaccacttcgcccccgacgagctgaccgtgaagaccaaggacggcgtggtggagatcaccggcaagcacgaggagagacaggacgagcacggctacatcagcagatgcttcaccagaaagtacaccctgccccccggcgtggaccccacccaggtgagcagcagcctgagccccgagggcaccctgaccgtggaggcccccatgcccaagctggccacccagagcaacgagatcaccatccccgtgaccttcgagagcagagcccagctgggcggccccgaggccgccaagagcgacgagaccgccgccaagtag

SEQ ID NO: 10908 - DNA, 1926 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgagggcggcaagcccaaggtgctggtgagctacaagggcgagaacaaggccttctaccccgaggagatcagcagcatggtgctgaccaagctgaaggagaccgccgaggccttcctgggccaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccatggacaagagcaccggcaaggtgaacaagatcaccatcaccaacgacaagggcagactgagcaaggaggagatcgagagaatggtgctggacgccgagaagtacaaggccgaggacgaggtgcagagagagaagatcgccgccaagaacgccctggagagctacgccttcaacatgaagagcgtggtgagcgacgagggcctgaagggcaagatcagcgagagcgacaagaacaagatcctggacaagtgcaacgagctgctgagctggctggaggtgaaccagctggccgagaaggacgagttcgaccacaagagaaaggagctgaagcagatgtgcaaccccatcatcaccaagctgtaccagggcggctgcaccggccccgcctgcggcaccggctacgtgcccggcagacccgccaccggccccaccatcgaggaggtggactag

SEQ ID NO: 10909 - DNA, 1599 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgagggcggcaagcccaaggtgctggtgagctacaagggcgagaacaaggccttctaccccgaggagatcagcagcatggtgctgaccaagctgaaggagaccgccgaggccttcctgggccaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccatggacaagagcaccggcaaggtgaacaagatcaccatcaccaacgacaagggcagactgagcaaggaggagatcgagagaatggtgctggacgccgagaagtacaaggccgaggacgtgtag

SEQ ID NO: 10910 - DNA, 1926 bp, Artificial Sequence; identical to SEQ ID NO: 10908
  Description of Artificial Sequence: Synthetic coding sequence

SEQ ID NO: 10911 - DNA, 699 bp, Artificial Sequence
  Description of Artificial Sequence: Synthetic coding sequence
gccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaagggcgccccccccgccagccccagatgcagcggctgcttcagaaccaccagcatggacgtgatctag

SEQ ID NO: 10912 - DNA, 1074 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccccgccaccgaggccagatacagaagagagggcgccagattcatcttcgacgtgggcaccagactgggcctgcactacgacaccctggccaccggcatcatctacttccacagattctacatgttccacagcttcaagcagttccccagatacgtgaccggcgcctgctgcctgttcctggccggcaaggtggaggagacccccaagaagtgcaaggacatcatcaagaccgccagaagcctgctgaacgacgtgcagttcggccagttcggcgacgaccccaaggaggaggtgatggtgctggagagaatcctgctgcagaccatcaagttcgacctgcaggtggagcacccctaccagttcctgctgaagtacgccaagcagctgaagggcgacaagaacaagatccagaagctggtgcagatggcctggaccttcgtgaacgacagaaccagcctgtgcaccaccctgagcctgcagtgggagcccgagatcatcgccgtggccgtgatgtacctggccggcagactgtgcaagttcgagatccaggagtggaccagcaagcccatgtacagaagatggtgggagcagttcgtgcaggacgtgcccgtggacgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccccctgatcctgctgcagggctgggcctgcagacagcccgccacccacctgctgcccagccccctggaggacagcctgctgtgccccagacccttcccccaccccgcctgcctgcagctgggcggctggggcggccagcccggctag

SEQ ID NO: 10913 - DNA, 2565 bp, Artificial Sequence
  Description of Artificial Sequence: Synthetic coding sequence
atgcccccctgcagcggcggcgacggcagcaccccccccggccccagcctgagagacagagactgccccgcccagagcgccgagtaccccagagacagactggaccccagacccggcagccccagcgaggccagcagcccccccttcctgagaagcagagcccccgtgaactggtaccaggagaaggcccaggtgttcctgtggcacctgatggtgagcggcagcaccaccctgctgtgcctgtggaagcagcccttccacgtgagcgccttccccgtgaccgccagcctggccttcagacagagccagggcgccggccagcacctgtacaaggacctgcagcccttcatcctgctgagactgctgatgcccgaggagacccagacccaggaccagcccatggaggaggaggaggtggagaccttcgccttccaggccgagatcgcccagctgatgagcctgatcatcaacaccttctacagcaacaaggagatcttcctgagagagctgatcagcaacagcagcgacgccctggacaagatcagatacgagagcctgaccgaccccagcaagctggacagcggcaaggagctgcacatcaacctgatccccaacaagcaggacagaaccctgaccatcgtggacaccggcatcggcatgaccaaggccgacctgatcaacaacctgggcaccatcgccaagagcggcaccaaggccttcatggaggccctgcaggccggcgccgacatcagcatgatcggccagttcggcgtgggcttctacagcgcctacctggtggccgagaaggtgaccgtgatcaccaagcacaacgacgacgagcagtacgcctgggagagcagcgccggcggcagcttcaccgtgagaaccgacaccggcgagcccatgggcagaggcaccaaggtgatcctgcacctgaaggaggaccagaccgagtacctggaggagagaagaatcaaggagatcgtgaagaagcacagccagttcatcggctaccccatcaccctgttcgtggagaaggagagagacaaggaggtgagcgacgacgaggccgaggagaaggaggacaaggaggaggagaaggagaaggaggagaaggagagcgaggacaagcccgagatcgaggacgtgggcagcgacgaggaggaggagaagaaggacggcgacaagaagaagaagaagaagatcaaggagaagtacatcgaccaggaggagctgaacaagaccaagcccatctggaccagaaaccccgacgacatcaccaacgaggagtacggcgagttctacaagagcctgaccaacgactgggaggaccacctggccgtgaagcacttcagcgtggagggccagctggagttcagagccctgctgttcgtgcccagaagagcccccttcgacctgttcgagaacagaaagaagaagaacaacatcaagctgtacgtgagaagagtgttcatcatggacaactgcgaggagctgatccccgagtacctgaacttcatcagaggcgtggtggacagcgaggacctgcccctgaacatcagcagagagatgctgcagcagagcaagatcctgaaggtgatcagaaagaacctggtgaagaagtgcctggagctgttcaccgagctggccgaggacaaggagaactacaagaagttctacgagcagttcagcaagaacatcaagctgggcatccacgaggacagccagaacagaaagaagctgagcgagctgctgagatactacaccagcgccagcggcgacgagatggtgagcctgaaggactactgcaccagaatgaaggagaaccagaagcacatctactacatcaccggcgagaccaaggaccaggtggccaacagcgccttcgtggagagactgagaaagcacggcctggaggtgatctacatgatcgagcccatcgacgagtactgcgtgcagcagctgaaggagttcgagggcaagaccctggtgagcgtgaccaaggagggcctggagctgcccgaggacgaggaggagaagaagaagcaggaggagaagaagaccaagttcgagaacctgtgcaagatcatgaaggacatcctggagaagaaggtggagaaggtggtggtgagcaacagactggtgaccagcccctgctgcatcgtgaccagcacctacggctggaccgccaacatggagagaatcatgaaggcccaggccctgagagacaacagcaccatgggctacatggccgccaagaagcacctggagatcaaccccgaccacagcatcatcgagaccctgagacagaaggccgaggccgacaagaacgacaagagcgtgaaggacctggtgatcctgctgtacgagaccgccctgctgagcagcggcttcagcctggaggacccccagacccacgccaacagaatctacagaatgatcaagctgggcctgggcatcgacgaggacgaccccaccgccgacgacaccagcgccgccgtgaccgaggagatgccccccctggagggcgacgacgacaccagcagaatggaggaggtggactag

SEQ ID NO: 10914 - DNA, 1242 bp, Artificial Sequence
  Description of Artificial Sequence: Synthetic coding sequence
atgggcagaggcaccaaggtgatcctgcacctgaaggaggaccagaccgagtacctggaggagagaagaatcaaggagatcgtgaagaagcacagccagttcatcggctaccccatcaccctgttcgtggagaaggagagagacaaggaggtgagcgacgacgaggccgaggagaaggaggacaaggaggaggagaaggagaaggaggagaaggagagcgaggacaagcccgagatcgaggacgtgggcagcgacgaggaggaggagaagaaggacggcgacaagaagaagaagaagaagatcaaggagaagtacatcgaccaggaggagctgaacaagaccaagcccatctggaccagaaaccccgacgacatcaccaacgaggagtacggcgagttctacaagagcctgaccaacgactgggaggaccacctggccgtgaagcacttcagcgtggagggccagctggagttcagagccctgctgttcgtgcccagaagagcccccttcgacctgttcgagaacagaaagaagaagaacaacatcaagctgtacgtgagaagagtgttcatcatggacaactgcgaggagctgatccccgagtacctgaacttcatcagaggcgtggtggacagcgaggacctgcccctgaacatcagcagagagatgctgcagcagagcaagatcctgaaggtgatcagaaagaacctggtgaagaagtgcctggagctgttcaccgagctggccgaggacaaggagaactacaagaagttctacgagcagttcagcaagaacatcaagctgggcatccacgaggacagccagaacagaaagaagctgagcgagctgctgagatactacaccagcgccagcggcgacgagatggtgagcctgaaggactactgcaccagaatgaaggagaaccagaagcacatctactacatcaccggcgagaccaaggaccaggtggccaacagcgccttcgtggagagactgagaaagcacggcctggaggtgatctacatgatcgagcccatcgacgagtactgcgtgcagcagctgaaggagttcgagggcaagaccctggtgagcgtgaccaaggagggcctggagctgcccgaggacgaggaggagaagaagaagcaggaggagaagaagaccaagttcgagaacctgtgcaagatcatgaaggacatcctggagaagaaggtggagaaggtgtgcgagtacagcatcagctag

SEQ ID NO: 10915 - DNA, 2412 bp, Artificial Sequence
  Description of Artificial Sequence: Synthetic coding sequence
atgagagccctgtgggtgctgggcctgtgctgcgtgctgctgaccttcggcagcgtgagagccgacgacgaggtggacgtggacggcaccgtggaggaggacctgggcaagagcagagagggcagcagaaccgacgacgaggtggtgcagagagaggaggaggccatccagctggacggcctgaacgccagccagatcagagagctgagagagaagagcgagaagttcgccttccaggccgaggtgaacagaatgatgaagctgatcatcaacagcctgtacaagaacaaggagatcttcctgagagagctgatcagcaacgccagcgacgccctggacaagatcagactgatcagcctgaccgacgagaacgccctgagcggcaacgaggagctgaccgtgaagatcaagtgcgacaaggagaagaacctgctgcacgtgaccgacaccggcgtgggcatgaccagagaggagctggtgaagaacctgggcaccatcgccaagagcggcaccagcgagttcctgaacaagatgaccgaggcccaggaggacggccagagcaccagcgagctgatcggccagttcggcgtgggcttctacagcgccttcctggtggccgacaaggtgatcgtgaccagcaagcacaacaacgacacccagcacatctgggagagcgacagcaacgagttcagcgtgatcgccgaccccagaggcaacaccctgggcagaggcaccaccatcaccctggtgctgaaggaggaggccagcgactacctggagctggacaccatcaagaacctggtgaagaagtacagccagttcatcaacttccccatctacgtgtggagcagcaagaccgagaccgtggaggagcccatggaggaggaggaggccgccaaggaggagaaggaggagagcgacgacgaggccgccgtggaggaggaggaggaggagaagaagcccaagaccaagaaggtggagaagaccgtgtgggactgggagctgatgaacgacatcaagcccatctggcagagacccagcaaggaggtggaggaggacgagtacaaggccttctacaagagcttcagcaaggagagcgacgaccccatggcctacatccacttcaccgccgagggcgaggtgaccttcaagagcatcctgttcgtgcccaccagcgcccccagaggcctgttcgacgagtacggcagcaagaagagcgactacatcaagctgtacgtgagaagagtgttcatcaccgacgacttccacgacatgatgcccaagtacctgaacttcgtgaagggcgtggtggacagcgacgacctgcccctgaacgtgagcagagagaccctgcagcagcacaagctgctgaaggtgatcagaaagaagctggtgagaaagaccctggacatgatcaagaagatcgccgacgacaagtacaacgacaccttctggaaggagttcggcaccaacatcaagctgggcgtgatcgaggaccacagcaacagaaccagactggccaagctgctgagattccagagcagccaccaccccaccgacatcaccagcctggaccagtacgtggagagaatgaaggagaagcaggacaagatctacttcatggccggcagcagcagaaaggaggccgagagcagccccttcgtggagagactgctgaagaagggctacgaggtgatctacctgaccgagcccgtggacgagtactgcatccaggccctgcccgagttcgacggcaagagattccagaacgtggccaaggagggcgtgaagttcgacgagagcgagaagaccaaggagagcagagaggccgtggagaaggagttcgagcccctgctgaactggatgaaggacaaggccctgaaggacaagatcgagaaggccgtggtgagccagagactgaccgagagcccctgcgccctggtggccagccagtacggctggagcggcaacatggagagaatcatgaaggcccaggcctaccagaccggcaaggacatcagcaccaactactacgccagccagaagaagaccttcgagatcaaccccagacaccccctgatcagagacatgctgagaagaatcaaggaggacgaggacgacaagaccgtgctggacctggccgtggtgctgttcgagaccgccaccctgagaagcggctacctgctgcccgacaccaaggcctacggcgacagaatcgagagaatgctgagactgagcctgaacatcgaccccgacgccaaggtggaggaggagcccgaggaggagcccgaggagaccgccgaggacaccaccgaggacaccgagcaggacgaggacgaggagatggacgtgggcaccgacgaggaggaggagaccgccaaggagagcaccgccgagaaggacgagctgtag

SEQ ID NO: 10916 - DNA, 1662 bp, Artificial Sequence
  Description of Artificial Sequence: Synthetic coding sequence
atgagagccctgtgggtgctgggcctgtgctgcgtgctgctgaccttcggcagcgtgagagccgacgacgaggtggacgtggacggcaccgtggaggaggacctgggcaagagcagagagggcagcagaaccgacgacgaggccgccaaggaggagaaggaggagagcgacgacgaggccgccgtggaggaggaggaggaggagaagaagcccaagaccaagaaggtggagaagaccgtgtgggactgggagctgatgaacgacatcaagcccatctggcagagacccagcaaggaggtggaggaggacgagtacaaggccttctacaagagcttcagcaaggagagcgacgaccccatggcctacatccacttcaccgccgagggcgaggtgaccttcaagagcatcctgttcgtgcccaccagcgcccccagaggcctgttcgacgagtacggcagcaagaagagcgactacatcaagctgtacgtgagaagagtgttcatcaccgacgacttccacgacatgatgcccaagtacctgaacttcgtgaagggcgtggtggacagcgacgacctgcccctgaacgtgagcagagagaccctgcagcagcacaagctgctgaaggtgatcagaaagaagctggtgagaaagaccctggacatgatcaagaagatcgccgacgacaagtacaacgacaccttctggaaggagttcggcaccaacatcaagctgggcgtgatcgaggaccacagcaacagaaccagactggccaagctgctgagattccagagcagccaccaccccaccgacatcaccagcctggaccagtacgtggagagaatgaaggagaagcaggacaagatctacttcatggccggcagcagcagaaaggaggccgagagcagccccttcgtggagagactgctgaagaagggctacgaggtgatctacctgaccgagcccgtggacgagtactgcatccaggccctgcccgagttcgacggcaagagattccagaacgtggccaaggagggcgtgaagttcgacgagagcgagaagaccaaggagagcagagaggccgtggagaaggagttcgagcccctgctgaactggatgaaggacaaggccctgaaggacaagatcgagaaggccgtggtgagccagagactgaccgagagcccctgcgccctggtggccagccagtacggctggagcggcaacatggagagaatcatgaaggcccaggcctaccagaccggcaaggacatcagcaccaactactacgccagccagaagaagaccttcgagatcaaccccagacaccccctgatcagagacatgctgagaagaatcaaggaggacgaggacgacaagaccgtgctggacctggccgtggtgctgttcgagaccgccaccctgagaagcggctacctgctgcccgacaccaaggcctacggcgacagaatcgagagaatgctgagactgagcctgaacatcgaccccgacgccaaggtggaggaggagcccgaggaggagcccgaggagaccgccgaggacaccaccgaggacaccgagcaggacgaggacgaggagatggacgtgggcaccgacgaggaggaggagaccgccaaggagagcaccgccgagaaggacgagctgtag

SEQ ID NO: 10917 - DNA, 948 bp, Artificial Sequence
  Description of Artificial Sequence: Synthetic coding sequence
atgagagccctgtgggtgctgggcctgtgctgcgtgctgctgaccttcggcagcgtgagagccgacgacgaggtggacgtggacggcaccgtggaggaggacctgggcaagagcagagagggcagcagaaccgacgacgaggtggtgcagagagaggaggaggccatccagctggacggcctgaacgccagccagatcagagagctgagagagaagagcgagaagttcgccttccaggccgaggtgaacagaatgatgaagctgatcatcaacagcctgtacaagaacaaggagatcttcctgagagagctgatcagcaacgccagcgacgccctggacaagatcagactgatcagcctgaccgacgagaacgccctgagcggcaacgaggagctgaccgtgaagatcaagtgcgacaaggagaagaacctgctgcacgtgaccgacaccggcgtgggcatgaccagagaggagctggtgaagaacctgggcaccatcgccaagagcggcaccagcgagttcctgaacaagatgaccgaggcccaggaggacggccagagcaccagcgagctgatcggccagttcggcgtgggcttctacagcgccttcctggtggccgacaaggtgatcgtgaccagcaagcacaacaacgacacccagcacatctgggagagcgacagcaacgagttcagcgtgatcgccgaccccagaggcaacaccctgggcagaggcaccaccatcaccctggtgctgaaggaggaggccagcgactacctggagctggacaccatcaagaacctggtgaagaagtacagccagttcatcaacttccccatctacgtgtggagcagcaagaccgagaccgtggaggagcccatggaggaggaggaggccgccaaggaggagaaggaggagagcgacgacgaggccgccgccagaagaagatag

SEQ ID NO: 10918 - DNA, 483 bp, Artificial Sequence
  Description of Artificial Sequence: Synthetic coding sequence
atgagcgaggtgagacccctgagcagagacatcctgatggagaccctgctgtacgagcagctgctggagccccccaccatggaggtgctgggcatgaccgacagcgaggaggacctggaccccatggaggacttcgacagcctggagtgcatggagggcagcgacgccctggccctgagactggcctgcatcggcgacgagatggacgtgagcctgagagcccccagactggcccagctgagcgaggtggccatgcacagcctgggcctggccttcatctacgaccagaccgaggacatcagagacgtgctgagaagcttcatggacggcttcaccaccctgaaggagaacatcatgagattctggagaagccccaaccccggcagctgggtgagctgcgagcaggtgctgctggccctgctgctgctgctggccctgctgctgcccctgctgagcggcggcctgcacctgctgctgaagtag

SEQ ID NO: 10919 - DNA, 564 bp, Artificial Sequence
  Description of Artificial Sequence: Synthetic coding sequence
atggagagaccccagcccgacagcatgccccaggacctgagcgaggccctgaaggaggccaccaaggaggtgcacacccaggccgagaacgccgagttcatgagaaacttccagaagggccaggtgaccagagacggcttcaagctggtgatggccagcctgtaccacatctacgtggccctggaggaggagatcgagagaaacaaggagagccccgtgttcgcccccgtgtacttccccgaggagctgcacagaaaggccgccctggagcaggacctggccttctggtacggccccagatggcaggaggtgatcccctacacccccgccatgcagagatacgtgaagagactgcacgaggtgggcagaaccgagcccgagctgctggtggcccacgcctacaccagatacctgggcgacctgagcggcggccaggtgctgaagaagatcgcccagaaggccctggacctgcccagcagcggcgagggcctggccttcttcaccttccccaacatcgccagcgccaccaagttcaagcagctgtacagaagcagaatgaactag

SEQ ID NO: 10920 - DNA, 1581 bp, Artificial Sequence
  Description of Artificial Sequence: Synthetic coding sequence
ctgggcggcagaagcagctgcgaggaccccggctgccccagagacgaggagagagcccccagaatgggctgcatgaagagcaagttcctgcaggtgggcggcaacaccttcagcaagaccgagaccagcgccagcccccactgccccgtgtacgtgcccgaccccaccagcaccatcaagcccggccccaacagccacaacagcaacacccccggcatcagagaggccggcagcgaggacatcatcgtggtggccctgtacgactacgaggccatccaccacgaggacctgagcttccagaagggcgaccagatggtggtgctggaggagagcggcgagtggtggaaggccagaagcctggccaccagaaaggagggctacatccccagcaactacgtggccagagtggacagcctggagaccgaggagtggttcttcaagggcatcagcagaaaggacgccgagagacagctgctggcccccggcaacatgctgggcagcttcatgatcagagacagcgagaccaccaagggcagctacagcctgagcgtgagagactacgaccccagacagggcgacaccgtgaagcactacaagatcagaaccctggacaacggcggcttctacatcagccccagaagcaccttcagcaccctgcaggagctggtggaccactacaagaagggcaacgacggcctgtgccagaagctgagcgtgccctgcatgagcagcaagccccagaagccctgggagaaggacgcctgggagatccccagagagagcctgaagctggagaagaagctgggcgccggccagttcggcgaggtgtggatggccacctacaacaagcacaccaaggtggccgtgaagaccatgaagcccggcagcatgagcgtggaggccttcctggccgaggccaacgtgatgaagaccctgcagcacgacaagctggtgaagctgcacgccgtggtgaccaaggagcccatctacatcatcaccgagttcatggccaagggcagcctgctggacttcctgaagagcgacgagggcagcaagcagcccctgcccaagctgatcgacttcagcgcccagatcgccgagggcatggccttcatcgagcagagaaactacatccacagagacctgagagccgccaacatcctggtgagcgccagcctggtgtgcaagatcgccgacttcggcctggccagagtgatcgaggacaacgagtacaccgccagagagggcgccaagttccccatcaagtggaccgcccccgaggccatcaacttcggcagcttcaccatcaagagcgacgtgtggagcttcggcatcctgctgatggagatcgtgacctacggcagaatcccctaccccggcatgagcaaccccgaggtgatcagagccctggagagaggctacagaatgcccagacccgagaactgccccgaggagctgtacaacatcatgatgagatgctggaagaacagacccgaggagagacccaccttcgagtacatccagagcgtgctggacgacttctacaccgccaccgagagccagtaccagcagcagccctag

SEQ ID NO: 10921 - DNA, 1578 bp, Artificial Sequence
  Description of Artificial Sequence: Synthetic coding sequence
ctgggcggcagaagcagctgcgaggaccccggctgccccagagacgaggagagagcccccagaatgggctgcatgaagagcaagttcctgcaggtgggcggcaacaccttcagcaagaccgagaccagcgccagcccccactgccccgtgtacgtgcccgaccccaccagcaccatcaagcccggccccaacagccacaacagcaacacccccggcatcagagagggcagcgaggacatcatcgtggtggccctgtacgactacgaggccatccaccacgaggacctgagcttccagaagggcgaccagatggtggtgctggaggagagcggcgagtggtggaaggccagaagcctggccaccagaaaggagggctacatccccagcaactacgtggccagagtggacagcctggagaccgaggagtggttcttcaagggcatcagcagaaaggacgccgagagacagctgctggcccccggcaacatgctgggcagcttcatgatcagagacagcgagaccaccaagggcagctacagcctgagcgtgagagactacgaccccagacagggcgacaccgtgaagcactacaagatcagaaccctggacaacggcggcttctacatcagccccagaagcaccttcagcaccctgcaggagctggtggaccactacaagaagggcaacgacggcctgtgccagaagctgagcgtgccctgcatgagcagcaagccccagaagccctgggagaaggacgcctgggagatccccagagagagcctgaagctggagaagaagctgggcgccggccagttcggcgaggtgtggatggccacctacaacaagcacaccaaggtggccgtgaagaccatgaagcccggcagcatgagcgtggaggccttcctggccgaggccaacgtgatgaagaccctgcagcacgacaagctggtgaagctgcacgccgtggtgaccaaggagcccatctacatcatcaccgagttcatggccaagggcagcctgctggacttcctgaagagcgacgagggcagcaagcagcccctgcccaagctgatcgacttcagcgcccagatcgccgagggcatggccttcatcgagcagagaaactacatccacagagacctgagagccgccaacatcctggtgagcgccagcctggtgtgcaagatcgccgacttcggcctggccagagtgatcgaggacaacgagtacaccgccagagagggcgccaagttccccatcaagtggaccgcccccgaggccatcaacttcggcagcttcaccatcaagagcgacgtgtggagcttcggcatcctgctgatggagatcgtgacctacggcagaatcccctaccccggcatgagcaaccccgaggtgatcagagccctggagagaggctacagaatgcccagacccgagaactgccccgaggagctgtacaacatcatgatgagatgctggaagaacagacccgaggagagacccaccttcgagtacatccagagcgtgctggacgacttctacaccgccaccgagagccagtaccagcagcagccctag

SEQ ID NO: 10922 - DNA, 1515 bp, Artificial Sequence
  Description of Artificial Sequence: Synthetic coding sequence
atgggctgcatgaagagcaagttcctgcaggtgggcggcaacaccttcagcaagaccgagaccagcgccagcccccactgccccgtgtacgtgcccgaccccaccagcaccatcaagcccggccccaacagccacaacagcaacacccccggcatcagagagggcagcgaggacatcatcgtggtggccctgtacgactacgaggccatccaccacgaggacctgagcttccagaagggcgaccagatggtggtgctggaggagagcggcgagtggtggaaggccagaagcctggccaccagaaaggagggctacatccccagcaactacgtggccagagtggacagcctggagaccgaggagtggttcttcaagggcatcagcagaaaggacgccgagagacagctgctggcccccggcaacatgctgggcagcttcatgatcagagacagcgagaccaccaagggcagctacagcctgagcgtgagagactacgaccccagacagggcgacaccgtgaagcactacaagatcagaaccctggacaacggcggcttctacatcagccccagaagcaccttcagcaccctgcaggagctggtggaccactacaagaagggcaacgacggcctgtgccagaagctgagcgtgccctgcatgagcagcaagccccagaagccctgggagaaggacgcctgggagatccccagagagagcctgaagctggagaagaagctgggcgccggccagttcggcgaggtgtggatggccacctacaacaagcacaccaaggtggccgtgaagaccatgaagcccggcagcatgagcgtggaggccttcctggccgaggccaacgtgatgaagaccctgcagcacgacaagctggtgaagctgcacgccgtggtgaccaaggagcccatctacatcatcaccgagttcatggccaagggcagcctgctggacttcctgaagagcgacgagggcagcaagcagcccctgcccaagctgatcgacttcagcgcccagatcgccgagggcatggccttcatcgagcagagaaactacatccacagagacctgagagccgccaacatcctggtgagcgccagcctggtgtgcaagatcgccgacttcggcctggccagagtgatcgaggacaacgagtacaccgccagagagggcgccaagttccccatcaagtggaccgcccccgaggccatcaacttcggcagcttcaccatcaagagcgacgtgtggagcttcggcatcctgctgatggagatcgtgacctacggcagaatcccctaccccggcatgagcaaccccgaggtgatcagagccctggagagaggctacagaatgcccagacccgagaactgccccgaggagctgtacaacatcatgatgagatgctggaagaacagacccgaggagagacccaccttcgagtacatccagagcgtgctggacgacttctacaccgccaccgagagccagtaccagcagcagccctag

SEQ ID NO: 10923 - DNA, 1518 bp, Artificial Sequence
  Description of Artificial Sequence: Synthetic coding sequence
atgggctgcatgaagagcaagttcctgcaggtgggcggcaacaccttcagcaagaccgagaccagcgccagcccccactgccccgtgtacgtgcccgaccccaccagcaccatcaagcccggccccaacagccacaacagcaacacccccggcatcagagaggccggcagcgaggacatcatcgtggtggccctgtacgactacgaggccatccaccacgaggacctgagcttccagaagggcgaccagatggtggtgctggaggagagcggcgagtggtggaaggccagaagcctggccaccagaaaggagggctacatccccagcaactacgtggccagagtggacagcctggagaccgaggagtggttcttcaagggcatcagcagaaaggacgccgagagacagctgctggcccccggcaacatgctgggcagcttcatgatcagagacagcgagaccaccaagggcagctacagcctgagcgtgagagactacgaccccagacagggcgacaccgtgaagcactacaagatcagaaccctggacaacggcggcttctacatcagccccagaagcaccttcagcaccctgcaggagctggtggaccactacaagaagggcaacgacggcctgtgccagaagctgagcgtgccctgcatgagcagcaagccccagaagccctgggagaaggacgcctgggagatccccagagagagcctgaagctggagaagaagctgggcgccggccagttcggcgaggtgtggatggccacctacaacaagcacaccaaggtggccgtgaagaccatgaagcccggcagcatgagcgtggaggccttcctggccgaggccaacgtgatgaagaccctgcagcacgacaagctggtgaagctgcacgccgtggtgaccaaggagcccatctacatcatcaccgagttcatggccaagggcagcctgctggacttcctgaagagcgacgagggcagcaagcagcccctgcccaagctgatcgacttcagcgcccagatcgccgagggcatggccttcatcgagcagagaaactacatccacagagacctgagagccgccaacatcctggtgagcgccagcctggtgtgcaagatcgccgacttcggcctggccagagtgatcgaggacaacgagtacaccgccagagagggcgccaagttccccatcaagtggaccgcccccgaggccatcaacttcggcagcttcaccatcaagagcgacgtgtggagcttcggcatcctgctgatggagatcgtgacctacggcagaatcccctaccccggcatgagcaaccccgaggtgatcagagccctggagagaggctacagaatgcccagacccgagaactgccccgaggagctgtacaacatcatgatgagatgctggaagaacagacccgaggagagacccaccttcgagtacatccagagcgtgctggacgacttctacaccgccaccgagagccagtaccagcagcagccctag

SEQ ID NO: 10924 - DNA, 1521 bp, Artificial Sequence
  Description of Artificial Sequence: Synthetic coding sequence
atgatgggctgcatgaagagcaagttcctgcaggtgggcggcaacaccttcagcaagaccgagaccagcgccagcccccactgccccgtgtacgtgcccgaccccaccagcaccatcaagcccggccccaacagccacaacagcaacacccccggcatcagagaggccggcagcgaggacatcatcgtggtggccctgtacgactacgaggccatccaccacgaggacctgagcttccagaagggcgaccagatggtggtgctggaggagagcggcgagtggtggaaggccagaagcctggccaccagaaaggagggctacatccccagcaactacgtggccagagtggacagcctggagaccgaggagtggttcttcaagggcatcagcagaaaggacgccgagagacagctgctggcccccggcaacatgctgggcagcttcatgatcagagacagcgagaccaccaagggcagctacagcctgagcgtgagagactacgaccccagacagggcgacaccgtgaagcactacaagatcagaaccctggacaacggcggcttctacatcagccccagaagcaccttcagcaccctgcaggagctggtggaccactacaagaagggcaacgacggcctgtgccagaagctgagcgtgccctgcatgagcagcaagccccagaagccctgggagaaggacgcctgggagatccccagagagagcctgaagctggagaagaagctgggcgccggccagttcggcgaggtgtggatggccacctacaacaagcacaccaaggtggccgtgaagaccatgaagcccggcagcatgagcgtggaggccttcctggccgaggccaacgtgatgaagaccctgcagcacgacaagctggtgaagctgcacgccgtggtgaccaaggagcccatctacatcatcaccgagttcatggccaagggcagcctgctggacttcctgaagagcgacgagggcagcaagcagcccctgcccaagctgatcgacttcagcgcccagatcgccgagggcatggccttcatcgagcagagaaactacatccacagagacctgagagccgccaacatcctggtgagcgccagcctggtgtgcaagatcgccgacttcggcctggccagagtgatcgaggacaacgagtacaccgccagagagggcgccaagttccccatcaagtggaccgcccccgaggccatcaacttcggcagcttcaccatcaagagcgacgtgtggagcttcggcatcctgctgatggagatcgtgacctacggcagaatcccctaccccggcatgagcaaccccgaggtgatcagagccctggagagaggctacagaatgcccagacccgagaactgccccgaggagctgtacaacatcatgatgagatgctggaagaacagacccgaggagagacccaccttcgagtacatccagagcgtgctggacgacttctacaccgccaccgagagccagtaccagcagcagccctag

SEQ ID NO: 10925 - DNA, 1518 bp, Artificial Sequence; identical to SEQ ID NO: 10923
  Description of Artificial Sequence: Synthetic coding sequence

SEQ ID NO: 10926 - DNA, 1632 bp, Artificial Sequence
  Description of Artificial Sequence: Synthetic coding sequence
atgctgctgagaagcaagcccgccctgcccccccccctgatgctgctgctgctgggccccctgggccccctgagccccggcgccctgcccagacccgcccaggcccaggacgtggtggacctggacttcttcacccaggagcccctgcacctggtgagccccagcttcctgagcgtgaccatcgacgccaacctggccaccgaccccagattcctgatcctgctgggcagccccaagctgagaaccctggccagaggcctgagccccgcctacctgagattcggcggcaccaagaccgacttcctgatcttcgaccccaagaaggagagcaccttcgaggagagaagctactggcagagccaggtgaaccaggacatctgcaagtacggcagcatcccccccgacgtggaggagaagctgagactggagtggccctaccaggagcagctgctgctgagagagcactaccagaagaagttcaagaacagcacctacagcagaagcagcgtggacgtgctgtacaccttcgccaactgcagcggcctggacctgatcttcggcctgaacgccctgctgagaaccgccgacctgcagtggaacagcagcaacgcccagctgctgctggactactgcagcagcaagggctacaacatcagctgggagctgggcaacgagcccaacagcttcctgaagaaggccgacatcttcatcaacggcagccagctgggcgaggacttcatccagctgcacaagctgctgagaaagagcaccttcaagaacgccaagctgtacggccccgacgtgggccagcccagaagaaagaccgccaagatgctgaagagcttcctgaaggccggcggcgaggtgatcgacagcgtgacctggcaccactactacctgaacggcagaaccgccaccaaggaggacttcctgaaccccgacgtgctggacatcttcatcagcagcgtgcagaaggtgttccaggtggtggagagcaccagacccggcaagaaggtgtggctgggcgagaccagcagcgcctacggcggcggcgcccccctgctgagcgacaccttcgccgccggcttcatgtggctggacaagctgggcctgagcgccagaatgggcatcgaggtggtgatgagacaggtgttcttcggcgccggcaactaccacctggtggacgagaacttcgaccccctgcccgactactggctgagcctgctgttcaagaagctggtgggcaccaaggtgctgatggccagcgtgcagggcagcaagagaagaaagctgagagtgtacctgcactgcaccaacaccgacaaccccagatacaaggagggcgacctgaccctgtacgccatcaacctgcacaacgtgaccaagtacctgagactgccctaccccttcagcaacaagcaggtggacaagtacctgctgagacccctgggcccccacggcctgctgagcaagagcgtgcagctgaacggcctgaccctgaagatggtggacgaccagaccctgccccccctgatggagaagcccctgagacccggcagcagcctgggcctgcccgccttcagctacagcttcttcgtgatcagaaacgccaaggtggccgcctgcatctag

SEQ ID NO: 10927 - DNA, 1632 bp, Artificial Sequence; identical to SEQ ID NO: 10926
  Description of Artificial Sequence: Synthetic coding sequence

SEQ ID NO: 10928 - DNA, 294 bp, Artificial Sequence
  Description of Artificial Sequence: Synthetic coding sequence
atgctgctgctgctgggccccctgggccccctgagccccggcgccctgcccagacccgcccaggcccaggacgtggtggacctggacttcttcacccaggagcccctgcacctggtgagccccagcttcctgagcgtgaccagacccggcaagaaggtgtggctgggcgagaccagcagcgcctacggcggcggcgcccccctgctgagcgacaccttcgccgccggcttcatgtggctggacaagctgggcctgagcgccagaatgggcatcgaggtggtgatgagacagtag

SEQ ID NO: 10929 - DNA, 1410 bp, Artificial Sequence
  Description of Artificial Sequence: Synthetic coding sequence
atgctgctgagaagcaagcccgccctgcccccccccctgatgctgctgctgctgggccccctgggccccctgagccccggcgccctgcccagacccgcccaggcccaggacgtggtggacctggacttcttcacccaggagcccctgcacctggtgagccccagcttcctgagcgtgaccatcgacgccaacctggccaccgaccccagattcctgatcctgctgggcagccccaagctgagaaccctggccagaggcctgagccccgcctacctgagattcggcggcaccaagaccgacttcctgatcttcgaccccaagaaggagagcaccttcgaggagagaagctactggcagagccaggtgaaccaggacatctgcaagtacggcagcatcccccccgacgtggaggagaagctgagactggagtggccctaccaggagcagctgctgctgagagagcactaccagaagaagttcaagaacagcacctacagcagaagcagcgtggacgtgctgtacaccttcgccaactgcagcggcctggacctgatcttcggcctgaacgccctgctgagaaccgccgacctgcagtggaacagcagcaacgcccagctgctgctggactactgcagcagcaagggctacaacatcagctgggagctgggcaacgagcccaacagcttcctgaagaaggccgacatcttcatcaacggcagccagctgggcgaggacttcatccagctgcacaagctgctgagaaagagcaccttcaagaacgccaagctgtacggccccgacgtgggccagcccagaagaaagaccgccaagatgctgaagagcttcctgaaggccggcggcgaggtgatcgacagcgtgacctggcaccactactacctgaacggcagaaccgccaccaaggaggacttcctgaaccccgacgtgctggacatcttcatcagcagcgtgcagaaggtgttccaggactactggctgagcctgctgttcaagaagctggtgggcaccaaggtgctgatggccagcgtgcagggcagcaagagaagaaagctgagagtgtacctgcactgcaccaacaccgacaaccccagatacaaggagggcgacctgaccctgtacgccatcaacctgcacaacgtgaccaagtacctgagactgccctaccccttcagcaacaagcaggtggacaagtacctgctgagacccctgggcccccacggcctgctgagcaagagcgtgcagctgaacggcctgaccctgaagatggtggacgaccagaccctgccccccctgatggagaagcccctgagacccggcagcagcctgggcctgcccgccttcagctacagcttcttcgtgatcagaaacgccaaggtggccgcctgcatctag

SEQ ID NO: 10930 - DNA, 1458 bp, Artificial Sequence
  Description of Artificial Sequence: Synthetic coding sequence
atgctgctgagaagcaagcccgccctgcccccccccctgatgctgctgctgctgggccccctgggccccctgagccccggcgccctgcccagacccgcccaggcccaggacgtggtggacctggacttcttcacccaggagcccctgcacctggtgagccccagcttcctgagcgtgaccatcgacgccaacctggccaccgaccccagattcctgatcctgctgggcagccccaagctgagaaccctggccagaggcctgagccccgcctacctgagattcggcggcaccaagaccgacttcctgatcttcgaccccaagaaggagagcaccttcgaggagagaagctactggcagagccaggtgaaccaggacatctgcaagtacggcagcatcccccccgacgtggaggagaagctgagactggagtggccctaccaggagcagctgctgctgagagagcactaccagaagaagttcaagaacagcacctacagcaagcccaacagcttcctgaagaaggccgacatcttcatcaacggcagccagctgggcgaggacttcatccagctgcacaagctgctgagaaagagcaccttcaagaacgccaagctgtacggccccgacgtgggccagcccagaagaaagaccgccaagatgctgaagagcttcctgaaggccggcggcgaggtgatcgacagcgtgacctggcaccactactacctgaacggcagaaccgccaccaaggaggacttcctgaaccccgacgtgctggacatcttcatcagcagcgtgcagaaggtgttccaggtggtggagagcaccagacccggcaagaaggtgtggctgggcgagaccagcagcgcctacggcggcggcgcccccctgctgagcgacaccttcgccgccggcttcatgtggctggacaagctgggcctgagcgccagaatgggcatcgaggtggtgatgagacaggtgttcttcggcgccggcaactaccacctggtggacgagaacttcgaccccctgcccgactactggctgagcctgctgttcaagaagctggtgggcaccaaggtgctgatggccagcgtgcagggcagcaagagaagaaagctgagagtgtacctgcactgcaccaacaccgacaaccccagatacaaggagggcgacctgaccctgtacgccatcaacctgcacaacgtgaccaagtacctgagactgccctaccccttcagcaacaagcaggtggacaagtacctgctgagacccctgggcccccacggcctgctgagcaagagcgtgcagctgaacggcctgaccctgaagatggtggacgaccagaccctgccccccctgatggagaagcccctgagacccggcagcagcctgggcctgcccgccttcagctacagcttcttcgtgatcagaaacgccaaggtggccgcctgcatctag

SEQ ID NO: 10931 - DNA, 1062 bp, Artificial Sequence
  Description of Artificial Sequence: Synthetic coding sequence
atggagaagaccctggagaccgtgcccctggagagaaagaagagagagaaggagcagttcagaaagctgttcatcggcggcctgagcttcgagaccaccgaggagagcctgagaaactactacgagcagtggggcaagctgaccgactgcgtggtgatgagagaccccgccagcaagagaagcagaggcttcggcttcgtgaccttcagcagcatggccgaggtggacgccgccatggccgccagaccccacagcatcgacggcagagtggtggagcccaagagagccgtggccagagaggagagcggcaagcccggcgcccacgtgaccgtgaagaagctgttcgtgggcggcatcaaggaggacaccgaggagcaccacctgagagactacttcgaggagtacggcaagatcgacaccatcgagatcatcaccgacagacagagcggcaagaagagaggcttcggcttcgtgaccttcgacgaccacgaccccgtggacaagatcgtgctgcagaagtaccacaccatcaacggccacaacgccgaggtgagaaaggccctgagcagacaggagatgcaggaggtgcagagcagcagaagcggcagaggcggcaacttcggcttcggcgacagcagaggcggcggcggcaacttcggccccggccccggcagcaacttcagaggcggcagcgacggctacggcagcggcagaggcttcggcgacggctacaacggctacggcggcggccccggcggcggcaacttcggcggcagccccggctacggcggcggcagaggcggctacggcggcggcggccccggctacggcaaccagggcggcggctacggcggcggctacgacaactacggcggcggcaactacggcagcggcaactacaacgacttcggcaactacaaccagcagcccagcaactacggccccatgaagagcggcaacttcggcggcagcagaaacatgggcggcccctacggcggcggcaactacggccccggcggcagcggcggcagcggcggctacggcggcagaagcagatactag

SEQ ID NO: 10932 - DNA, 1026 bp, Artificial Sequence
  Description of Artificial Sequence: Synthetic coding sequence
atggagagagagaaggagcagttcagaaagctgttcatcggcggcctgagcttcgagaccaccgaggagagcctgagaaactactacgagcagtggggcaagctgaccgactgcgtggtgatgagagaccccgccagcaagagaagcagaggcttcggcttcgtgaccttcagcagcatggccgaggtggacgccgccatggccgccagaccccacagcatcgacggcagagtggtggagcccaagagagccgtggccagagaggagagcggcaagcccggcgcccacgtgaccgtgaagaagctgttcgtgggcggcatcaaggaggacaccgaggagcaccacctgagagactacttcgaggagtacggcaagatcgacaccatcgagatcatcaccgacagacagagcggcaagaagagaggcttcggcttcgtgaccttcgacgaccacgaccccgtggacaagatcgtgctgcagaagtaccacaccatcaacggccacaacgccgaggtgagaaaggccctgagcagacaggagatgcaggaggtgcagagcagcagaagcggcagaggcggcaacttcggcttcggcgacagcagaggcggcggcggcaacttcggccccggccccggcagcaacttcagaggcggcagcgacggctacggcagcggcagaggcttcggcgacggctacaacggctacggcggcggccccggcggcggcaacttcggcggcagccccggctacggcggcggcagaggcggctacggcggcggcggccccggctacggcaaccagggcggcggctacggcggcggctacgacaactacggcggcggcaactacggcagcggcaactacaacgacttcggcaactacaaccagcagcccagcaactacggccccatgaagagcggcaacttcggcggcagcagaaacatgggcggcccctacggcggcggcaactacggccccggcggcagcggcggcagcggcggctacggcggcagaagcagatactag

SEQ ID NO: 10933 - DNA, 1062 bp, Artificial Sequence; identical to SEQ ID NO: 10931
  Description of Artificial Sequence: Synthetic coding sequence

SEQ ID NO: 10934 - DNA, 750 bp, Artificial Sequence
  Description of Artificial Sequence: Synthetic coding sequence
atggagagagagaaggagcagttcagaaagctgttcatcggcggcctgagcttcgagaccaccgaggagagcctgagaaactactacgagcagtggggcaagctgaccgactgcgtggtgatgagagaccccgccagcaagagaagcagaggcttcggcttcgtgaccttcagcagcatggccgaggtggacgccgccatggccgccagaccccacagcatcgacggcagagtggtggagcccaagagagccgtggccagagaggagagcggcaagcccggcgcccacgtgaccgtgaagaagctgttcgtgggcggcatcaaggaggacaccgaggagcaccacctgagagactacttcgaggagtacggcaagatcgacaccatcgagatcatcaccgacagacagagcggcaagaagagaggcttcggcttcgtgaccttcgacgaccacgaccccgtggacaagatcgtgctgcagaagtaccacaccatcaacggccacaacgccgaggtgagaaaggccctgagcagacaggagatgcaggaggacctggaggtggccatcctggaggtggcccccgtgatggaggaggaggaggaggacatggtggtggaggacctggacatggccaccagagtgggcgccaccgaggtggtgatgaccaccatggaggaggagatcatggaggtggagatcaccatgatcctggagatcatcaccagcaacctgctgaccaccgtgcagtag

SEQ ID NO: 10935 - DNA, 846 bp, Artificial Sequence
  Description of Artificial Sequence: Synthetic coding sequence
atgagcgaggagcagttcggcggcgacggcgccgccggcaacggcggcggcagaagagccggcgagcaggagggcgccatggtggccgccacccagggcgccgccgccagagaggccgagcccggccccggcgccgagcccagactggaggcccccaagggcgccgagagcgagggcgccaagatcgacgccagcaagaacgaggaggacgagggcaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcgaccagcagagcggctacggcaaggtgagcagaagaggcggccaccagaacagctacaagccctactag

SEQ ID NO: 10936 - DNA, 1068 bp, Artificial Sequence
  Description of Artificial Sequence: Synthetic coding sequence
atgagcgaggagcagttcggcggcgacggcgccgccgccgccgccaccgccgccgtgggcggcagcgccggcgagcaggagggcgccatggtggccgccacccagggcgccgccgccgccgccggcagcggcgccggcaccggcggcggcaccgccagcggcggcaccgagggcggcagcgccgagagcgagggcgccaagatcgacgccagcaagaacgaggaggacgagggccacagcaacagcagccccagacacagcgaggccgccaccgcccagagagaggagtggaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcggccccagccagaactggaaccagggctacagcaactactggaaccagggctacggcaactacggctacaacagccagggctacggcggctacggcggctacgactacaccggctacaacaactactacggctacggcgactacagcaaccagcagagcggctacggcaaggtgagcagaagaggcggccaccagaacagctacaagccctactag

SEQ ID NO: 10937 - DNA, 1011 bp, Artificial Sequence
  Description of Artificial Sequence: Synthetic coding sequence
atgagcgaggagcagttcggcggcgacggcgccgccgccgccgccaccgccgccgtgggcggcagcgccggcgagcaggagggcgccatggtggccgccacccagggcgccgccgccgccgccggcagcggcgccggcaccggcggcggcaccgccagcggcggcaccgagggcggcagcgccgagagcgagggcgccaagatcgacgccagcaagaacgaggaggacgagggcaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcggccccagccagaactggaaccagggctacagcaactactggaaccagggctacggcaactacggctacaacagccagggctacggcggctacggcggctacgactacaccggctacaacaactactacggctacggcgactacagcaaccagcagagcggctacggcaaggtgagcagaagaggcggccaccagaacagctacaagccctactag

SEQ ID NO: 10938 - DNA, 921 bp, Artificial Sequence
  Description of Artificial Sequence: Synthetic coding sequence
atgagcgaggagcagttcggcggcgacggcgccgccgccgccgccaccgccgccgtgggcggcagcgccggcgagcaggagggcgccatggtggccgccacccagggcgccgccgccgccgccggcagcggcgccggcaccggcggcggcaccgccagcggcggcaccgagggcggcagcgccgagagcgagggcgccaagatcgacgccagcaagaacgaggaggacgagggccacagcaacagcagccccagacacagcgaggccgccaccgcccagagagaggagtggaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcgaccagcagagcggctacggcaaggtgagcagaagaggcggccaccagaacagctacaagccctactag

SEQ ID NO: 10939 - DNA, 468 bp, Artificial Sequence
  Description of Artificial Sequence: Synthetic coding sequence
atgagcgaggagcagttcggcggcgacggcgccgccgccgccgccaccgccgccgtgggcggcagcgccggcgagcaggagggcgccatggtggccgccacccagggcgccgccgccgccgccggcagcggcgccggcaccggcggcggcaccgccagcggcggcaccgagggcggcagcgccgagagcgagggcgccaagatcgacgccagcaagaacgaggaggacgagggcaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggcctag

SEQ ID NO: 10940 - DNA, 666 bp, Artificial Sequence
  Description of Artificial Sequence: Synthetic coding sequence
atgagcgaggagcagttcggcggcgacggcgccgccgccgccgccaccgccgccgtgggcggcagcgccggcgagcaggagggcgccatggtggccgccacccagggcgccgccgccgccgccggcagcggcgccggcaccggcggcggcaccgccagcggcggcaccgagggcggcagcgccgagagcgagggcgccaagatcgacgccagcaagaacgaggaggacgagggccacagcaacagcagccccagacacagcgaggccgccaccgcccagagagaggagtggaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagtag

SEQ ID NO: 10941 - DNA, 633 bp, Artificial Sequence
  Description of Artificial Sequence: Synthetic coding sequence
tgaaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcgaccagcagagcggctacggcaaggtgagcagaagaggcggccaccagaacagctacaagccctactag

SEQ ID NO: 10942 - DNA, 606 bp, Artificial Sequence
  Description of Artificial Sequence: Synthetic coding sequence
atggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcggccccagccagaactggaaccagggctacagcaactactggaaccagggctacggcaactacggctacaacagccagggctacggcggctacggcggctacgactacaccggctacaacaactactacggctacggcgactacagcaaccagcagagcggctacggcaaggtgagcagaagaggcggccaccagaacagctacaagccctactag

SEQ ID NO: 10943 - DNA, 912 bp, Artificial Sequence
  Description of Artificial Sequence: Synthetic coding sequence
atgagcgaggagcagttcggcggcgacggcgccgccgccgccgccaccgccgccgccagcggcggcaccgagggcggcagcgccgagagcgagggcgccaagatcgacgccagcaagaacgaggaggacgagggcaagatgttcatcggcggcctgagctgggacaccaccaagaaggacctgaaggactacttcagcaagttcggcgaggtggtggactgcaccctgaagctggaccccatcaccggcagaagcagaggcttcggcttcgtgctgttcaaggagagcgagagcgtggacaaggtgatggaccagaaggagcacaagctgaacggcaaggtgatcgaccccaagagagccaaggccatgaagaccaaggagcccgtgaagaagatcttcgtgggcggcctgagccccgacacccccgaggagaagatcagagagtacttcggcggcttcggcgaggtggagagcatcgagctgcccatggacaacaagaccaacaagagaagaggcttctgcttcatcaccttcaaggaggaggagcccgtgaagaagatcatggagaagaagtaccacaacgtgggcctgagcaagtgcgagatcaaggtggccatgagcaaggagcagtaccagcagcagcagcagtggggcagcagaggcggcttcgccggcagagccagaggcagaggcggcggccccagccagaactggaaccagggctacagcaactactggaaccagggctacggcaactacggctacaacagccagggctacggcggctacggcggctacgactacaccggctacaacaactactacggctacggcgactacagcaaccagcagagcggctacggcaaggtgagcagaagaggcggccaccagaacagctacaagccctactag

SEQ ID NO: 10944 - DNA, 1974 bp, Artificial Sequence
  Description of Artificial Sequence: Synthetic coding sequence
atgcccagatacaccgtgcacgtgagaggcgagtggctggccgtgccctgccaggacgcccagctgaccgtgggctggctgggcagagaggccgtgagaagatacatcaagaacaagcccgacaacggcggcttcaccagcgtggacgacgcccacttcctggtgagaagatgcaagggcctgggcctgctggacaacgaggacagactggaggtggccctggagaacaacgagttcgtggaggtggtgatcgagggcgacgccatgagccccgacttcatccccagccagcccgagggcgtgtacctgtacagcaagtacagagagcccgagaagtacatcgagctggacggcgacagactgaccaccgaggacctggtgaacctgggcaagggcagatacaagatcaagctgacccccaccgccgagaagagagtgcagaagagcagagaggtgatcgacagcatcatcaaggagaagaccgtggtgtacggcatcaccaccggcttcggcaagttcgccagaaccgtgatccccatcaacaagctgcaggagctgcaggtgaacctggtgagaagccacagcagcggcgtgggcaagcccctgagccccgagagatgcagaatgctgctggccctgagaatcaacgtgctggccaagggctacagcggcatcagcctggagaccctgaagcaggtgatcgagatgttcaacgccagctgcctgccctacgtgcccgagaagggcaccgtgggcgccagcggcgacctggcccccctgagccacctggccctgggcctggtgggcgagggcaagatgtggagccccaagagcggctgggccgacgccaagtacgtgctggaggcccacggcctgaagcccgtgatcctgaagcccaaggagggcctggccctgatcaacggcacccagatgatcaccagcctgggctgcgaggccgtggagagagccagcgccatcgccagacaggccgacatcgtggccgccctgaccctggaggtgctgaagggcaccaccaaggccttcgacaccgacatccacgccctgagaccccacagaggccagatcgaggtggccttcagattcagaagcctgctggacagcgaccaccaccccagcgagatcgccgagagccacagattctgcgacagagtgcaggacgcctacaccctgagatgctgcccccaggtgcacggcgtggtgaacgacaccatcgccttcgtgaagaacatcatcaccaccgagctgaacagcgccaccgacaaccccatggtgttcgccaacagaggcgagaccgtgagcggcggcaacttccacggcgagtaccccgccaaggccctggactacctggccatcggcatccacgagctggccgccatcagcgagagaagaatcgagagactgtgcaaccccagcctgagcgagctgcccgccttcctggtggccgagggcggcctgaacagcggcttcatgatcgcccactgcaccgccgccgccctggtgagcgagaacaaggccctgtgccaccccagcagcgtggacagcctgagcaccagcgccgccaccgaggaccacgtgagcatgggcggctgggccgccagaaaggccctgagagtgatcgagcacgtggagcaggtgctggccatcgagctgctggccgcctgccagggcatcgagttcctgagacccctgaagaccaccacccccctggagaaggtgtacgacctggtgagaagcgtggtgagaccctggatcaaggacagattcatggcccccgacatcgaggccgcccacagactgctgctggagcagaaggtgtgggaggtggccgccccctacatcgagaagtacagaatggagcacatccccgagagcagacccctgagccccaccgccttcagcctgcagttcctgcacaagaagagcaccaagatccccgagagcgaggacctgtag

SEQ ID NO: 10945 - DNA, 1776 bp, Artificial Sequence
  Description of Artificial Sequence: Synthetic coding sequence
atgcccagatacaccgtgcacgtgagaggcgagtggctggccgtgccctgccaggacgcccagctgaccgtgggctggctgggcagagaggccgtgagaagatacatcaagaacaagcccgacaacggcggcttcaccagcgtggacgacgcccacttcctggtgagaagatgcaagggcctgggcctgctggacaacgaggacagactggaggtggccctggagaacaacgagttcgtggaggtggtgatcgagggcgacgccatgagccccgacttcatccccagccagcccgagggcgtgtacctgtacagcaagtacagagagcccgagaagtacatcgagctggacggcgacagactgaccaccgaggacctggtgaacctgggcaagggcagatacaagatcaagctgacccccaccgccgagaagagagtgcagaagagcagagaggtgatcgacagcatcatcaaggagaagaccgtggtgtacggcatcaccaccggcttcggcaagttcgccagaaccgtgatccccatcaacaagctgcaggagctgcaggtgaacctggtgagaagccacagcagcggcgtgggcaagcccctgagccccgagagatgcagaatgctgctggccctgagaatcaacgtgctggccaagggctacagcggcatcagcctggagaccctgaagcaggtgatcgagatgttcaacgccagctgcctgccctacgtgcccgagaagggcaccgtgggcgccagcggcgacctggcccccctgagccacctggccctgggcctggtgggcgagggcaagatgtggagccccaagagcggctgggccgacgccaagtacgtgctggaggcccacggcctgaagcccgtgatcctgaagcccaaggagggcctggccctgatcaacggcacccagatgatcaccagcctgggctgcgaggccgtggagagagccagcgccatcgccagacaggccgacatcgtggccgccctgaccctggaggtgctgaagggcaccaccaaggccttcgacaccgacatccacgccctgagaccccacagaggccagatcgaggtggccttcagattcagaagcctgctggacagcgaccaccaccccagcgagatcgccgagagccacagattctgcgacagagtgcaggacgcctacaccctgagatgctgcccccaggtgcacggcgtggtgaacgacaccatcgccttcgtgaagaacatcatcaccaccgagctgaacagcgccaccgacaaccccatggtgttcgccaacagaggcgagaccgtgagcggcggcaacttccacggcgagtaccccgccaaggccctggactacctggccatcggcatccacgagctggccgccatcagcgagagaagaatcgagagactgtgcaaccccagcctgagcgagctgcccgccttcctggtggccgagggcggcctgaacagcggcttcatgatcgcccactgcaccgccgccgccctggtgagcgagaacaaggccctgtgccaccccagcagcgtggacagcctgagcaccagcgccgccaccgaggaccacgtgagcatgggcggctgggccgccagaaaggccctgagagtgatcgagcacgtggagcaggtgctggccatcgagctgctggccgcctgccagggcatcgagttcctgagacccctgaagaccaccacccccctggagaaggtgtacgacctggtgagaagcgtggtgagattcggcaagtag

SEQ ID NO: 10946 - DNA, 1350 bp, Artificial Sequence
  Description of Artificial Sequence: Synthetic coding sequence
atgctgctggccctgagaatcaacgtgctggccaagggctacagcggcatcagcctggagaccctgaagcaggtgatcgagatgttcaacgccagctgcctgccctacgtgcccgagaagggcaccgtgggcgccagcggcgacctggcccccctgagccacctggccctgggcctggtgggcgagggcaagatgtggagccccaagagcggctgggccgacgccaagtacgtgctggaggcccacggcctgaagcccgtgatcctgaagcccaaggagggcctggccctgatcaacggcacccagatgatcaccagcctgggctgcgaggccgtggagagagccagcgccatcgccagacaggccgacatcgtggccgccctgaccctggaggtgctgaagggcaccaccaaggccttcgacaccgacatccacgccctgagaccccacagaggccagatcgaggtggccttcagattcagaagcctgctggacagcgaccaccaccccagcgagatcgccgagagccacagattctgcgacagagtgcaggacgcctacaccctgagatgctgcccccaggtgcacggcgtggtgaacgacaccatcgccttcgtgaagaacatcatcaccaccgagctgaacagcgccaccgacaaccccatggtgttcgccaacagaggcgagaccgtgagcggcggcaacttccacggcgagtaccccgccaaggccctggactacctggccatcggcatccacgagctggccgccatcagcgagagaagaatcgagagactgtgcaaccccagcctgagcgagctgcccgccttcctggtggccgagggcggcctgaacagcggcttcatgatcgcccactgcaccgccgccgccctggtgagcgagaacaaggccctgtgccaccccagcagcgtggacagcctgagcaccagcgccgccaccgaggaccacgtgagcatgggcggctgggccgccagaaaggccctgagagtgatcgagcacgtggagcaggtgctggccatcgagctgctggccgcctgccagggcatcgagttcctgagacccctgaagaccaccacccccctggagaaggtgtacgacctggtgagaagcgtggtgagaccctggatcaaggacagattcatggcccccgacatcgaggccgcccacagactgctgctggagcagaaggtgtgggaggtggccgccccctacatcgagaagtacagaatggagcacatccccgagagcagacccctgagccccaccgccttcagcctgcagttcctgcacaagaagagcaccaagatccccgagagcgaggacctgtag

SEQ ID NO: 10947 - DNA, 1260 bp, Artificial Sequence
  Description of Artificial Sequence: Synthetic coding sequence
atggccggcttcggcgccatggagaagttcctggtggagtacaagagcgccgtggagaagaagctggccgagtacaagtgcaacaccaacaccgccatcgagctgaagctggtgagattccccgaggacctggagaacgacatcagaaccttcttccccgagtacacccaccagctgttcggcgacgacgagaccgccttcggctacaagggcctgaagatcctgctgtactacatcgccggcagcctgagcaccatgttcagagtggagtacgccagcaaggtggacgagaacttcgactgcgtggaggccgacgacgtggagggcaagatcagacagatcatcccccccggcttctgcaccaacaccaacgacttcctgagcctgctggagaaggaggtggacttcaagcccttcggcaccctgctgcacacctacagcgtgctgagccccaccggcggcgagaacttcaccttccagatctacaaggccgacatgacctgcagaggcttcagagagtaccacgagagactgcagaccttcctgatgtggttcatcgagaccgccagcttcatcgacgtggacgacgagagatggcactacttcctggtgttcgagaagtacaacaaggacggcgccaccctgttcgccaccgtgggctacatgaccgtgtacaactactacgtgtaccccgacaagaccagacccagagtgagccagatgctgatcctgacccccttccagggccagggccacggcgcccagctgctggagaccgtgcacagatactacaccgagttccccaccgtgctggacatcaccgccgaggaccccagcaagagctacgtgaagctgagagacttcgtgctggtgaagctgtgccaggacctgccctgcttcagcagagagaagctgatgcagggcttcaacgaggacatggccatcgaggcccagcagaagttcaagatcaacaagcagcacgccagaagagtgtacgagatcctgagactgctggtgaccgacatgagcgacgccgagcagtacagaagctacagactggacatcaagagaagactgatcagcccctacaagaagaagcagagagacctggccaagatgagaaagtgcctgagacccgaggagctgaccaaccagatgaaccagatcgagatcagcatgcagcacgagcagctggaggagagcttccaggagctggtggaggactacagaagagtgatcgagagactggcccaggagtag

SEQ ID NO: 10948 - DNA, 1005 bp, Artificial Sequence
  Description of Artificial Sequence: Synthetic coding sequence
atgttcagagtggagtacgccagcaaggtggacgagaacttcgactgcgtggaggccgacgacgtggagggcaagatcagacagatcatcccccccggcttctgcaccaacaccaacgacttcctgagcctgctggagaaggaggtggacttcaagcccttcggcaccctgctgcacacctacagcgtgctgagccccaccggcggcgagaacttcaccttccagatctacaaggccgacatgacctgcagaggcttcagagagtaccacgagagactgcagaccttcctgatgtggttcatcgagaccgccagcttcatcgacgtggacgacgagagatggcactacttcctggtgttcgagaagtacaacaaggacggcgccaccctgttcgccaccgtgggctacatgaccgtgtacaactactacgtgtaccccgacaagaccagacccagagtgagccagatgctgatcctgacccccttccagggccagggccacggcgcccagctgctggagaccgtgcacagatactacaccgagttccccaccgtgctggacatcaccgccgaggaccccagcaagagctacgtgaagctgagagacttcgtgctggtgaagctgtgccaggacctgccctgcttcagcagagagaagctgatgcagggcttcaacgaggacatggccatcgaggcccagcagaagttcaagatcaacaagcagcacgccagaagagtgtacgagatcctgagactgctggtgaccgacatgagcgacgccgagcagtacagaagctacagactggacatcaagagaagactgatcagcccctacaagaagaagcagagagacctggccaagatgagaaagtgcctgagacccgaggagctgaccaaccagatgaaccagatcgagatcagcatgcagcacgagcagctggaggagagcttccaggagctggtggaggactacagaagagtgatcgagagactggcccaggagtag

SEQ ID NO: 10949 - DNA, 870 bp, Artificial Sequence
  Description of Artificial Sequence: Synthetic coding sequence
atgaccgtgagcttccacaagtacggcgagtacttccccggcaccggcgacctgagagacatcggcgccggcaagggcaagtactacgccgtgaactaccccctgagagacggcatcgacgacgagagctacgaggccatcttcaagcccgtgatgagcaaggtgatggagatgttccagcccagcgccgtggtgctgcagtgcggcagcgacagcctgagcggcgacagactgggctgcttcaacctgaccatcaagggccacgccaagtgcgtggagttcgtgaagagcttcaacctgcccatgctgatgctgggcggcggcggctacaccatcagaaacgtggccagatgctggacctacgagaccgccgtggccctggacaccgagatccccaacgagctgccctacaacgactacttcgagtacttcggccccgacttcaagctgcacatcagccccagcaacatgaccaaccagaacaccaacgagtacctggagaagatcaagcagagactgttcgagaacctgagaatgctgccccacgcccccggcgtgcagatgcaggccatccccgaggacgccatccccgaggagagcggcgacgaggacgaggacgaccccgacaagagaatcagcatctgcagcagcgacaagagaatcgcctgcgaggaggagttcagcgacagcgaggaggagggcgagggcggcagaaagaacagcagcaacttcaagaaggccaagagagtgaagaccgaggacgagaaggagaaggaccccgaggagaagaaggaggtgaccgaggaggagaagaccaaggaggagaagcccgaggccaagggcgtgaaggaggaggtgaagctggcctag

SEQ ID NO: 10950 - DNA, 1449 bp, Artificial Sequence
  Description of Artificial Sequence: Synthetic coding sequence
atggcccagacccagggcaccagaagaaaggtgtgctactactacgacggcgacgtgggcaactactactacggccagggccaccccatgaagccccacagaatcagaatgacccacaacctgctgctgaactacggcctgtacagaaagatggagatctacagaccccacaaggccaacgccgaggagatgaccaagtaccacagcgacgactacatcaagttcctgagaagcatcagacccgacaacatgagcgagtacagcaagcagatgcagagattcaacgtgggcgaggactgccccgtgttcgacggcctgttcgagttctgccagctgagcaccggcggcagcgtggccagcgccgtgaagctgaacaagcagcagaccgacatcgccgtgaactgggccggcggcctgcaccacgccaagaagagcgaggccagcggcttctgctacgtgaacgacatcgtgctggccatcctggagctgctgaagtaccaccagagagtgctgtacatcgacatcgacatccaccacggcgacggcgtggaggaggccttctacaccaccgacagagtgatgaccgtgagcttccacaagtacggcgagtacttccccggcaccggcgacctgagagacatcggcgccggcaagggcaagtactacgccgtgaactaccccctgagagacggcatcgacgacgagagctacgaggccatcttcaagcccgtgatgagcaaggtgatggagatgttccagcccagcgccgtggtgctgcagtgcggcagcgacagcctgagcggcgacagactgggctgcttcaacctgaccatcaagggccacgccaagtgcgtggagttcgtgaagagcttcaacctgcccatgctgatgctgggcggcggcggctacaccatcagaaacgtggccagatgctggacctacgagaccgccgtggccctggacaccgagatccccaacgagctgccctacaacgactacttcgagtacttcggccccgacttcaagctgcacatcagccccagcaacatgaccaaccagaacaccaacgagtacctggagaagatcaagcagagactgttcgagaacctgagaatgctgccccacgcccccggcgtgcagatgcaggccatccccgaggacgccatccccgaggagagcggcgacgaggacgaggacgaccccgacaagagaatcagcatctgcagcagcgacaagagaatcgcctgcgaggaggagttcagcgacagcgaggaggagggcgagggcggcagaaagaacagcagcaacttcaagaaggccaagagagtgaagaccgaggacgagaaggagaaggaccccgaggagaagaaggaggtgaccgaggaggagaagaccaaggaggagaagcccgaggccaagggcgtgaaggaggaggtgaagctggcctag

SEQ ID NO: 10951 - DNA, 636 bp, Artificial Sequence
  Description of Artificial Sequence: Synthetic coding sequence
atggcccagacccagggcaccagaagaaaggtgtgctactactacgacggcgacgtgggcaactactactacggccagggccaccccatgaagccccacagaatcagaatgacccacaacctgctgctgaactacggcctgtacagaaagatggagatctacagaccccacaaggccaacgccgaggagatgaccaagtaccacagcgacgactacatcaagttcctgagaagcatcagacccgacaacatgagcgagtacagcaagcagatgcagagaagcagcgccgtgaagctgaacaagcagcagaccgacatcgccgtgaactgggccggcggcctgcaccacgccaagaagagcgaggccagcggcttctgctacgtgaacgacatcgtgctggccatcctggagctgctgaagtaccaccagagagtgctgtacatcgacatcgacatccaccacggcgacggcgtggaggaggccttctacaccaccgacagagtgatgaccgtgagcttccacaagtacggcgagtacttccccggcaccggcgacctgagagacatcggcgccggcaagggcaagtactacgccgtgaactaccccctgagagacggcatcgacgacgagagctag

SEQ ID NO: 10952 - DNA, 1044 bp, Artificial Sequence
  Description of Artificial Sequence: Synthetic coding sequence
atgctgcacaccacccagctgtaccagcacgtgcccgagaccagatggcccatcgtgtacagccccagatacaacatcaccttcatgggcctggagaagctgcaccccttcgacgccggcaagtggggcaaggtgatcaacttcctgaaggaggagaagctgctgagcgacagcatgctggtggaggccagagaggccagcgaggaggacctgctggtggtgcacaccagaagatacctgaacgagctgaagtggagcttcgccgtggccaccatcaccgagatcccccccgtgatcttcctgcccaacttcctggtgcagagaaaggtgctgagacccctgagaacccagaccggcggcaccatcatggccggcaagctggccgtggagagaggctgggccatcaacgtgggcggcggcttccaccactgcagcagcgacagaggcggcggcttctgcgcctacgccgacatcaccctggccatcaagttcctgttcgagagagtggagggcatcagcagagccaccatcatcgacctggacgcccaccagggcaacggccacgagagagacttcatggacgacaagagagtgtacatcatggacgtgtacaacagacacatctaccccggcgacagattcgccaagcaggccatcagaagaaaggtggagctggagtggggcaccgaggacgacgagtacctggacaaggtggagagaaacatcaagaagagcctgcaggagcacctgcccgacgtggtggtgtacaacgccggcaccgacatcctggagggcgacagactgggcggcctgagcatcagccccgccggcatcgtgaagagagacgagctggtgttcagaatggtgagaggcagaagagtgcccatcctgatggtgaccagcggcggctaccagaagagaaccgccagaatcatcgccgacagcatcctgaacctgttcggcctgggcctgatcggccccgagagccccagcgtgagcgcccagaacagcgacacccccctgctgccccccgccgtgccctag

SEQ ID NO: 10953 - DNA, 711 bp, Artificial Sequence
  Description of Artificial Sequence: Synthetic coding sequence
atgggcctggagaagctgcaccccttcgacgccggcaagtggggcaaggtgatcaacttcctgaaggaggagaagctgctgagcgacagcatgctggtggaggccagagaggccagcgaggaggacctgctggtggtgcacaccagaagatacctgaacgagctgaagtggagcttcgccgtggccaccatcaccgagatcccccccgtgatcttcctgcccaacttcctggtgcagagaaaggtgctgagacccctgagaacccagaccggcggcaccatcatgggcgtggccagcaccaccgcccccgccaccgtggccggcgccagcgtgcccatgagaaccagcagaagccccagcagcttctgcctgagcgtgtggagagccagccccggcctgcccagcctgatcctgatgcccatcagagccatgggcatgagcgagaccagctggaccaccagcgtgtgcaccagctggatgagcaccaccgccaccagcacccagggcaccgccctgcccagcagacccagcggcggcagatggagctggagcggcgcccagagaatgatgagcacctggatcagatggagaggcaccagcagaaaccccagcagaagcacctgccccacctggtggtacaccatgcaggcccccaccagcagcagaggcaccgccctgggcggctgccccagcgcccagagagccagctag

SEQ ID NO: 10954 - DNA, 960 bp, Artificial Sequence
  Description of Artificial Sequence: Synthetic coding sequence
atgggcctggagaagctgcaccccttcgacgccggcaagtggggcaaggtgatcaacttcctgaaggaggagaagctgctgagcgacagcatgctggtggaggccagagaggccagcgaggaggacctgctggtggtgcacaccagaagatacctgaacgagctgaagtggagcttcgccgtggccaccatcaccgagatcccccccgtgatcttcctgcccaacttcctggtgcagagaaaggtgctgagacccctgagaacccagaccggcggcaccatcatggccggcaagctggccgtggagagaggctgggccatcaacgtgggcggcggcttccaccactgcagcagcgacagaggcggcggcttctgcgcctacgccgacatcaccctggccatcaagttcctgttcgagagagtggagggcatcagcagagccaccatcatcgacctggacgcccaccagggcaacggccacgagagagacttcatggacgacaagagagtgtacatcatggacgtgtacaacagacacatctaccccggcgacagattcgccaagcaggccatcagaagaaaggtggagctggagtggggcaccgaggacgacgagtacctggacaaggtggagagaaacatcaagaagagcctgcaggagcacctgcccgacgtggtggtgtacaacgccggcaccgacatcctggagggcgacagactgggcggcctgagcatcagccccgccggcatcgtgaagagagacgagctggtgttcagaatggtgagaggcagaagagtgcccatcctgatggtgaccagcggcggctaccagaagagaaccgccagaatcatcgccgacagcatcctgaacctgttcggcctgggcctgatcggccccgagagccccagcgtgagcgcccagaacagcgacacccccctgctgccccccgccgtgccctag

SEQ ID NO: 10955 - DNA, 468 bp, Artificial Sequence
  Description of Artificial Sequence: Synthetic coding sequence
atggacgacaagagagtgtacatcatggacgtgtacaacagacacatctaccccggcgacagattcgccaagcaggccatcagaagaaaggtggagctggagtggggcaccgaggacgacgagtacctggacaaggtggagagaaacatcaagaagagcctgcaggagcacctgcccgacgtggtggtgtacaacgccggcaccgacatcctggagggcgacagactgggcggcctgagcatcagccccgccggcatcgtgaagagagacgagctggtgttcagaatggtgagaggcagaagagtgcccatcctgatggtgaccagcggcggctaccagaagagaaccgccagaatcatcgccgacagcatcctgaacctgttcggcctgggcctgatcggccccgagagccccagcgtgagcgcccagaacagcgacacccccctgctgccccccgccgtgccctag

SEQ ID NO: 10956 - DNA, 891 bp, Artificial Sequence
  Description of Artificial Sequence: Synthetic coding sequence
atgggcctggagaagctgcaccccttcgacgccggcaagtggggcaaggtgatcaacttcctgaaggaggagaagctgctgagcgacagcatgctggtggaggccagagaggccagcgaggaggacctgctggtggtgcacaccagaagatacctgaacgagctgaagagaaaggtgctgagacccctgagaacccagaccggcggcaccatcatggccggcaagctggccgtggagagaggctgggccatcaacgtgggcggcggcttccaccactgcagcagcgacagaggcggcggcttctgcgcctacgccgacatcaccctggccatcaagttcctgttcgagagagtggagggcatcagcagagccaccatcatcgacctggacgcccaccagggcaacggccacgagagagacttcatggacgacaagagagtgtacatcatggacgtgtacaacagacacatctaccccggcgacagattcgccaagcaggccatcagaagaaaggtggagctggagtggggcaccgaggacgacgagtacctggacaaggtggagagaaacatcaagaagagcctgcaggagcacctgcccgacgtggtggtgtacaacgccggcaccgacatcctggagggcgacagactgggcggcctgagcatcagccccgccggcatcgtgaagagagacgagctggtgttcagaatggtgagaggcagaagagtgcccatcctgatggtgaccagcggcggctaccagaagagaaccgccagaatcatcgccgacagcatcctgaacctgttcggcctgggcctgatcggccccgagagccccagcgtgagcgcccagaacagcgacacccccctgctgccccccgccgtgccctag

SEQ ID NO: 10957 - DNA, 1377 bp, Artificial Sequence
  Description of Artificial Sequence: Synthetic coding sequence
atgaagccccacagaatcagaatgacccacaacctgctgctgaactacggcctgtacagaaagatggagatctacagaccccacaaggccaccgccgaggagatgaccaagtaccacagcgacgagtacatcaagttcctgagaagcatcagacccgacaacatgagcgagtacagcaagcagatgcagagattcaacgtgggcgaggactgccccgtgttcgacggcctgttcgagttctgccagctgagcaccggcggcagcgtggccggcgccgtgaagctgaacagacagcagaccgacatggccgtgaactgggccggcggcctgcaccacgccaagaagagcgaggccagcggcttctgctacgtgaacgacatcgtgctggccatcctggagctgctgaagtaccaccagagagtgctgtacatcgacatcgacatccaccacggcgacggcgtggaggaggccttctacaccaccgacagagtgatgaccgtgagcttccacaagtacggcgagtacttccccggcaccggcgacctgagagacatcggcgccggcaagggcaagtactacgccgtgaacttccccatgagagacggcatcgacgacgagagctacggccagatcttcaagcccatcatcagcaaggtgatggagatgtaccagcccagcgccgtggtgctgcagtgcggcgccgacagcctgagcggcgacagactgggctgcttcaacctgaccgtgaagggccacgccaagtgcgtggaggtggtgaagaccttcaacctgcccctgctgatgctgggcggcggcggctacaccatcagaaacgtggccagatgctggacctacgagaccgccgtggccctggactgcgagatccccaacgagctgccctacaacgactacttcgagtacttcggccccgacttcaagctgcacatcagccccagcaacatgaccaaccagaacacccccgagtacatggagaagatcaagcagagactgttcgagaacctgagaatgctgccccacgcccccggcgtgcagatgcaggccatccccgaggacgccgtgcacgaggacagcggcgacgaggacggcgaggaccccgacaagagaatcagcatcagagccagcgacaagagaatcgcctgcgacgaggagttcagcgacagcgaggacgagggcgagggcggcagaagaaacgtggccgaccacaagaagggcgccaagaaggccagaatcgaggaggacaagaaggagaccgaggacaagaagaccgacgtgaaggaggaggacaagagcaaggacaacagcggcgagaagaccgacaccaagggcaccaagagcgagcagctgagcaacccctag

SEQ ID NO: 10958 - DNA, 1749 bp, Artificial Sequence
  Description of Artificial Sequence: Synthetic coding sequence
atgagaagccccccctgcggcctgctgagatggttcggcggccccctgctggccagctggtgcagatgccacctgagattcagagccttcggcaccagcgccggctggtacagagccttccccgcccccccccccctgctgccccccgcctgccccagccccagagactacagaccccacgtgagcctgagccccttcctgagcagacccagcagaggcggcagcagcagcagcagcagcagcagaagaagaagccccgtggccgccgtggccggcgagcccatggcctacagccagggcggcggcaagaagaaggtgtgctactactacgacggcgacatcggcaactactactacggccagggccaccccatgaagccccacagaatcagaatgacccacaacctgctgctgaactacggcctgtacagaaagatggagatctacagaccccacaaggccaccgccgaggagatgaccaagtaccacagcgacgagtacatcaagttcctgagaagcatcagacccgacaacatgagcgagtacagcaagcagatgcagagattcaacgtgggcgaggactgccccgtgttcgacggcctgttcgagttctgccagctgagcaccggcggcagcgtggccggcgccgtgaagctgaacagacagcagaccgacatggccgtgaactgggccggcggcctgcaccacgccaagaagagcgaggccagcggcttctgctacgtgaacgacatcgtgctggccatcctggagctgctgaagtaccaccagagagtgctgtacatcgacatcgacatccaccacggcgacggcgtggaggaggccttctacaccaccgacagagtgatgaccgtgagcttccacaagtacggcgagtacttccccggcaccggcgacctgagagacatcggcgccggcaagggcaagtactacgccgtgaacttccccatgagagacggcatcgacgacgagagctacggccagatcttcaagcccatcatcagcaaggtgatggagatgtaccagcccagcgccgtggtgctgcagtgcggcgccgacagcctgagcggcgacagactgggctgcttcaacctgaccgtgaagggccacgccaagtgcgtggaggtggtgaagaccttcaacctgcccctgctgatgctgggcggcggcggctacaccatcagaaacgtggccagatgctggacctacgagaccgccgtggccctggactgcgagatccccaacgagctgccctacaacgactacttcgagtacttcggccccgacttcaagctgcacatcagccccagcaacatgaccaaccagaacacccccgagtacatggagaagatcaagcagagactgttcgagaacctgagaatgctgccccacgcccccggcgtgcagatgcaggccatccccgaggacgccgtgcacgaggacagcggcgacgaggacggcgaggaccccgacaagagaatcagcatcagagccagcgacaagagaatcgcctgcgacgaggagttcagcgacagcgaggacgagggcgagggcggcagaagaaacgtggccgaccacaagaagggcgccaagaaggccagaatcgaggaggacaagaaggagaccgaggacaagaagaccgacgtgaaggaggaggacaagagcaaggacaacagcggcgagaagaccgacaccaagggcaccaagagcgagcagctgagcaacccctag

SEQ ID NO: 10959 - DNA, 1467 bp, Artificial Sequence
  Description of Artificial Sequence: Synthetic coding sequence
atggcctacagccagggcggcggcaagaagaaggtgtgctactactacgacggcgacatcggcaactactactacggccagggccaccccatgaagccccacagaatcagaatgacccacaacctgctgctgaactacggcctgtacagaaagatggagatctacagaccccacaaggccaccgccgaggagatgaccaagtaccacagcgacgagtacatcaagttcctgagaagcatcagacccgacaacatgagcgagtacagcaagcagatgcagagattcaacgtgggcgaggactgccccgtgttcgacggcctgttcgagttctgccagctgagcaccggcggcagcgtggccggcgccgtgaagctgaacagacagcagaccgacatggccgtgaactgggccggcggcctgcaccacgccaagaagagcgaggccagcggcttctgctacgtgaacgacatcgtgctggccatcctggagctgctgaagtaccaccagagagtgctgtacatcgacatcgacatccaccacggcgacggcgtggaggaggccttctacaccaccgacagagtgatgaccgtgagcttccacaagtacggcgagtacttccccggcaccggcgacctgagagacatcggcgccggcaagggcaagtactacgccgtgaacttccccatgagagacggcatcgacgacgagagctacggccagatcttcaagcccatcatcagcaaggtgatggagatgtaccagcccagcgccgtggtgctgcagtgcggcgccgacagcctgagcggcgacagactgggctgcttcaacctgaccgtgaagggccacgccaagtgcgtggaggtggtgaagaccttcaacctgcccctgctgatgctgggcggcggcggctacaccatcagaaacgtggccagatgctggacctacgagaccgccgtggccctggactgcgagatccccaacgagctgccctacaacgactacttcgagtacttcggccccgacttcaagctgcacatcagccccagcaacatgaccaaccagaacacccccgagtacatggagaagatcaagcagagactgttcgagaacctgagaatgctgccccacgcccccggcgtgcagatgcaggccatccccgaggacgccgtgcacgaggacagcggcgacgaggacggcgaggaccccgacaagagaatcagcatcagagccagcgacaagagaatcgcctgcgacgaggagttcagcgacagcgaggacgagggcgagggcggcagaagaaacgtggccgaccacaagaagggcgccaagaaggccagaatcgaggaggacaagaaggagaccgaggacaagaagaccgacgtgaaggaggaggacaagagcaaggacaacagcggcgagaagaccgacaccaagggcaccaagagcgagcagctgagcaacccctag

SEQ ID NO: 10960 - DNA, 1377 bp, Artificial Sequence; identical to SEQ ID NO: 10957
  Description of Artificial Sequence: Synthetic coding sequence

SEQ ID NO: 10961 - DNA, 1287 bp, Artificial Sequence
  Description of Artificial Sequence: Synthetic coding sequence
atggccaagaccgtggcctacttctacgaccccgacgtgggcaacttccactacggcgccggccaccccatgaagccccacagactggccctgacccacagcctggtgctgcactacggcctgtacaagaagatgatcgtgttcaagccctaccaggccagccagcacgacatgtgcagattccacagcgaggactacatcgacttcctgcagagagtgagccccaccaacatgcagggcttcaccaagagcctgaacgccttcaacgtgggcgacgactgccccgtgttccccggcctgttcgagttctgcagcagatacaccggcgccagcctgcagggcgccacccagctgaacaacaagatctgcgacatcgccatcaactgggccggcggcctgcaccacgccaagaagttcgaggccagcggcttctgctacgtgaacgacatcgtgatcggcatcctggagctgctgaagtaccaccccagagtgctgtacatcgacatcgacatccaccacggcgacggcgtgcaggaggccttctacctgaccgacagagtgatgaccgtgagcttccacaagtacggcaactacttcttccccggcaccggcgacatgtacgaggtgggcgccgagagcggcagatactactgcctgaacgtgcccctgagagacggcatcgacgaccagagctacaagcacctgttccagcccgtgatcaaccaggtggtggacttctaccagcccacctgcatcgtgctgcagtgcggcgccgacagcctgggctgcgacagactgggctgcttcaacctgagcatcagaggccacggcgagtgcgtggagtacgtgaagagcttcaacatccccctgctggtgctgggcggcggcggctacaccgtgagaaacgtggccagatgctggacctacgagaccagcctgctggtggaggaggccatcagcgaggagctgccctacagcgagtacttcgagtacttcgcccccgacttcaccctgcaccccgacgtgagcaccagaatcgagaaccagaacagcagacagtacctggaccagatcagacagaccatcttcgagaacctgaagatgctgaaccacgcccccagcgtgcagatccacgacgtgcccgccgacctgctgacctacgacagaaccgacgaggccgacgccgaggagagaggccccgaggagaactacagcagacccgaggcccccaacgagttctacgacggcgaccacgacaacgacaaggagagcgacgtggagatctag

SEQ ID NO: 10962 - DNA, 3255 bp, Artificial Sequence
  Description of Artificial Sequence: Synthetic coding sequence
atgagcagccagagccaccccgacggcctgagcggcagagaccagcccgtggagctgctgaaccccgccagagtgaaccacatgcccagcaccgtggacgtggccaccgccctgcccctgcaggtggcccccagcgccgtgcccatggacctgagactggaccaccagttcagcctgcccgtggccgagcccgccctgagagagcagcagctgcagcaggagctgctggccctgaagcagaagcagcagatccagagacagatcctgatcgccgagttccagagacagcacgagcagctgagcagacagcacgaggcccagctgcacgagcacatcaagcagcagcaggagatgctggccatgaagcaccagcaggagctgctggagcaccagagaaagctggagagacacagacaggagcaggagctggagaagcagcacagagagcagaagctgcagcagctgaagaacaaggagaagggcaaggagagcgccgtggccagcaccgaggtgaagatgaagctgcaggagttcgtgctgaacaagaagaaggccctggcccacagaaacctgaaccactgcatcagcagcgaccccagatactggtacggcaagacccagcacagcagcctggaccagagcagccccccccagagcggcgtgagcaccagctacaaccaccccgtgctgggcatgtacgacgccaaggacgacttccccctgagaaagaccgccagcgagcccaacctgaagctgagaagcagactgaagcagaaggtggccgagagaagaagcagccccctgctgagaagaaaggacggccccgtggtgaccgccctgaagaagagacccctggacgtgaccgacagcgcctgcagcagcgcccccggcagcggccccagcagccccaacaacagcagcggcagcgtgagcgccgagaacggcatcgcccccgccgtgcccagcatccccgccgagaccagcctggcccacagactggtggccagagagggcagcgccgcccccctgcccctgtacaccagccccagcctgcccaacatcaccctgggcctgcccgccaccggccccagcgccggcaccgccggccagcaggacgccgagagactgaccctgcccgccctgcagcagagactgagcctgttccccggcacccacctgaccccctacctgagcaccagccccctggagagagacggcggcgccgcccacagccccctgctgcagcacatggtgctgctggagcagccccccgcccaggcccccctggtgaccggcctgggcgccctgcccctgcacgcccagagcctggtgggcgccgacagagtgagccccagcatccacaagctgagacagcacagacccctgggcagaacccagagcgcccccctgccccagaacgcccaggccctgcagcacctggtgatccagcagcagcaccagcagttcctggagaagcacaagcagcagttccagcagcagcagctgcagatgaacaagatcatccccaagcccagcgagcccgccagacagcccgagagccaccccgaggagaccgaggaggagctgagagagcaccaggccctgctggacgagccctacctggacagactgcccggccagaaggaggcccacgcccaggccggcgtgcaggtgaagcaggagcccatcgagagcgacgaggaggaggccgagccccccagagaggtggagcccggccagagacagcccagcgagcaggagctgctgttcagacagcaggccctgctgctggagcagcagagaatccaccagctgagaaactaccaggccagcatggaggccgccggcatccccgtgagcttcggcggccacagacccctgagcagagcccagagcagccccgccagcgccaccttccccgtgagcgtgcaggagccccccaccaagcccagattcaccaccggcctggtgtacgacaccctgatgctgaagcaccagtgcacctgcggcagcagcagcagccaccccgagcacgccggcagaatccagagcatctggagcagactgcaggagaccggcctgagaggcaagtgcgagtgcatcagaggcagaaaggccaccctggaggagctgcagaccgtgcacagcgaggcccacaccctgctgtacggcaccaaccccctgaacagacagaagctggacagcaagaagctgctgggcagcctggccagcgtgttcgtgagactgccctgcggcggcgtgggcgtggacagcgacaccatctggaacgaggtgcacagcgccggcgccgccagactggccgtgggctgcgtggtggagctggtgttcaaggtggccaccggcgagctgaagaacggcttcgccgtggtgagaccccccggccaccacgccgaggagagcacccccatgggcttctgctacttcaacagcgtggccgtggccgccaagctgctgcagcagagactgagcgtgagcaagatcctgatcgtggactgggacgtgcaccacggcaacggcacccagcaggccttctacagcgaccccagcgtgctgtacatgagcctgcacagatacgacgacggcaacttcttccccggcagcggcgcccccgacgaggtgggcaccggccccggcgtgggcttcaacgtgaacatggccttcaccggcggcctggacccccccatgggcgacgccgagtacctggccgccttcagaaccgtggtgatgcccatcgccagcgagttcgcccccgacgtggtgctggtgagcagcggcttcgacgccgtggagggccaccccacccccctgggcggctacaacctgagcgccagatgcttcggctacctgaccaagcagctgatgggcctggccggcggcagaatcgtgctggccctggagggcggccacgacctgaccgccatctgcgacgccagcgaggcctgcgtgagcgccctgctgggcaacgagctggaccccctgcccgagaaggtgctgcagcagagacccaacgccaacgccgtgagaagcatggagaaggtgatggagatccacagcaagtactggagatgcctgcagagaaccaccagcaccgccggcagaagcctgatcgaggcccagacctgcgagaacgaggaggccgagaccgtgaccgccatggccagcctgagcgtgggcgtgaagcccgccgagaagagacccgacgaggagcccatggaggaggagccccccctgtag

SEQ ID NO: 10963 - DNA, 1941 bp, Artificial Sequence
  Description of Artificial Sequence: Synthetic coding sequence
atgctggccatgaagcaccagcaggagctgctggagcaccagagaaagctggagagacacagacaggagcaggagctggagaagcagcacagagagcagaagctgcagcagctgaagaacaaggagaagggcaaggagagcgccgtggccagcaccgaggtgaagatgaagctgcaggagttcgtgctgaacaagaagaaggccctggcccacagaaacctgaaccactgcatcagcagcgaccccagatactggtacggcaagacccagcacagcagcctggaccagagcagccccccccagagcggcgtgagcaccagctacaaccaccccgtgctgggcatgtacgacgccaaggacgacttccccctgagaaagaccgccagcgagcccaacctgaagctgagaagcagactgaagcagaaggtggccgagagaagaagcagccccctgctgagaagaaaggacggccccgtggtgaccgccctgaagaagagacccctggacgtgaccgacagcgcctgcagcagcgcccccggcagcggccccagcagccccaacaacagcagcggcagcgtgagcgccgagaacggcatcgcccccgccgtgcccagcatccccgccgagaccagcctggcccacagactggtggccagagagggcagcgccgcccccctgcccctgtacaccagccccagcctgcccaacatcaccctgggcctgcccgccaccggccccagcgccggcaccgccggccagcaggacgccgagagactgaccctgcccgccctgcagcagagactgagcctgttccccggcacccacctgaccccctacctgagcaccagccccctggagagagacggcggcgccgcccacagccccctgctgcagcacatggtgctgctggagcagccccccgcccaggcccccctggtgaccggcctgggcgccctgcccctgcacgcccagagcctggtgggcgccgacagagtgagccccagcatccacaagctgagacagcacagacccctgggcagaacccagagcgcccccctgccccagaacgcccaggccctgcagcacctggtgatccagcagcagcaccagcagttcctggagaagcacaagcagcagttccagcagcagcagctgcagatgaacaagatcatccccaagcccagcgagcccgccagacagcccgagagccaccccgaggagaccgaggaggagctgagagagcaccaggccctgctggacgagccctacctggacagactgcccggccagaaggaggcccacgcccaggccggcgtgcaggtgaagcaggagcccatcgagagcgacgaggaggaggccgagccccccagagaggtggagcccggccagagacagcccagcgagcaggagctgctgttcagacagcaggccctgctgctggagcagcagagaatccaccagctgagaaactaccaggccagcatggaggccgccggcatccccgtgagcttcggcggccacagacccctgagcagagcccagagcagccccgccagcgccaccttccccgtgagcgtgcaggagccccccaccaagcccagattcaccaccggcctggtgtacgacaccctgatgctgaagcaccagtgcacctgcggcagcagcagcagccaccccgagcacgccggcagaatccagagcatctggagcagactgcaggagaccggcctgagaggcaagtgcgagtgcatcagaggcagaaaggccaccctggaggagctgcagaccgtgcacagcgaggcccacaccctgctgtacggcaccaaccccctgaacagacagaagctggacagcaagaagctgctgggcagcctggccagcgtgttcgtgagactgccctgcggcggcgtgggcgtgagcgtgcccctgatgtgcaagtag

SEQ ID NO: 10964 - DNA, 2919 bp, Artificial Sequence
  Description of Artificial Sequence: Synthetic coding sequence
atgctggccatgaagcaccagcaggagctgctggagcaccagagaaagctggagagacacagacaggagcaggagctggagaagcagcacagagagcagaagctgcagcagctgaagaacaaggagaagggcaaggagagcgccgtggccagcaccgaggtgaagatgaagctgcaggagttcgtgctgaacaagaagaaggccctggcccacagaaacctgaaccactgcatcagcagcgaccccagatactggtacggcaagacccagcacagcagcctggaccagagcagccccccccagagcggcgtgagcaccagctacaaccaccccgtgctgggcatgtacgacgccaaggacgacttccccctgagaaagaccgccagcgagcccaacctgaagctgagaagcagactgaagcagaaggtggccgagagaagaagcagccccctgctgagaagaaaggacggccccgtggtgaccgccctgaagaagagacccctggacgtgaccgacagcgcctgcagcagcgcccccggcagcggccccagcagccccaacaacagcagcggcagcgtgagcgccgagaacggcatcgcccccgccgtgcccagcatccccgccgagaccagcctggcccacagactggtggccagagagggcagcgccgcccccctgcccctgtacaccagccccagcctgcccaacatcaccctgggcctgcccgccaccggccccagcgccggcaccgccggccagcaggacgccgagagactgaccctgcccgccctgcagcagagactgagcctgttccccggcacccacctgaccccctacctgagcaccagccccctggagagagacggcggcgccgcccacagccccctgctgcagcacatggtgctgctggagcagccccccgcccaggcccccctggtgaccgactggtacctgagcggcctgggcgccctgcccctgcacgcccagagcctggtgggcgccgacagagtgagccccagcatccacaagctgagacagcacagacccctgggcagaacccagagcgcccccctgccccagaacgcccaggccctgcagcacctggtgatccagcagcagcaccagcagttcctggagaagcacaagcagcagttccagcagcagcagctgcagatgaacaagatcatccccaagcccagcgagcccgccagacagcccgagagccaccccgaggagaccgaggaggagctgagagagcaccaggccctgctggacgagccctacctggacagactgcccggccagaaggaggcccacgcccaggccggcgtgcaggtgaagcaggagcccatcgagagcgacgaggaggaggccgagccccccagagaggtggagcccggccagagacagcccagcgagcaggagctgctgttcagacagcaggccctgctgctggagcagcagagaatccaccagctgagaaactaccaggccagcatggaggccgccggcatccccgtgagcttcggcggccacagacccctgagcagagcccagagcagccccgccagcgccaccttccccgtgagcgtgcaggagccccccaccaagcccagattcaccaccggcctggtgtacgacaccctgatgctgaagcaccagtgcacctgcggcagcagcagcagccaccccgagcacgccggcagaatccagagcatctggagcagactgcaggagaccggcctgagaggcaagtgcgagtgcatcagaggcagaaaggccaccctggaggagctgcagaccgtgcacagcgaggcccacaccctgctgtacggcaccaaccccctgaacagacagaagctggacagcaagaagctgctgggcagcctggccagcgtgttcgtgagactgccctgcggcggcgtgggcgtggacagcgacaccatctggaacgaggtgcacagcgccggcgccgccagactggccgtgggctgcgtggtggagctggtgttcaaggtggccaccggcgagctgaagaacggcttcgccgtggtgagaccccccggccaccacgccgaggagagcacccccatgggcttctgctacttcaacagcgtggccgtggccgccaagctgctgcagcagagactgagcgtgagcaagatcctgatcgtggactgggacgtgcaccacggcaacggcacccagcaggccttctacagcgaccccagcgtgctgtacatgagcctgcacagatacgacgacggcaacttcttccccggcagcggcgcccccgacgaggtgggcaccggccccggcgtgggcttcaacgtgaacatggccttcaccggcggcctggacccccccatgggcgacgccgagtacctggccgccttcagaaccgtggtgatgcccatcgccagcgagttcgcccccgacgtggtgctggtgagcagcggcttcgacgccgtggagggccaccccacccccctgggcggctacaacctgagcgccagatgcttcggctacctgaccaagcagctgatgggcctggccggcggcagaatcgtgctggccctggagggcggccacgacctgaccgccatctgcgacgccagcgaggcctgcgtgagcgccctgctgggcaacgagctggaccccctgcccgagaaggtgctgcagcagagacccaacgccaacgccgtgagaagcatggagaaggtgatggagatccacagcaagtactggagatgcctgcagagaaccaccagcaccgccggcagaagcctgatcgaggcccagacctgcgagaacgaggaggccgagaccgtgaccgccatggccagcctgagcgtgggcgtgaagcccgccgagaagagacccgacgaggagcccatggaggaggagccccccctgtag

SEQ ID NO: 10965 - DNA, 2214 bp, Artificial Sequence
  Description of Artificial Sequence: Synthetic coding sequence
atggacgtggccaccgccctgcccctgcaggtggcccccagcgccgtgcccatggacctgagactggaccaccagttcagcctgcccgtggccgagcccgccctgagagagcagcagctgcagcaggagctgctggccctgaagcagaagcagcagatccagagacagatcctgatcgccgagttccagagacagcacgagcagctgagcagacagcacgaggcccagctgcacgagcacatcaagcagcagcaggagatgctggccatgaagcaccagcaggagctgctggagcaccagagaaagctggagagacacagacaggagcaggagctggagaagcagcacagagagcagaagctgcagcagctgaagaacaaggagaagggcaaggagagcgccgtggccagcaccgaggtgaagatgaagctgcaggagttcgtgctgaacaagaagaaggccctggcccacagaaacctgaaccactgcatcagcagcgaccccagatactggtacggcaagacccagcacagcagcctggaccagagcagccccccccagagcggcgtgagcaccagctacaaccaccccgtgctgggcatgtacgacgccaaggacgacttccccctgagaaagaccgccagcgagcccaacctgaagctgagaagcagactgaagcagaaggtggccgagagaagaagcagccccctgctgagaagaaaggacggccccgtggtgaccgccctgaagaagagacccctggacgtgaccgacagcgcctgcagcagcgcccccggcagcggccccagcagccccaacaacagcagcggcagcgtgagcgccgagaacggcatcgcccccgccgtgcccagcatccccgccgagaccagcctggcccacagactggtggccagagagggcagcgccgcccccctgcccctgtacaccagccccagcctgcccaacatcaccctgggcctgcccgccaccggccccagcgccggcaccgccggccagcaggacgccgagagactgaccctgcccgccctgcagcagagactgagcctgttccccggcacccacctgaccccctacctgagcaccagccccctggagagagacggcggcgccgcccacagccccctgctgcagcacatggtgctgctggagcagccccccgcccaggcccccctggtgaccgactggtacctgagcggcctgggcgccctgcccctgcacgcccagagcctggtgggcgccgacagagtgagccccagcatccacaagctgagacagcacagacccctgggcagaacccagagcgcccccctgccccagaacgcccaggccctgcagcacctggtgatccagcagcagcaccagcagttcctggagaagcacaagcagcagttccagcagcagcagctgcagatgaacaagatcatccccaagcccagcgagcccgccagacagcccgagagccaccccgaggagaccgaggaggagctgagagagcaccaggccctgctggacgagccctacctggacagactgcccggccagaaggaggcccacgcccaggccggcgtgcaggtgaagcaggagcccatcgagagcgacgaggaggaggccgagccccccagagaggtggagcccggccagagacagcccagcgagcaggagctgctgttcagacagcaggccctgctgctggagcagcagagaatccaccagctgagaaactaccaggccagcatggaggccgccggcatccccgtgagcttcggcggccacagacccctgagcagagcccagagcagccccgccagcgccaccttccccgtgagcgtgcaggagccccccaccaagcccagattcaccaccggcctggtgtacgacaccctgatgctgaagcaccagtgcacctgcggcagcagcagcagccaccccgagcacgccggcagaatccagagcatctggagcagactgcaggagaccggcctgagaggcaagtgcgagtgcatcagaggcagaaaggccaccctggaggagctgcagaccgtgcacagcgaggcccacaccctgctgtacggcaccaaccccctgaacagacagaagctggacagcaagaagctgctgggcagcctggccagcgtgttcgtgagactgccctgcggcggcgtgggcgtgagcgtgcccctgatgtgcaagtag

SEQ ID NO: 10966 - DNA, 2007 bp, Artificial Sequence
  Description of Artificial Sequence: Synthetic coding sequence
atggtgctgctggagcagccccccgcccaggcccccctggtgaccggcctgggcgccctgcccctgcacgcccagagcctggtgggcgccgacagagtgagccccagcatccacaagctgagacagcacagacccctgggcagaacccagagcgcccccctgccccagaacgcccaggccctgcagcacctggtgatccagcagcagcaccagcagttcctggagaagcacaagcagcagttccagcagcagcagctgcagatgaacaagatcatccccaagcccagcgagcccgccagacagcccgagagccaccccgaggagaccgaggaggagctgagagagcaccaggccctgctggacgagccctacctggacagactgcccggccagaaggaggcccacgcccaggccggcgtgcaggtgaagcaggagcccatcgagagcgacgaggaggaggccgagccccccagagaggtggagcccggccagagacagcccagcgagcaggagctgctgttcagacagcaggccctgctgctggagcagcagagaatccaccagctgagaaactaccaggccagcatggaggccgccggcatccccgtgagcttcggcggccacagacccctgagcagagcccagagcagccccgccagcgccaccttccccgtgagcgtgcaggagccccccaccaagcccagattcaccaccggcctggtgtacgacaccctgatgctgaagcaccagtgcacctgcggcagcagcagcagccaccccgagcacgccggcagaatccagagcatctggagcagactgcaggagaccggcctgagaggcaagtgcgagtgcatcagaggcagaaaggccaccctggaggagctgcagaccgtgcacagcgaggcccacaccctgctgtacggcaccaaccccctgaacagacagaagctggacagcaagaagctgctgggcagcctggccagcgtgttcgtgagactgccctgcggcggcgtgggcgtggacagcgacaccatctggaacgaggtgcacagcgccggcgccgccagactggccgtgggctgcgtggtggagctggtgttcaaggtggccaccggcgagctgaagaacggcttcgccgtggtgagaccccccggccaccacgccgaggagagcacccccatgggcttctgctacttcaacagcgtggccgtggccgccaagctgctgcagcagagactgagcgtgagcaagatcctgatcgtggactgggacgtgcaccacggcaacggcacccagcaggccttctacagcgaccccagcgtgctgtacatgagcctgcacagatacgacgacggcaacttcttccccggcagcggcgcccccgacgaggtgggcaccggccccggcgtgggcttcaacgtgaacatggccttcaccggcggcctggacccccccatgggcgacgccgagtacctggccgccttcagaaccgtggtgatgcccatcgccagcgagttcgcccccgacgtggtgctggtgagcagcggcttcgacgccgtggagggccaccccacccccctgggcggctacaacctgagcgccagatgcttcggctacctgaccaagcagctgatgggcctggccggcggcagaatcgtgctggccctggagggcggccacgacctgaccgccatctgcgacgccagcgaggcctgcgtgagcgccctgctgggcaacgagctggaccccctgcccgagaaggtgctgcagcagagacccaacgccaacgccgtgagaagcatggagaaggtgatggagatccacagcaagtactggagatgcctgcagagaaccaccagcaccgccggcagaagcctgatcgaggcccagacctgcgagaacgaggaggccgagaccgtgaccgccatggccagcctgagcgtgggcgtgaagcccgccgagaagagacccgacgaggagcccatggaggaggagccccccctgtag

SEQ ID NO: 10967 - DNA, 90 bp, Artificial Sequence
  Description of Artificial Sequence: Synthetic coding sequence
atgagcagccagagccaccccgacggcctgagcggcagagaccagcccgtggagctgctgaaccccgccagagtgaaccacatgccctag

SEQ ID NO: 10968 - DNA, 3648 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatcagaccccccggccaccacgcccagcacagcctgatggacggctactgcatgttcaaccacgtggccgtggccgccagatacgcccagcagaagcacagaatcagaagagtgctgatcgtggactgggacgtgcaccacggccagggcacccagttcaccttcgaccaggaccccagcgtgctgtacttcagcatccacagatacgagcagggcagattctggccccacctgaaggccagcaactggagcaccaccggcttcggccagggccagggctacaccatcaacgtgccctggaaccaggtgggcatgagagacgccgactacatcgccgccttcctgcacgtgctgctgcccgtggccctggagttccagccccagctggtgctggtggccgccggcttcgacgccctgcagggcgaccccaagggcgagatggccgccacccccgccggcttcgcccagctgacccacctgctgatgggcctggccggcggcaagctgatcctgagcctggagggcggctacaacctgagagccctggccgagggcgtgagcgccagcctgcacaccctgctgggcgacccctgccccatgctggagagccccggcgccccctgcagaagcgcccaggccagcgtgagctgcgccctggaggccctggagcccttctgggaggtgctggtgagaagcaccgagaccgtggagagagacaacatggaggaggacaacgtggaggagagcgaggaggagggcccctgggagccccccgtgctgcccatcctgacctggcccgtgctgcagagcagaaccggcctggtgtacgaccagaacatgatgaaccactgcaacctgtgggacagccaccaccccgaggtgccccagagaatcctgagaatcatgtgcagactggaggagctgggcctggccggcagatgcctgaccctgacccccagacccgccaccgaggccgagctgctgacctgccacagcgccgagtacgtgggccacctgagagccaccgagaagatgaagaccagagagctgcacagagagagcagcaacttcgacagcatctacatctgccccagcaccttcgcctgcgcccagctggccaccggcgccgcctgcagactggtggaggccgtgctgagcggcgaggtgctgaacggcgccgccgtggtgagaccccccggccaccacgccgagcaggacgccgcctgcggcttctgcttcttcaacagcgtggccgtggccgccagacacgcccagaccatcagcggccacgccctgagaatcctgatcgtggactgggacgtgcaccacggcaacggcacccagcacatgttcgaggacgaccccagcgtgctgtacgtgagcctgcacagatacgaccacggcaccttcttccccatgggcgacgagggcgccagcagccagatcggcagagccgccggcaccggcttcaccgtgaacgtggcctggaacggccccagaatgggcgacgccgactacctggccgcctggcacagactggtgctgcccatcgcctacgagttcaaccccgagctggtgctggtgagcgccggcttcgacgccgccagaggcgaccccctgggcggctgccaggtgagccccgagggctacgcccacctgacccacctgctgatgggcctggccagcggcagaatcatcctgatcctggagggcggctacaacctgaccagcatcagcgagagcatggccgcctgcaccagaagcctgctgggcgaccccccccccctgctgaccctgcccagaccccccctgagcggcgccctggccagcatcaccgagaccatccaggtgcacagaagatactggagaagcctgagagtgatgaaggtggaggacagagagggccccagcagcagcaagctggtgaccaagaaggccccccagcccgccaagcccagactggccgagagaatgaccaccagagagaagaaggtgctggaggccggcatgggcaaggtgaccagcgccagcttcggcgaggagagcacccccggccagaccaacagcgagaccgccgtggtggccctgacccaggaccagcccagcgaggccgccaccggcggcgccaccctggcccagaccatcagcgaggccgccatcggcggcgccatgctgggccagaccaccagcgaggaggccgtgggcggcgccacccccgaccagaccaccagcgaggagaccgtgggcggcgccatcctggaccagaccaccagcgaggacgccgtgggcggcgccaccctgggccagaccaccagcgaggaggccgtgggcggcgccaccctggcccagaccaccagcgaggccgccatggagggcgccaccctggaccagaccaccagcgaggaggcccccggcggcaccgagctgatccagacccccctggccagcagcaccgaccaccagaccccccccaccagccccgtgcagggcaccaccccccagatcagccccagcaccctgatcggcagcctgagaaccctggagctgggcagcgagagccagggcgccagcgagagccaggcccccggcgaggagaacctgctgggcgaggccgccggcggccaggacatggccgacagcatgctgatgcagggcagcagaggcctgaccgaccaggccatcttctacgccgtgacccccctgccctggtgcccccacctggtggccgtgtgccccatccccgccgccggcctggacgtgacccagccctgcggcgactgcggcaccatccaggagaactgggtgtgcctgagctgctaccaggtgtactgcggcagatacatcaacggccacatgctgcagcaccacggcaacagcggccaccccctggtgctgagctacatcgacctgagcgcctggtgctactactgccaggcctacgtgcaccaccaggccctgctggacgtgaagaacatcgcccaccagaacaagttcggcgaggacatgccccacccccactag

SEQ ID NO: 10969 - DNA, 633 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatctag

SEQ ID NO: 10970 - DNA, 3648 bp, Artificial Sequence; identical to SEQ ID NO: 10968
  Description of Artificial Sequence: Synthetic coding sequence

SEQ ID NO: 10971 - DNA, 633 bp, Artificial Sequence; identical to SEQ ID NO: 10969
  Description of Artificial Sequence: Synthetic coding sequence

SEQ ID NO: 10972 - DNA, 891 bp, Artificial Sequence
  Description of Artificial Sequence: Synthetic coding sequence
atgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatcagaccccccggccaccacgcccagcacagcctgatggacggctactgcatgttcaaccacgtggccgtggccgccagatacgcccagcagaagcacagaatcagaagagtgctgatcgtggactgggacgtgcaccacggccagggcacccagttcaccttcgaccaggaccccagcgtgctgtacttcagcatccacagatacgagcagggcagattctggccccacctgaaggccagcaactggagcaccaccggcttcggccagggccagggctacaccatcaacgtgccctggaaccaggtgggcatgagagacgccgactacatcgccgccttcctgcacgtgctgctgcccgtggccctggaggtgctgggcatctggggcgtgctgggcggcggcgtggccctgaaggtgagactgtag

SEQ ID NO: 10973 - DNA, 429 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgtag

SEQ ID NO: 10974 - DNA, 810 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatcagaccccccggccaccacgcccagcacagcctgatggacggctactgcatgttcaaccacgtggccgtggccgccagatacgcccagcagaagcacagaatcagaagagtgctgatcgtggactgggacgtgcaccacggccagggcacccagttcaccttcgaccaggaccccagatag

SEQ ID NO: 10975 - DNA, 2454 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatcagaccccccggccaccacgcccagcacagcctgatggacggctactgcatgttcaaccacgtggccgtggccgccagatacgcccagcagaagcacagaatcagaagagtgctgatcgtggactgggacgtgcaccacggccagggcacccagttcaccttcgaccaggaccccagcgtgctgtacttcagcatccacagatacgagcagggcagattctggccccacctgaaggccagcaactggagcaccaccggcttcggccagggccagggctacaccatcaacgtgccctggaaccaggtgggcatgagagacgccgactacatcgccgccttcctgcacgtgctgctgcccgtggccctggagttccagccccagctggtgctggtggccgccggcttcgacgccctgcagggcgaccccaagggcgagatggccgccacccccgccggcttcgcccagctgacccacctgctgatgggcctggccggcggcaagctgatcctgagcctggagggcggctacaacctgagagccctggccgagggcgtgagcgccagcctgcacaccctgctgggcgacccctgccccatgctggagagccccggcgccccctgcagaagcgcccaggccagcgtgagctgcgccctggaggccctggagcccttctgggaggtgctggtgagaagcaccgagaccgtggagagagacaacatggaggaggacaacgtggaggagagcgaggaggagggcccctgggagccccccgtgctgcccatcctgacctggcccgtgctgcagagcagaaccggcctggtgtacgaccagaacatgatgaaccactgcaacctgtgggacagccaccaccccgaggtgccccagagaatcctgagaatcatgtgcagactggaggagctgggcctggccggcagatgcctgaccctgacccccagacccgccaccgaggccgagctgctgacctgccacagcgccgagtacgtgggccacctgagagccaccgagaagatgaagaccagagagctgcacagagagagcagcaacttcgacagcatctacatctgccccagcaccttcgcctgcgcccagctggccaccggcgccgcctgcagactggtggaggccgtgctgagcggcgaggtgctgaacggcgccgccgtggtgagaccccccggccaccacgccgagcaggacgccgcctgcggcttctgcttcttcaacagcgtggccgtggccgccagacacgcccagaccatcagcggccacgccctgagaatcctgatcgtggactgggacgtgcaccacggcaacggcacccagcacatgttcgaggacgaccccagcgtgctgtacgtgagcctgcacagatacgaccacggcaccttcttccccatgggcgacgagggcgccagcagccagatcggcagagccgccggcaccggcttcaccgtgaacgtggcctggaacggccccagaatgggcgacgccgactacctggccgcctggcacagactggtgctgcccatcgcctacgagttcaaccccgagctggtgctggtgagcgccggcttcgacgccgccagaggcgaccccctgggcggctgccaggtgagccccgagggctacgcccacctgaccctgcccatcgcctgcctgagaggcaccaccacccccgcccagaaggagagaggcgccgcccagtggccccaggagggcgccgacatcatgagaatcaccctggccggcggcgagctgaccggcagacacggcaaggtggcctacgtgatcaagtacaagctgtag

SEQ ID NO: 10976 - DNA, 156 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagtag

SEQ ID NO: 10977 - DNA, 516 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctactag

SEQ ID NO: 10978 - DNA, 486 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagtag

SEQ ID NO: 10979 - DNA, 504 bp, Artificial Sequence
  Description of Artificial Sequence: Synthetic coding sequence
atgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctgtag

SEQ ID NO: 10980 - DNA, 3690 bp, Artificial Sequence
  Description of Artificial Sequence: Synthetic coding sequence
atgagcggcgccaacagaggcagaggccaggccagcagcaccatgaccagcaccggccaggacagcaccaccaccagacagagaagaagcagacagaacccccagagccccccccaggacagcagcgtgaccagcaagagaaacatcaagaagggcgccgtgcccagaagcatccccaacctggccgaggtgaagaagaagggcaagatgaagaagctgggccaggccatggaggaggacctgatcgtgggcctgcagggcatggacctgaacctggaggccgaggccctggccggcaccggcctggtgctggacgagcagctgaacgagttccactgcctgtgggacgacagcttccccgagggccccgagagactgcacgccatcaaggagcagctgatccaggagggcctgctggacagatgcgtgagcttccaggccagattcgccgagaaggaggagctgatgctggtgcacagcctggagtacatcgacctgatggagaccacccagtacatgaacgagggcgagctgagagtgctggccgacacctacgacagcgtgtacctgcaccccaacagctacagctgcgcctgcctggccagcggcagcgtgctgagactggtggacgccgtgctgggcgccgagatcagaaacggcatggccatcatcagaccccccggccaccacgcccagcacagcctgatggacggctactgcatgttcaaccacgtggccgtggccgccagatacgcccagcagaagcacagaatcagaagagtgctgatcgtggactgggacgtgcaccacggccagggcacccagttcaccttcgaccaggaccccagcgtgctgtacttcagcatccacagatacgagcagggcagattctggccccacctgaaggccagcaactggagcaccaccggcttcggccagggccagggctacaccatcaacgtgccctggaaccaggtgggcatgagagacgccgactacatcgccgccttcctgcacgtgctgctgcccgtggccctggagttccagccccagctggtgctggtggccgccggcttcgacgccctgcagggcgaccccaagggcgagatggccgccacccccgccggcttcgcccagctgacccacctgctgatgggcctggccggcggcaagctgatcctgagcctggagggcggctacaacctgagagccctggccgagggcgtgagcgccagcctgcacaccctgctgggcgacccctgccccatgctggagagccccggcgccccctgcagaagcgcccaggccagcgtgagctgcgccctggaggccctggagcccttctgggaggtgctggtgagaagcaccgagaccgtggagagagacaacatggaggaggacaacgtggaggagagcgaggaggagggcccctgggagccccccgtgctgcccatcctgacctggcccgtgctgcagagcagaaccggcctggtgtacgaccagaacatgatgaaccactgcaacctgtgggacagccaccaccccgaggtgccccagagaatcctgagaatcatgtgcagactggaggagctgggcctggccggcagatgcctgaccctgacccccagacccgccaccgaggccgagctgctgacctgccacagcgccgagtacgtgggccacctgagagccaccgagaagatgaagaccagagagctgcacagagagagcagcaacttcgacagcatctacatctgccccagcaccttcgcctgcgcccagctggccaccggcgccgcctgcagactggtggaggccgtgctgagcggcgaggtgctgaacggcgccgccgtggtgagaccccccggccaccacgccgagcaggacgccgcctgcggcttctgcttcttcaacagcgtggccgtggccgccagacacgcccagaccatcagcggccacgccctgagaatcctgatcgtggactgggacgtgcaccacggcaacggcacccagcacatgttcgaggacgaccccagcgtgctgtacgtgagcctgcacagatacgaccacggcaccttcttccccatgggcgacgagggcgccagcagccagatcggcagagccgccggcaccggcttcaccgtgaacgtggcctggaacggccccagaatgggcgacgccgactacctggccgcctggcacagactggtgctgcccatcgcctacgagttcaaccccgagctggtgctggtgagcgccggcttcgacgccgccagaggcgaccccctgggcggctgccaggtgagccccgagggctacgcccacctgacccacctgctgatgggcctggccagcggcagaatcatcctgatcctggagggcggctacaacctgaccagcatcagcgagagcatggccgcctgcaccagaagcctgctgggcgaccccccccccctgctgaccctgcccagaccccccctgagcggcgccctggccagcatcaccgagaccatccaggtgcacagaagatactggagaagcctgagagtgatgaaggtggaggacagagagggccccagcagcagcaagctggtgaccaagaaggccccccagcccgccaagcccagactggccgagagaatgaccaccagagagaagaaggtgctggaggccggcatgggcaaggtgaccagcgccagcttcggcgaggagagcacccccggccagaccaacagcgagaccgccgtggtggccctgacccaggaccagcccagcgaggccgccaccggcggcgccaccctggcccagaccatcagcgaggccgccatcggcggcgccatgctgggccagaccaccagcgaggaggccgtgggcggcgccacccccgaccagaccaccagcgaggagaccgtgggcggcgccatcctggaccagaccaccagcgaggacgccgtgggcggcgccaccctgggccagaccaccagcgaggaggccgtgggcggcgccaccctggcccagaccaccagcgaggccgccatggagggcgccaccctggaccagaccaccagcgaggaggcccccggcggcaccgagctgatccagacccccctggccagcagcaccgaccaccagaccccccccaccagccccgtgcagggcaccaccccccagatcagccccagcaccctgatcggcagcctgagaaccctggagctgggcagcgagagccagggcgccagcgagagccaggcccccggcgaggagaacctgctgggcgaggccgccggcggccaggacatggccgacagcatgctgatgcagggcagcagaggcctgaccgaccaggccatcttctacgccgtgacccccctgccctggtgcccccacctggtggccgtgtgccccatccccgccgccggcctggacgtgacccagccctgcggcgactgcggcaccatccaggagaactgggtgtgcctgagctgctaccaggtgtactgcggcagatacatcaacggccacatgctgcagcaccacggcaacagcggccaccccctggtgctgagctacatcgacctgagcgcctggtgctactactgccaggcctacgtgcaccaccaggccctgctggacgtgaagaacatcgcccaccagaacaagttcggcgaggacatgccccacccccactag

SEQ ID NO: 10981 - DNA, 2976 bp, Artificial Sequence
  Description of Artificial Sequence: Synthetic coding sequence
atgcacagccccggcgccgacggcacccaggtgagccccggcgcccactactgcagccccaccggcgccggctgccccagaccctgcgccgacacccccggcccccagccccagcccatggacctgagagtgggccagagaccccccgtggagcccccccccgagcccaccctgctggccctgcagagaccccagagactgcaccaccacctgttcctggccggcctgcagcagcagagaagcgtggagcccatgagactgagcatggacacccccatgcccgagctgcaggtgggcccccaggagcaggagctgagacagctgctgcacaaggacaagagcaagagaagcgccgtggccagcagcgtggtgaagcagaagctggccgaggtgatcctgaagaagcagcaggccgccctggagagaaccgtgcaccccaacagccccggcatcccctacagaaccctggagcccctggagaccgagggcgccaccagaagcatgctgagcagcttcctgccccccgtgcccagcctgcccagcgacccccccgagcacttccccctgagaaagaccgtgagcgagcccaacctgaagctgagatacaagcccaagaagagcctggagagaagaaagaaccccctgctgagaaaggagagcgccccccccagcctgagaagaagacccgccgagaccctgggcgacagcagccccagcagcagcagcacccccgccagcggctgcagcagccccaacgacagcgagcacggccccaaccccatcctgggcagcgaggccctgctgggccagagactgagactgcaggagaccagcgtggcccccttcgccctgcccaccgtgagcctgctgcccgccatcaccctgggcctgcccgcccccgccagagccgacagcgacagaagaacccaccccaccctgggccccagaggccccatcctgggcagcccccacacccccctgttcctgccccacggcctggagcccgaggccggcggcaccctgcccagcagactgcagcccatcctgctgctggaccccagcggcagccacgcccccctgctgaccgtgcccggcctgggccccctgcccttccacttcgcccagagcctgatgaccaccgagagactgagcggcagcggcctgcactggcccctgagcagaaccagaagcgagcccctgccccccagcgccaccgccccccccccccccggccccatgcagcccagactggagcagctgaagacccacgtgcaggtgatcaagagaagcgccaagcccagcgagaagcccagactgagacagatccccagcgccgaggacctggagaccgacggcggcggccccggccaggtggtggacgacggcctggagcacagagagctgggccacggccagcccgaggccagaggccccgcccccctgcagcagcacccccaggtgctgctgtgggagcagcagagactggccggcagactgcccagaggcagcaccggcgacaccgtgctgctgcccctggcccagggcggccacagacccctgagcagagcccagagcagccccgccgcccccgccagcctgagcgcccccgagcccgccagccaggccagagtgctgagcagcagcgagacccccgccagaaccctgcccttcaccaccggcctgatctacgacagcgtgatgctgaagcaccagtgcagctgcggcgacaacagcagacaccccgagcacgccggcagaatccagagcatctggagcagactgcaggagagaggcctgagaagccagtgcgagtgcctgagaggcagaaaggccagcctggaggagctgcagagcgtgcacagcgagagacacgtgctgctgtacggcaccaaccccctgagcagactgaagctggacaacggcaagctggccggcctgctggcccagagaatgttcgtgatgctgccctgcggcggcgtgggcgtggacaccgacaccatctggaacgagctgcacagcagcaacgccgccagatgggccgccggcagcgtgaccgacctggccttcaaggtggccagcagagagctgaagaacggcttcgccgtggtgagaccccccggccaccacgccgaccacagcaccgccatgggcttctgcttcttcaacagcgtggccatcgcctgcagacagctgcagcagcagagcaaggccagcaagatcctgatcgtggactgggacgtgcaccacggcaacggcacccagcagaccttctaccaggaccccagcgtgctgtacatcagcctgcacagacacgacgacggcaacttcttccccggcagcggcgccgtggacgaggtgggcgccggcagcggcgagggcttcaacgtgaacgtggcctgggccggcggcctggacccccccatgggcgaccccgagtacctggccgccttcagaatcgtggtgatgcccatcgccagagagttcagccccgacctggtgctggtgagcgccggcttcgacgccgccgagggccaccccgcccccctgggcggctaccacgtgagcgccaagtgcttcggctacatgacccagcagctgatgaacctggccggcggcgccgtggtgctggccctggagggcggccacgacctgaccgccatctgcgacgccagcgaggcctgcgtggccgccctgctgggcaacagagtggaccccctgagcgaggagggctggaagcagaagcccaacctgaacgccatcagaagcctggaggccgtgatcagagtgcacagcaagtactggggctgcatgcagagactggccagctgccccgacagctgggtgcccagagtgcccggcgccgacaaggaggaggtggaggccgtgaccgccctggccagcctgagcgtgggcatcctggccgaggacagacccagcgagcagctggtggaggaggaggagcccatgaacctgtag

SEQ ID NO: 10982 - DNA, 2865 bp, Artificial Sequence
  Description of Artificial Sequence: Synthetic coding sequence
atgcacagccccggcgccgacggcacccaggtgagccccggcgcccactactgcagccccaccggcgccggctgccccagaccctgcgccgacacccccggcccccagccccagcccatggacctgagagtgggccagagaccccccgtggagcccccccccgagcccaccctgctggccctgcagagaccccagagactgcaccaccacctgttcctggccggcctgcagcagcagagaagcgtggagcccatgagactgagcatggacacccccatgcccgagctgcaggtgggcccccaggagcaggagctgagacagctgctgcacaaggacaagagcaagagaagcgccgtggccagcagcgtggtgaagcagaagctggccgaggtgatcctgaagaagcagcaggccgccctggagagaaccgtgcaccccaacagccccggcatcccctacagaaccctggagcccctggagaccgagggcgccaccagaagcatgctgagcagcttcctgccccccgtgcccagcctgcccagcgacccccccgagcacttccccctgagaaagaccgtgagcgagcccaacctgaagctgagatacaagcccaagaagagcctggagagaagaaagaaccccctgctgagaaaggagagcgccccccccagcctgagaagaagacccgccgagaccctgggcgacagcagccccagcagcagcagcacccccgccagcggctgcagcagccccaacgacagcgagcacggccccaaccccatcctgggcagcgaggccgacagcgacagaagaacccaccccaccctgggccccagaggccccatcctgggcagcccccacacccccctgttcctgccccacggcctggagcccgaggccggcggcaccctgcccagcagactgcagcccatcctgctgctggaccccagcggcagccacgcccccctgctgaccgtgcccggcctgggccccctgcccttccacttcgcccagagcctgatgaccaccgagagactgagcggcagcggcctgcactggcccctgagcagaaccagaagcgagcccctgccccccagcgccaccgccccccccccccccggccccatgcagcccagactggagcagctgaagacccacgtgcaggtgatcaagagaagcgccaagcccagcgagaagcccagactgagacagatccccagcgccgaggacctggagaccgacggcggcggccccggccaggtggtggacgacggcctggagcacagagagctgggccacggccagcccgaggccagaggccccgcccccctgcagcagcacccccaggtgctgctgtgggagcagcagagactggccggcagactgcccagaggcagcaccggcgacaccgtgctgctgcccctggcccagggcggccacagacccctgagcagagcccagagcagccccgccgcccccgccagcctgagcgcccccgagcccgccagccaggccagagtgctgagcagcagcgagacccccgccagaaccctgcccttcaccaccggcctgatctacgacagcgtgatgctgaagcaccagtgcagctgcggcgacaacagcagacaccccgagcacgccggcagaatccagagcatctggagcagactgcaggagagaggcctgagaagccagtgcgagtgcctgagaggcagaaaggccagcctggaggagctgcagagcgtgcacagcgagagacacgtgctgctgtacggcaccaaccccctgagcagactgaagctggacaacggcaagctggccggcctgctggcccagagaatgttcgtgatgctgccctgcggcggcgtgggcgtggacaccgacaccatctggaacgagctgcacagcagcaacgccgccagatgggccgccggcagcgtgaccgacctggccttcaaggtggccagcagagagctgaagaacggcttcgccgtggtgagaccccccggccaccacgccgaccacagcaccgccatgggcttctgcttcttcaacagcgtggccatcgcctgcagacagctgcagcagcagagcaaggccagcaagatcctgatcgtggactgggacgtgcaccacggcaacggcacccagcagaccttctaccaggaccccagcgtgctgtacatcagcctgcacagacacgacgacggcaacttcttccccggcagcggcgccgtggacgaggtgggcgccggcagcggcgagggcttcaacgtgaacgtggcctgggccggcggcctggacccccccatgggcgaccccgagtacctggccgccttcagaatcgtggtgatgcccatcgccagagagttcagccccgacctggtgctggtgagcgccggcttcgacgccgccgagggccaccccgcccccctgggcggctaccacgtgagcgccaagtgcttcggctacatgacccagcagctgatgaacctggccggcggcgccgtggtgctggccctggagggcggccacgacctgaccgccatctgcgacgccagcgaggcctgcgtggccgccctgctgggcaacagagtggaccccctgagcgaggagggctggaagcagaagcccaacctgaacgccatcagaagcctggaggccgtgatcagagtgcacagcaagtactggggctgcatgcagagactggccagctgccccgacagctgggtgcccagagtgcccggcgccgacaaggaggaggtggaggccgtgaccgccctggccagcctgagcgtgggcatcctggccgaggacagacccagcgagcagctggtggaggaggaggagcccatgaacctgtag

SEQ ID NO: 10983 - DNA, 3045 bp, Artificial Sequence
  Description of Artificial Sequence: Synthetic coding sequence
atgagcgacctgagaaagagagagctgggcgccctgttcaccagcagaggcaccggcggcgtggagtgggacggcacccaggtgagccccggcgcccactactgcagccccaccggcgccggctgccccagaccctgcgccgacacccccggcccccagccccagcccatggacctgagagtgggccagagaccccccgtggagcccccccccgagcccaccctgctggccctgcagagaccccagagactgcaccaccacctgttcctggccggcctgcagcagcagagaagcgtggagcccatgagactgagcatggacacccccatgcccgagctgcaggtgggcccccaggagcaggagctgagacagctgctgcacaaggacaagagcaagagaagcgccgtggccagcagcgtggtgaagcagaagctggccgaggtgatcctgaagaagcagcaggccgccctggagagaaccgtgcaccccaacagccccggcatcccctacagaaccctggagcccctggagaccgagggcgccaccagaagcatgctgagcagcttcctgccccccgtgcccagcctgcccagcgacccccccgagcacttccccctgagaaagaccgtgagcgagcccaacctgaagctgagatacaagcccaagaagagcctggagagaagaaagaaccccctgctgagaaaggagagcgccccccccagcctgagaagaagacccgccgagaccctgggcgacagcagccccagcagcagcagcacccccgccagcggctgcagcagccccaacgacagcgagcacggccccaaccccatcctgggcagcgaggccctgctgggccagagactgagactgcaggagaccagcgtggcccccttcgccctgcccaccgtgagcctgctgcccgccatcaccctgggcctgcccgcccccgccagagccgacagcgacagaagaacccaccccaccctgggccccagaggccccatcctgggcagcccccacacccccctgttcctgccccacggcctggagcccgaggccggcggcaccctgcccagcagactgcagcccatcctgctgctggaccccagcggcagccacgcccccctgctgaccgtgcccggcctgggccccctgcccttccacttcgcccagagcctgatgaccaccgagagactgagcggcagcggcctgcactggcccctgagcagaaccagaagcgagcccctgccccccagcgccaccgccccccccccccccggccccatgcagcccagactggagcagctgaagacccacgtgcaggtgatcaagagaagcgccaagcccagcgagaagcccagactgagacagatccccagcgccgaggacctggagaccgacggcggcggccccggccaggtggtggacgacggcctggagcacagagagctgggccacggccagcccgaggccagaggccccgcccccctgcagcagcacccccaggtgctgctgtgggagcagcagagactggccggcagactgcccagaggcagcaccggcgacaccgtgctgctgcccctggcccagggcggccacagacccctgagcagagcccagagcagccccgccgcccccgccagcctgagcgcccccgagcccgccagccaggccagagtgctgagcagcagcgagacccccgccagaaccctgcccttcaccaccggcctgatctacgacagcgtgatgctgaagcaccagtgcagctgcggcgacaacagcagacaccccgagcacgccggcagaatccagagcatctggagcagactgcaggagagaggcctgagaagccagtgcgagtgcctgagaggcagaaaggccagcctggaggagctgcagagcgtgcacagcgagagacacgtgctgctgtacggcaccaaccccctgagcagactgaagctggacaacggcaagctggccggcctgctggcccagagaatgttcgtgatgctgccctgcggcggcgtgggcgtggacaccgacaccatctggaacgagctgcacagcagcaacgccgccagatgggccgccggcagcgtgaccgacctggccttcaaggtggccagcagagagctgaagaacggcttcgccgtggtgagaccccccggccaccacgccgaccacagcaccgccatgggcttctgcttcttcaacagcgtggccatcgcctgcagacagctgcagcagcagagcaaggccagcaagatcctgatcgtggactgggacgtgcaccacggcaacggcacccagcagaccttctaccaggaccccagcgtgctgtacatcagcctgcacagacacgacgacggcaacttcttccccggcagcggcgccgtggacgaggtgggcgccggcagcggcgagggcttcaacgtgaacgtggcctgggccggcggcctggacccccccatgggcgaccccgagtacctggccgccttcagaatcgtggtgatgcccatcgccagagagttcagccccgacctggtgctggtgagcgccggcttcgacgccgccgagggccaccccgcccccctgggcggctaccacgtgagcgccaagtgcttcggctacatgacccagcagctgatgaacctggccggcggcgccgtggtgctggccctggagggcggccacgacctgaccgccatctgcgacgccagcgaggcctgcgtggccgccctgctgggcaacagagtggaccccctgagcgaggagggctggaagcagaagcccaacctgaacgccatcagaagcctggaggccgtgatcagagtgcacatgggcgccctgaccctgagccagatccccggccacggcagcagccagcagcaggccggcggcgccttcagctggcccggccacccctgcagagccgccgtggtgatggtgaacaccggcgccgcctgcagcgcctggccccccgtgcagacccccggctgcctggagtgccagggcctgaccaagaagaagtggagacagtag

SEQ ID NO: 10984 - DNA, 402 bp, Artificial Sequence
  Description of Artificial Sequence: Synthetic coding sequence
atgcacagccccggcgccggctgccccagaccctgcgccgacacccccggcccccagccccagcccatggacctgagagtgggccagagaccccccgtggagcccccccccgagcccaccctgctggccctgcagagaccccagagactgcaccaccacctgttcctggccggcctgcagcagcagagaagcgtggagcccatgagactgagcatggacacccccatgcccgagctgcaggtgggcccccaggagcaggagctgagacagctgctgcacaaggacaagagcaagagaagcgccgtggccagcagcgtggtgaagcagaagctggccgaggtgatcctgaagaagcagcaggccgccctggagagaaccgtgcaccccaacagccccggctag

SEQ ID NO: 10985 - DNA, 2859 bp, Artificial Sequence
  Description of Artificial Sequence: Synthetic coding sequence
atggacctgagagtgggccagagaccccccgtggagcccccccccgagcccaccctgctggccctgcagagaccccagagactgcaccaccacctgttcctggccggcctgcagcagcagagaagcgtggagcccatgagactgagcatggacacccccatgcccgagctgcaggtgggcccccaggagcaggagctgagacagctgctgcacaaggacaagagcaagagaagcgccgtggccagcagcgtggtgaagcagaagctggccgaggtgatcctgaagaagcagcaggccgccctggagagaaccgtgcaccccaacagccccggcatcccctacagaaccctggagcccctggagaccgagggcgccaccagaagcatgctgagcagcttcctgccccccgtgcccagcctgcccagcgacccccccgagcacttccccctgagaaagaccgtgagcgagcccaacctgaagctgagatacaagcccaagaagagcctggagagaagaaagaaccccctgctgagaaaggagagcgccccccccagcctgagaagaagacccgccgagaccctgggcgacagcagccccagcagcagcagcacccccgccagcggctgcagcagccccaacgacagcgagcacggccccaaccccatcctgggcagcgaggccctgctgggccagagactgagactgcaggagaccagcgtggcccccttcgccctgcccaccgtgagcctgctgcccgccatcaccctgggcctgcccgcccccgccagagccgacagcgacagaagaacccaccccaccctgggccccagaggccccatcctgggcagcccccacacccccctgttcctgccccacggcctggagcccgaggccggcggcaccctgcccagcagactgcagcccatcctgctgctggaccccagcggcagccacgcccccctgctgaccgtgcccggcctgggccccctgcccttccacttcgcccagagcctgatgaccaccgagagactgagcggcagcggcctgcactggcccctgagcagaaccagaagcgagcccctgccccccagcgccaccgccccccccccccccggccccatgcagcccagactggagcagctgaagacccacgtgcaggtgatcaagagaagcgccaagcccagcgagaagcccagactgagacagatccccagcgccgaggacctggagaccgacggcggcggccccggccaggtggtggacgacggcctggagcacagagagctgggccacggccagcccgaggccagaggccccgcccccctgcagcagcacccccaggtgctgctgtgggagcagcagagactggccggcagactgcccagaggcagcaccggcgacaccgtgctgctgcccctggcccagggcggccacagacccctgagcagagcccagagcagccccgccgcccccgccagcctgagcgcccccgagcccgccagccaggccagagtgctgagcagcagcgagacccccgccagaaccctgcccttcaccaccggcctgatctacgacagcgtgatgctgaagcaccagtgcagctgcggcgacaacagcagacaccccgagcacgccggcagaatccagagcatctggagcagactgcaggagagaggcctgagaagccagtgcgagtgcctgagaggcagaaaggccagcctggaggagctgcagagcgtgcacagcgagagacacgtgctgctgtacggcaccaaccccctgagcagactgaagctggacaacggcaagctggccggcctgctggcccagagaatgttcgtgatgctgccctgcggcggcgtgggcgtggacaccgacaccatctggaacgagctgcacagcagcaacgccgccagatgggccgccggcagcgtgaccgacctggccttcaaggtggccagcagagagctgaagaacggcttcgccgtggtgagaccccccggccaccacgccgaccacagcaccgccatgggcttctgcttcttcaacagcgtggccatcgcctgcagacagctgcagcagcagagcaaggccagcaagatcctgatcgtggactgggacgtgcaccacggcaacggcacccagcagaccttctaccaggaccccagcgtgctgtacatcagcctgcacagacacgacgacggcaacttcttccccggcagcggcgccgtggacgaggtgggcgccggcagcggcgagggcttcaacgtgaacgtggcctgggccggcggcctggacccccccatgggcgaccccgagtacctggccgccttcagaatcgtggtgatgcccatcgccagagagttcagccccgacctggtgctggtgagcgccggcttcgacgccgccgagggccaccccgcccccctgggcggctaccacgtgagcgccaagtgcttcggctacatgacccagcagctgatgaacctggccggcggcgccgtggtgctggccctggagggcggccacgacctgaccgccatctgcgacgccagcgaggcctgcgtggccgccctgctgggcaacagagtggaccccctgagcgaggagggctggaagcagaagcccaacctgaacgccatcagaagcctggaggccgtgatcagagtgcacagcaagtactggggctgcatgcagagactggccagctgccccgacagctgggtgcccagagtgcccggcgccgacaaggaggaggtggaggccgtgaccgccctggccagcctgagcgtgggcatcctggccgaggacagacccagcgagcagctggtggaggaggaggagcccatgaacctgtag

SEQ ID NO: 10986 - DNA, 2925 bp, Artificial Sequence
  Description of Artificial Sequence: Synthetic coding sequence
atgcacagccccggcgccggctgccccagaccctgcgccgacacccccggcccccagccccagcccatggacctgagagtgggccagagaccccccgtggagcccccccccgagcccaccctgctggccctgcagagaccccagagactgcaccaccacctgttcctggccggcctgcagcagcagagaagcgtggagcccatgagactgagcatggacacccccatgcccgagctgcaggtgggcccccaggagcaggagctgagacagctgctgcacaaggacaagagcaagagaagcgccgtggccagcagcgtggtgaagcagaagctggccgaggtgatcctgaagaagcagcaggccgccctggagagaaccgtgcaccccaacagccccggcatcccctacagaaccctggagcccctggagaccgagggcgccaccagaagcatgctgagcagcttcctgccccccgtgcccagcctgcccagcgacccccccgagcacttccccctgagaaagaccgtgagcgagcccaacctgaagctgagatacaagcccaagaagagcctggagagaagaaagaaccccctgctgagaaaggagagcgccccccccagcctgagaagaagacccgccgagaccctgggcgacagcagccccagcagcagcagcacccccgccagcggctgcagcagccccaacgacagcgagcacggccccaaccccatcctgggcagcgaggccctgctgggccagagactgagactgcaggagaccagcgtggcccccttcgccctgcccaccgtgagcctgctgcccgccatcaccctgggcctgcccgcccccgccagagccgacagcgacagaagaacccaccccaccctgggccccagaggccccatcctgggcagcccccacacccccctgttcctgccccacggcctggagcccgaggccggcggcaccctgcccagcagactgcagcccatcctgctgctggaccccagcggcagccacgcccccctgctgaccgtgcccggcctgggccccctgcccttccacttcgcccagagcctgatgaccaccgagagactgagcggcagcggcctgcactggcccctgagcagaaccagaagcgagcccctgccccccagcgccaccgccccccccccccccggccccatgcagcccagactggagcagctgaagacccacgtgcaggtgatcaagagaagcgccaagcccagcgagaagcccagactgagacagatccccagcgccgaggacctggagaccgacggcggcggccccggccaggtggtggacgacggcctggagcacagagagctgggccacggccagcccgaggccagaggccccgcccccctgcagcagcacccccaggtgctgctgtgggagcagcagagactggccggcagactgcccagaggcagcaccggcgacaccgtgctgctgcccctggcccagggcggccacagacccctgagcagagcccagagcagccccgccgcccccgccagcctgagcgcccccgagcccgccagccaggccagagtgctgagcagcagcgagacccccgccagaaccctgcccttcaccaccggcctgatctacgacagcgtgatgctgaagcaccagtgcagctgcggcgacaacagcagacaccccgagcacgccggcagaatccagagcatctggagcagactgcaggagagaggcctgagaagccagtgcgagtgcctgagaggcagaaaggccagcctggaggagctgcagagcgtgcacagcgagagacacgtgctgctgtacggcaccaaccccctgagcagactgaagctggacaacggcaagctggccggcctgctggcccagagaatgttcgtgatgctgccctgcggcggcgtgggcgtggacaccgacaccatctggaacgagctgcacagcagcaacgccgccagatgggccgccggcagcgtgaccgacctggccttcaaggtggccagcagagagctgaagaacggcttcgccgtggtgagaccccccggccaccacgccgaccacagcaccgccatgggcttctgcttcttcaacagcgtggccatcgcctgcagacagctgcagcagcagagcaaggccagcaagatcctgatcgtggactgggacgtgcaccacggcaacggcacccagcagaccttctaccaggaccccagcgtgctgtacatcagcctgcacagacacgacgacggcaacttcttccccggcagcggcgccgtggacgaggtgggcgccggcagcggcgagggcttcaacgtgaacgtggcctgggccggcggcctggacccccccatgggcgaccccgagtacctggccgccttcagaatcgtggtgatgcccatcgccagagagttcagccccgacctggtgctggtgagcgccggcttcgacgccgccgagggccaccccgcccccctgggcggctaccacgtgagcgccaagtgcttcggctacatgacccagcagctgatgaacctggccggcggcgccgtggtgctggccctggagggcggccacgacctgaccgccatctgcgacgccagcgaggcctgcgtggccgccctgctgggcaacagagtggaccccctgagcgaggagggctggaagcagaagcccaacctgaacgccatcagaagcctggaggccgtgatcagagtgcacagcaagtactggggctgcatgcagagactggccagctgccccgacagctgggtgcccagagtgcccggcgccgacaaggaggaggtggaggccgtgaccgccctggccagcctgagcgtgggcatcctggccgaggacagacccagcgagcagctggtggaggaggaggagcccatgaacctgtag

SEQ ID NO: 10987 - DNA, 819 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagaatcgtgaagcccaaggtggccagcatggaggagatggccaccttccacaccgacgcctacctgcagcacctgcagaaggtgagccaggagggcgacgacgaccaccccgacagcatcgagtacggcctgggctacgactgccccgccaccgagggcatcttcgactacgccgccgccatcggcggcgccaccatcaccgccgcccagtgcctgatcgacggcatgtgcaaggtggccatcaactggagcggcggctggcaccacgccaagaaggacgaggccagcggcttctgctacctgaacgacgccgtgctgggcatcctgagactgagaagaaagttcgagagaatcctgtacgtggacctggacctgcaccacggcgacggcgtggaggacgccttcagcttcaccagcaaggtgatgaccgtgagcctgcacaagttcagccccggcttcttccccggcaagagcgacgtgagcgacgtgggcctgggcaagggcagatactacagcgtgaacgtgcccatccaggacggcatccaggacgagaagtactaccagatctgcgagagcgtgagaaccagctgccccaagagcagacccgtggaggccgccgccgccgcctgcctgccccacctgcacagcctggtgtag

SEQ ID NO: 10988 - DNA, 1134 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagaatcgtgaagcccaaggtggccagcatggaggagatggccaccttccacaccgacgcctacctgcagcacctgcagaaggtgagccaggagggcgacgacgaccaccccgacagcatcgagtacggcctgggctacgactgccccgccaccgagggcatcttcgactacgccgccgccatcggcggcgccaccatcaccgccgcccagtgcctgatcgacggcatgtgcaaggtggccatcaactggagcggcggctggcaccacgccaagaaggacgaggccagcggcttctgctacctgaacgacgccgtgctgggcatcctgagactgagaagaaagttcgagagaatcctgtacgtggacctggacctgcaccacggcgacggcgtggaggacgccttcagcttcaccagcaaggtgatgaccgtgagcctgcacaagttcagccccggcttcttccccggcaccggcgacgtgagcgacgtgggcctgggcaagggcagatactacagcgtgaacgtgcccatccaggacggcatccaggacgagaagtactaccagatctgcgagagcgtgctgaaggaggtgtaccaggccttcaaccccaaggccgtggtgctgcagctgggcgccgacaccatcgccggcgaccccatgtgcagcttcaacatgacccccgtgggcatcggcaagtgcctgaagtacatcctgcagtggcagctggccaccctgatcctgggcggcggcggctacaacctggccaacaccgccagatgctggacctacctgaccggcgtgatcctgggcaagaccctgagcagcgagatccccgaccacgagttcttcaccgcctacggccccgactacgtgctggagatcacccccagctgcagacccgacagaaacgagccccacagaatccagcagatcctgaactacatcaagggcaacctgaagcacgtggtgtag

SEQ ID NO: 10989 - DNA, 861 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagagacgaggccagcggcttctgctacctgaacgacgccgtgctgggcatcctgagactgagaagaaagttcgagagaatcctgtacgtggacctggacctgcaccacggcgacggcgtggaggacgccttcagcttcaccagcaaggtgatgaccgtgagcctgcacaagttcagccccggcttcttccccggcaccggcgacgtgagcgacgtgggcctgggcaagggcagatactacagcgtgaacgtgcccatccaggacggcatccaggacgagaagtactaccagatctgcgagagcgtgctgaaggaggtgtaccaggccttcaaccccaaggccgtggtgctgcagctgggcgccgacaccatcgccggcgaccccatgtgcagcttcaacatgacccccgtgggcatcggcaagtgcctgaagtacatcctgcagtggcagctggccaccctgatcctgggcggcggcggctacaacctggccaacaccgccagatgctggacctacctgaccggcgtgatcctgggcaagaccctgagcagcgagatccccgaccacgagttcttcaccgcctacggccccgactacgtgctggagatcacccccagctgcagacccgacagaaacgagccccacagaatccagcagatcctgaactacatcaagggcaacctgaagcacgtggtgtag

SEQ ID NO: 10990 - DNA, 549 bp, Artificial Sequence
  Description of Artificial Sequence: Synthetic coding sequence
atgaccgtgagcctgcacaagttcagccccggcttcttccccggcaccggcgacgtgagcgacgtgggcctgggcaagggcagatactacagcgtgaacgtgcccatccaggacggcatccaggacgagaagtactaccagatctgcgagagcgtgctgaaggaggtgtaccaggccttcaaccccaaggccgtggtgctgcagctgggcgccgacaccatcgccggcgaccccatgtgcagcttcaacatgacccccgtgggcatcggcaagtgcctgaagtacatcctgcagtggcagctggccaccctgatcctgggcggcggcggctacaacctggccaacaccgccagatgctggacctacctgaccggcgtgatcctgggcaagaccctgagcagcgagatccccgaccacgagttcttcaccgcctacggccccgactacgtgctggagatcacccccagctgcagacccgacagaaacgagccccacagaatccagcagatcctgaactacatcaagggcaacctgaagcacgtggtgtag

SEQ ID NO: 10991 - DNA, 441 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagaatcgtgaagcccaaggtggccagcatggaggagatggccaccttccacaccgacgcctacctgcagcacctgcagaaggtgagccaggagggcgacgacgaccaccccgacagcatcgagtacggcctgggctacgactgccccgccaccgagggcatcttcgactacgccgccgccatcggcggcgccaccatcaccgccgcccagtgcctgatcgacggcatgtgcaaggtggccatcaactggagcggcggctggcaccacgccaagaagtag

SEQ ID NO: 10992 - DNA, 477 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagaatcgtgaagcccaaggtggccagcatggaggagatggccaccttccacaccgacgcctacctgcagcacctgcagaaggtgagccaggagggcgacgacgaccaccccgacagcatcgagtacggcctgggctacgactgccccgccaccgagggcatcttcgactacgccgccgccatcggcggcgccaccatcaccgccgcccagtgcctgatcgacggcatgtgcaaggtggccatcaactggagcggcggctggcaccacgccaagaaggagacctgcgtgtacgtggccctgtacaaggccttctag

SEQ ID NO: 10993 - DNA, 420 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagagacgaggccagcggcttctgctacctgaacgacgccgtgctgggcatcctgagactgagaagaaagttcgagagaatcctgtacgtggacctggacctgcaccacggcgacggcaccggcgacgtgagcgacgtgggcctgggcaagggcagatactacagcgtgaacgtgcccatccaggacggcatccaggacgagaagtactaccagatctgcgagagatacgagccccccgcccccaaccccggcctgtag

SEQ ID NO: 10994 - DNA, 771 bp, Artificial Sequence
  Description of Artificial Sequence: Synthetic coding sequence
atggaggagcccgaggagcccgccgacagcggccagagcctggtgcccgtgtacatctacagccccgagtacgtgagcatgtgcgacagcctggccaagatccccaagagagccagcatggtgcacagcctgatcgaggcctacgccctgcacaagcagatgagaatcgtgaagcccaaggtggccagcatggaggagatggccaccttccacaccgacgcctacctgcagcacctgcagaaggtgagccaggagggcgacgacgaccaccccgacagcatcgagtacggcctgggctacgactgccccgccaccgagggcatcttcgactacgccgccgccatcggcggcgccaccatcaccgccgcccagtgcctgatcgacggcatgtgcaaggtggccatcaactggagcggcggctggcaccacgccaagaaggacgaggccagcggcttctgctacctgaacgacgccgtgctgggcatcctgagactgagaagaaagttcgagagaatcctgtacgtggacctggacctgcaccacggcgacggcgtggaggacgccttcagcttcaccagcaaggtgatgaccgtgagcctgcacaagttcagccccggcttcttccccggcaccggcgacgtgagcgacgtgggcctgggcaagggcagatactacagcgtgaacgtgcccatccaggacggcatccaggacgagaagtactaccagatctgcgagagatacgagccccccgcccccaaccccggcctgtag

SEQ ID NO: 10995 - DNA, 831 bp, Artificial Sequence
  Description of Artificial Sequence: Synthetic coding sequence
atggccggccccgccgccctgagcgccgccgccgccgccgccctggccgccgccctgctgctgctgagaagagaggaccccggccccggcgccggccccagcatggccgagaccgaggccctgagcaagctgagagaggacttcagaatgcagaacaagagcgtgttcatcctgggcgccagcggcgagaccggcagagtgctgctgaaggagatcctggagcagggcctgttcagcaaggtgaccctgatcggcagaagaaagctgaccttcgacgaggaggcctacaagaacgtgaaccaggaggtggtggacttcgagaagctggacgactacgccagcgccttccagggccacgacgtgggcttctgctgcctgggcaccaccagaggcaaggccggcgccgagggcttcgtgagagtggacagagactacgtgctgaagagcgccgagctggccaaggccggcggctgcaagcacttcaacctgctgagcagcaagggcgccgacaagagcagcaacttcctgtacctgcaggtgaagggcgaggtggaggccaaggtggaggagctgaagttcgacagatacagcgtgttcagacccggcgtgctgctgtgcgacagacaggagagcagacccggcgagtggctggtgagaaagttcttcggcagcctgcccgacagctgggccagcggccacagcgtgcccgtggtgaccgtggtgagagccatgctgaacaacgtggtgagacccagagacaagcagatggagctgctggagaacaaggccatccacgacctgggcaaggcccacggcagcctgaagccctag

SEQ ID NO: 10996 - DNA, 729 bp, Artificial Sequence
  Description of Artificial Sequence: Synthetic coding sequence
atggccgagaccgaggccctgagcaagctgagagaggacttcagaatgcagaacaagagcgtgttcatcctgggcgccagcggcgagaccggcagagtgctgctgaaggagatcctggagcagggcctgttcagcaaggtgaccctgatcggcagaagaaagctgaccttcgacgaggaggcctacaagaacgtgaaccaggaggtggtggacttcgagaagctggacgactacgccagcgccttccagggccacgacgtgggcttctgctgcctgggcaccaccagaggcaaggccggcgccgagggcttcgtgagagtggacagagactacgtgctgaagagcgccgagctggccaaggccggcggctgcaagcacttcaacctgctgagcagcaagggcgccgacaagagcagcaacttcctgtacctgcaggtgaagggcgaggtggaggccaaggtggaggagctgaagttcgacagatacagcgtgttcagacccggcgtgctgctgtgcgacagacaggagagcagacccggcgagtggctggtgagaaagttcttcggcagcctgcccgacagctgggccagcggccacagcgtgcccgtggtgaccgtggtgagagccatgctgaacaacgtggtgagacccagagacaagcagatggagctgctggagaacaaggccatccacgacctgggcaaggcccacggcagcctgaagccctag

SEQ ID NO: 10997 - DNA, 729 bp, Artificial Sequence; identical to SEQ ID NO: 10996
  Description of Artificial Sequence: Synthetic coding sequence

SEQ ID NO: 10998 - DNA, 729 bp, Artificial Sequence; identical to SEQ ID NO: 10996
  Description of Artificial Sequence: Synthetic coding sequence

SEQ ID NO: 10999 - DNA, 402 bp, Artificial Sequence
  Description of Artificial Sequence: Synthetic coding sequence
atggccgagaccgaggccctgagcaagctgagagaggacttcagaatgcagaacaagagcgtgttcatcctgggcgccagcggcgagaccggcagagtgctgctgaaggagatcctggagcagggcctgttcagcaaggtgaccctgatcggcagaagaaagctgaccttcgacgaggaggcctacaagaacgtgaaccaggaggtggtggacttcgagaagctggacgactacgccagcgccttccagggccacgacgtgggcttctgctgcctgggcaccaccagaggcaaggccggcgccgtgagaaaggcctacgccctgttccccttctgctggcccgtgatcagcagaatcctgttcctgctgaccctgttcctgtgcgcctgctgcaacgcctag

SEQ ID NO: 11000 - DNA, 402 bp, Artificial Sequence; identical to SEQ ID NO: 10999
  Description of Artificial Sequence: Synthetic coding sequence

SEQ ID NO: 11001 - DNA, 402 bp, Artificial Sequence; identical to SEQ ID NO: 10999
  Description of Artificial Sequence: Synthetic coding sequence

SEQ ID NO: 11002 - DNA, 1080 bp, Artificial Sequence
  Description of Artificial Sequence: Synthetic coding sequence
atggccgagcacggcgcccacttcaccgccgccagcgtggccgacgaccagcccagcatcttcgaggtggtggcccaggacagcctgatgaccgccgtgagacccgccctgcagcacgtggtgaaggtgctggccgagagcaaccccacccactacggcttcctgtggagatggttcgacgagatcttcaccctgctggacctgctgctgcagcagcactacctgagcagaaccagcgccagcttcagcgagaacttctacggcctgaagagaatcgtgatgggcgacacccacaagagccagagactggccagcgccggcctgcccaagcagcagctgtggaagagcatcatgttcctggtgctgctgccctacctgaaggtgaagctggagaagctggtgagcagcctgagagaggaggacgagtacagcatccacccccccagcagcagatggaagagattctacagagccttcctggccgcctaccccttcgtgaacatggcctgggagggctggttcctggtgcagcagctgagatacatcctgggcaaggcccagcaccacagccccctgctgagactggccggcgtgcagctgggcagactgaccgtgcaggacatccaggccctggagcacaagcccgccaaggccagcatgatgcagcagcccgccagaagcgtgagcgagaagatcaacagcgccctgaagaaggccgtgggcggcgtggccctgagcctgagcaccggcctgagcgtgggcgtgttcttcctgcagttcctggactggtggtacagcagcgagaaccaggagaccatcaagagcctgaccgccctgcccaccccccccccccccgtgcacctggactacaacagcgacagccccctgctgcccaagatgaagaccgtgtgccccctgtgcagaaagaccagagtgaacgacaccgtgctggccaccagcggctacgtgttctgctacagatgcgtgttccactacgtgagaagccaccaggcctgccccatcaccggctaccccaccgaggtgcagcacctgatcaagctgtacagccccgagaactag

SEQ ID NO: 11003 - DNA, 1374 bp, Artificial Sequence
  Description of Artificial Sequence: Synthetic coding sequence
atggtgagcaagctgaccagcctgcagcaggagctgctgagcgccctgctgagcagcggcgtgaccaaggaggtgctggtgcaggccctggaggagctgctgcccagccccaacttcggcgtgaagctggagaccctgcccctgagccccggcagcggcgccgagcccgacaccaagcccgtgttccacaccctgaccaacggccacgccaagggcagactgagcggcgacgagggcagcgaggacggcgacgactacgacaccccccccatcctgaaggagctgcaggccctgaacaccgaggaggccgccgagcagagagccgaggtggacagaatgctgagcgaggacccctggagagccgccaagatgatcaagggctacatgcagcagcacaacatcccccagagagaggtggtggacgtgaccggcctgaaccagagccacctgagccagcacctgaacaagggcacccccatgaagacccagaagagagccgccctgtacacctggtacgtgagaaagcagagagagatcctgagacagttcagccagcagagccacggccccggccagagcgacgacgcctgcagcgagcccaccaacaagaagatgagaagaaacagattcaagtggggccccgccagccagcagatcctgtaccaggcctacgacagacagaagaaccccagcaaggaggagagagaggccctggtggaggagtgcaacagagccgagtgcctgcagagaggcgtgagccccagcaaggcccacggcctgggcagcaacctggtgaccgaggtgagagtgtacaactggttcgccaacagaagaaaggaggaggccttcagacagaagctggccatggacgcctacagcagcaaccagacccacagcctgaaccccctgctgagccacggcagcccccaccaccagcccagcagcagcccccccaacaagctgagcggcgtgagatacagccagcagggcaacaacgagatcaccagcagcagcaccatcagccaccacggcaacagcgccatggtgaccagccagagcgtgctgcagcaggtgagccccgccagcctggaccccggccacaacctgctgagccccgacggcaagatgatcagcgtgagcggcggcggcctgccccccgtgagcaccctgaccaacatccacagcctgagccaccacaacccccagcagagccagaacctgatcatgacccccctgagcggcgtgatggccatcgcccagatgagcagcaccagcctggtgatgcccacccaccacctgctgagagcccagcagcagggcccctgcttcccccaccaccaccccctgggcagctgccacggcaaggcccagtag

SEQ ID NO: 11004 - DNA, 1338 bp, Artificial Sequence
  Description of Artificial Sequence: Synthetic coding sequence
atgctgagcgaggacccctggagagccgccaagatgatcaagggctacatgcagcagcacaacatcccccagagagaggtggtggacgtgaccggcctgaaccagagccacctgagccagcacctgaacaagggcacccccatgaagacccagaagagagccgccctgtacacctggtacgtgagaaagcagagagagatcctgagacagttcaaccagaccgtgcagagcagcggcaacatgaccgacaagagcagccaggaccagctgctgttcctgttccccgagttcagccagcagagccacggccccggccagagcgacgacgcctgcagcgagcccaccaacaagaagatgagaagaaacagattcaagtggggccccgccagccagcagatcctgtaccaggcctacgacagacagaagaaccccagcaaggaggagagagaggccctggtggaggagtgcaacagagccgagtgcctgcagagaggcgtgagccccagcaaggcccacggcctgggcagcaacctggtgaccgaggtgagagtgtacaactggttcgccaacagaagaaaggaggaggccttcagacagaagctggccatggacgcctacagcagcaaccagacccacagcctgaaccccctgctgagccacggcagcccccaccaccagcccagcagcagcccccccaacaagctgagcggcgtgagatacagccagcagggcaacaacgagatcaccagcagcagcaccatcagccaccacggcaacagcgccatggtgaccagccagagcgtgctgcagcaggtgagccccgccagcctggaccccggccacaacctgctgagccccgacggcaagatgatcagcgtgagcggcggcggcctgccccccgtgagcaccctgaccaacatccacagcctgagccaccacaacccccagcagagccagaacctgatcatgacccccctgagcggcgtgatggccatcgcccagagcctgaacaccagccaggcccagagcgtgcccgtgatcaacagcgtggccggcagcctggccgccctgcagcccgtgcagttcagccagcagctgcacagcccccaccagcagcccctgatgcagcagagccccggcagccacatggcccagcagcccttcatggccgccgtgacccagctgcagaacagccacatgtacgcccacaagcaggagcccccccagtacagccacaccagcagattccccagcgccatggtggtgaccgacaccagcagcatcagcaccctgaccaacatgagcagcagcaagcagtgccccctgcaggcctggtag

SEQ ID NO: 11005 - DNA, 1278 bp, Artificial Sequence
  Description of Artificial Sequence: Synthetic coding sequence
atggtgagcaagctgaccagcctgcagcaggagctgctgagcgccctgctgagcagcggcgtgaccaaggaggtgctggtgcaggccctggaggagctgctgcccagccccaacttcggcgtgaagctggagaccctgcccctgagccccggcagcggcgccgagcccgacaccaagcccgtgttccacaccctgaccaacggccacgccaagggcagactgagcggcgacgagggcagcgaggacggcgacgactacgacaccccccccatcctgaaggagctgcaggccctgaacaccgaggaggccgccgagcagagagccgaggtggacagaatgctgagcgaggacccctggagagccgccaagatgatcaagggctacatgcagcagcacaacatcccccagagagaggtggtggacgtgaccggcctgaaccagagccacctgagccagcacctgaacaagggcacccccatgaagacccagaagagagccgccctgtacacctggtacgtgagaaagcagagagagatcctgagacagttcaaccagaccgtgcagagcagcggcaacatgaccgacaagagcagccaggaccagctgctgttcctgttccccgagttcagccagcagagccacggccccggccagagcgacgacgcctgcagcgagcccaccaacaagaagatgagaagaaacagattcaagtggggccccgccagccagcagatcctgtaccaggcctacgacagacagaagaaccccagcaaggaggagagagaggccctggtggaggagtgcaacagagccgagtgcctgcagagaggcgtgagccccagcaaggcccacggcctgggcagcaacctggtgaccgaggtgagagtgtacaactggttcgccaacagaagaaaggaggaggccttcagacagaagctggccatggacgcctacagcagcaaccagacccacagcctgaaccccctgctgagccacggcagcccccaccaccagcccagcagcagcccccccaacaagctgagcggcgtgagatacagccagcagggcaacaacgagatcaccagcagcagcaccatcagccaccacggcaacagcgccatggtgaccagccagagcgtgctgcagcaggtgagccccgccagcctggaccccggccacaacctgctgagccccgacggcaagatggacctgagcctgagaagaagattcgcccccagccagcacctggacgagtacccccagcccctgcccccctag

SEQ ID NO: 11006 - DNA, 1596 bp, Artificial Sequence
  Description of Artificial Sequence: Synthetic coding sequence
atggtgagcaagctgaccagcctgcagcaggagctgctgagcgccctgctgagcagcggcgtgaccaaggaggtgctggtgcaggccctggaggagctgctgcccagccccaacttcggcgtgaagctggagaccctgcccctgagccccggcagcggcgccgagcccgacaccaagcccgtgttccacaccctgaccaacggccacgccaagggcagactgagcggcgacgagggcagcgaggacggcgacgactacgacaccccccccatcctgaaggagctgcaggccctgaacaccgaggaggccgccgagcagagagccgaggtggacagaatgctgagcgaggacccctggagagccgccaagatgatcaagggctacatgcagcagcacaacatcccccagagagaggtggtggacgtgaccggcctgaaccagagccacctgagccagcacctgaacaagggcacccccatgaagacccagaagagagccgccctgtacacctggtacgtgagaaagcagagagagatcctgagacagttcagccagcagagccacggccccggccagagcgacgacgcctgcagcgagcccaccaacaagaagatgagaagaaacagattcaagtggggccccgccagccagcagatcctgtaccaggcctacgacagacagaagaaccccagcaaggaggagagagaggccctggtggaggagtgcaacagagccgagtgcctgcagagaggcgtgagccccagcaaggcccacggcctgggcagcaacctggtgaccgaggtgagagtgtacaactggttcgccaacagaagaaaggaggaggccttcagacagaagctggccatggacgcctacagcagcaaccagacccacagcctgaaccccctgctgagccacggcagcccccaccaccagcccagcagcagcccccccaacaagctgagcggcgtgagatacagccagcagggcaacaacgagatcaccagcagcagcaccatcagccaccacggcaacagcgccatggtgaccagccagagcgtgctgcagcaggtgagccccgccagcctggaccccggccacaacctgctgagccccgacggcaagatgatcagcgtgagcggcggcggcctgccccccgtgagcaccctgaccaacatccacagcctgagccaccacaacccccagcagagccagaacctgatcatgacccccctgagcggcgtgatggccatcgcccagagcctgaacaccagccaggcccagagcgtgcccgtgatcaacagcgtggccggcagcctggccgccctgcagcccgtgcagttcagccagcagctgcacagcccccaccagcagcccctgatgcagcagagccccggcagccacatggcccagcagcccttcatggccgccgtgacccagctgcagaacagccacatgtacgcccacaagcaggagcccccccagtacagccacaccagcagattccccagcgccatggtggtgaccgacaccagcagcatcagcaccctgaccaacatgagcagcagcaagcagtgccccctgcaggcctggtag

SEQ ID NO: 11007 - DNA, 843 bp, Artificial Sequence
  Description of Artificial Sequence: Synthetic coding sequence
atgaagttcagagccaagatcgtggacggcgcctgcctgaaccacttcaccagaatcagcaacatgatcgccaagctggccaagacctgcaccctgagaatcagccccgacaagctgaacttcatcctgtgcgacaagctggccaacggcggcgtgagcatgtggtgcgagctggagcaggagaacttcttcaacgagttccagatggagggcgtgagcgccgagaacaacgagatctacctggagctgaccagcgagaacctgagcagagccctgaagaccgcccagaacgccagagccctgaagatcaagctgaccaacaagcacttcccctgcctgaccgtgagcgtggagctgctgagcatgagcagcagcagcagaatcgtgacccacgacatccccatcaaggtgatccccagaaagctgtggaaggacctgcaggagcccgtggtgcccgaccccgacgtgagcatctacctgcccgtgctgaagaccatgaagagcgtggtggagaagatgaagaacatcagcaaccacctggtgatcgaggccaacctggacggcgagctgaacctgaagatcgagaccgagctggtgtgcgtgaccacccacttcaaggacctgggcaacccccccctggccagcgagagcacccacgaggacagaaacgtggagcacatggccgaggtgcacatcgacatcagaaagctgctgcagttcctggccggccagcaggtgaaccccaccaaggccctgtgcaacatcgtgaacaacaagatggtgcacttcgacctgctgcacgaggacgtgagcctgcagtacttcatccccgccctgagctag

SEQ ID NO: 11008 - DNA, 780 bp, Artificial Sequence
  Description of Artificial Sequence: Synthetic coding sequence
atgatcgccaagctggccaagacctgcaccctgagaatcagccccgacaagctgaacttcatcctgtgcgacaagctggccaacggcggcgtgagcatgtggtgcgagctggagcaggagaacttcttcaacgagttccagatggagggcgtgagcgccgagaacaacgagatctacctggagctgaccagcgagaacctgagcagagccctgaagaccgcccagaacgccagagccctgaagatcaagctgaccaacaagcacttcccctgcctgaccgtgagcgtggagctgctgagcatgagcagcagcagcagaatcgtgacccacgacatccccatcaaggtgatccccagaaagctgtggaaggacctgcaggagcccgtggtgcccgaccccgacgtgagcatctacctgcccgtgctgaagaccatgaagagcgtggtggagaagatgaagaacatcagcaaccacctggtgatcgaggccaacctggacggcgagctgaacctgaagatcgagaccgagctggtgtgcgtgaccacccacttcaaggacctgggcaacccccccctggccagcgagagcacccacgaggacagaaacgtggagcacatggccgaggtgcacatcgacatcagaaagctgctgcagttcctggccggccagcaggtgaaccccaccaaggccctgtgcaacatcgtgaacaacaagatggtgcacttcgacctgctgcacgaggacgtgagcctgcagtacttcatccccgccctgagctag

SEQ ID NO: 11009 - DNA, 843 bp, Artificial Sequence; identical to SEQ ID NO: 11007
  Description of Artificial Sequence: Synthetic coding sequence

SEQ ID NO: 11010 - DNA, 780 bp, Artificial Sequence; identical to SEQ ID NO: 11008
  Description of Artificial Sequence: Synthetic coding sequence

SEQ ID NO: 11011 - DNA, 2130 bp, Artificial Sequence
  Description of Artificial Sequence: Synthetic coding sequence
atgagcttccccaaggcccccctgaagagattcaacgaccccagcggctgcgcccccagccccggcgcctacgacgtgaagaccctggaggtgctgaagggccccgtgagcttccagaagagccagagattcaagcagcagaaggagagcaagcagaacctgaacgtggacaaggacaccaccctgcccgccagcgccagaaaggtgaagagcagcgagagcaagatcagagtgctgctgcaggagagaggcgcccaggacagaagaatccaggacctggagaccgagctggagaagatggaggccagactgaacgccgccctgagagagaagaccagcctgagcgccaacaacgccaccctggagaagcagctgatcgagctgaccagaaccaacgagctgctgaagagcaagttcagcgagaacggcaaccagaagaacctgagaatcctgagcctggagctgatgaagctgagaaacaagagagagaccaagatgagaggcatgatggccaagcaggagggcatggagatgaagctgcaggtgacccagagaagcctggaggagagccagggcaagatcgcccagctggagggcaagctggtgagcatcgagaaggagaagatcgacgagaagagcgagaccgagaagctgctggagtacatcgaggagatcagctgcgccagcgaccaggtggagaagtacaagctggacatcgcccagctggaggagaacctgaaggagaagaacgacgagatcctgagcctgaagcagagcctggaggagaacatcgtgatcctgagcaagcaggtggaggacctgaacgtgaagtgccagctgctggagaaggagaaggaggaccacgtgaacagaaacagagagcacaacgagaacctgaacgccgagatgcagaacctgaagcagaagttcatcctggagcagcaggagagagagaagctgcagcagaaggagctgcagatcgacagcctgctgcagcaggagaaggagctgagcagcagcctgcaccagaagctgtgcagcttccaggaggagatggtgaaggagaagaacctgttcgaggaggagctgaagcagaccctggacgagctggacaagctgcagcagaaggaggagcaggccgagagactggtgaagcagctggaggaggaggccaagagcagagccgaggagctgaagctgctggaggagaagctgaagggcaaggaggccgagctggagaagagcagcgccgcccacacccaggccaccctgctgctgcaggagaagtacgacagcatggtgcagagcctggaggacgtgaccgcccagttcgagagctacaaggccctgaccgccagcgagatcgaggacctgaagctggagaacagcagcctgcaggagaaggccgccaaggccggcaagaacgccgaggacgtgcagcaccagatcctggccaccgagagcagcaaccaggagtacgtgagaatgctgctggacctgcagaccaagagcgccctgaaggagaccgagatcaaggagatcaccgtgagcttcctgcagaagatcaccgacctgcagaaccagctgaagcagcaggaggaggacttcagaaagcagctggaggacgaggagggcagaaaggccgagaaggagaacaccaccgccgagctgaccgaggagatcaacaagtggagactgctgtacgaggagctgtacaacaagaccaagcccttccagctgcagctggacgccttcgaggtggagaagcaggccctgctgaacgagcacggcgccgcccaggagcagctgaacaagatcagagacagctacgccaagctgctgggccaccagaacctgaagcagaagatcaagcacgtggtgaagctgaaggacgagaacagccagctgaagagcgaggtgagcaagctgagatgccagctggccaagaagaagcagagcgagaccaagctgcaggaggagctgaacaaggtgctgggcatcaagcacttcgaccccagcaaggccttccaccacgagagcaaggagaacttcgccctgaagacccccctgaaggagggcaacaccaactgctacagagcccccatggagtgccaggagagctggaagtag

SEQ ID NO: 11012 - DNA, 2175 bp, Artificial Sequence
  Description of Artificial Sequence: Synthetic coding sequence
atgagcttccccaaggcccccctgaagagattcaacgaccccagcggctgcgcccccagccccggcgcctacgacgtgaagaccctggaggtgctgaagggccccgtgagcttccagaagagccagagattcaagcagcagaaggagagcaagcagaacctgaacgtggacaaggacaccaccctgcccgccagcgccagaaaggtgaagagcagcgagagcaaggagagccagaagaacgacaaggacctgaagatcctggagaaggagatcagagtgctgctgcaggagagaggcgcccaggacagaagaatccaggacctggagaccgagctggagaagatggaggccagactgaacgccgccctgagagagaagaccagcctgagcgccaacaacgccaccctggagaagcagctgatcgagctgaccagaaccaacgagctgctgaagagcaagttcagcgagaacggcaaccagaagaacctgagaatcctgagcctggagctgatgaagctgagaaacaagagagagaccaagatgagaggcatgatggccaagcaggagggcatggagatgaagctgcaggtgacccagagaagcctggaggagagccagggcaagatcgcccagctggagggcaagctggtgagcatcgagaaggagaagatcgacgagaagagcgagaccgagaagctgctggagtacatcgaggagatcagctgcgccagcgaccaggtggagaagtacaagctggacatcgcccagctggaggagaacctgaaggagaagaacgacgagatcctgagcctgaagcagagcctggaggagaacatcgtgatcctgagcaagcaggtggaggacctgaacgtgaagtgccagctgctggagaaggagaaggaggaccacgtgaacagaaacagagagcacaacgagaacctgaacgccgagatgcagaacctgaagcagaagttcatcctggagcagcaggagagagagaagctgcagcagaaggagctgcagatcgacagcctgctgcagcaggagaaggagctgagcagcagcctgcaccagaagctgtgcagcttccaggaggagatggtgaaggagaagaacctgttcgaggaggagctgaagcagaccctggacgagctggacaagctgcagcagaaggaggagcaggccgagagactggtgaagcagctggaggaggaggccaagagcagagccgaggagctgaagctgctggaggagaagctgaagggcaaggaggccgagctggagaagagcagcgccgcccacacccaggccaccctgctgctgcaggagaagtacgacagcatggtgcagagcctggaggacgtgaccgcccagttcgagagctacaaggccctgaccgccagcgagatcgaggacctgaagctggagaacagcagcctgcaggagaaggccgccaaggccggcaagaacgccgaggacgtgcagcaccagatcctggccaccgagagcagcaaccaggagtacgtgagaatgctgctggacctgcagaccaagagcgccctgaaggagaccgagatcaaggagatcaccgtgagcttcctgcagaagatcaccgacctgcagaaccagctgaagcagcaggaggaggacttcagaaagcagctggaggacgaggagggcagaaaggccgagaaggagaacaccaccgccgagctgaccgaggagatcaacaagtggagactgctgtacgaggagctgtacaacaagaccaagcccttccagctgcagctggacgccttcgaggtggagaagcaggccctgctgaacgagcacggcgccgcccaggagcagctgaacaagatcagagacagctacgccaagctgctgggccaccagaacctgaagcagaagatcaagcacgtggtgaagctgaaggacgagaacagccagctgaagagcgaggtgagcaagctgagatgccagctggccaagaagaagcagagcgagaccaagctgcaggaggagctgaacaaggtgctgggcatcaagcacttcgaccccagcaaggccttccaccacgagagcaaggagaacttcgccctgaagacccccctgaaggagggcaacaccaactgctacagagcccccatggagtgccaggagagctggaagtag

SEQ ID NO: 11013 - DNA, 2178 bp, Artificial Sequence
  Description of Artificial Sequence: Synthetic coding sequence
atgagcttccccaaggcccccctgaagagattcaacgaccccagcggctgcgcccccagccccggcgcctacgacgtgaagaccctggaggtgctgaagggccccgtgagcttccagaagagccagagattcaagcagcagaaggagagcaagcagaacctgaacgtggacaaggacaccaccctgcccgccagcgccagaaaggtgaagagcagcgagagcaagaaggagagccagaagaacgacaaggacctgaagatcctggagaaggagatcagagtgctgctgcaggagagaggcgcccaggacagaagaatccaggacctggagaccgagctggagaagatggaggccagactgaacgccgccctgagagagaagaccagcctgagcgccaacaacgccaccctggagaagcagctgatcgagctgaccagaaccaacgagctgctgaagagcaagttcagcgagaacggcaaccagaagaacctgagaatcctgagcctggagctgatgaagctgagaaacaagagagagaccaagatgagaggcatgatggccaagcaggagggcatggagatgaagctgcaggtgacccagagaagcctggaggagagccagggcaagatcgcccagctggagggcaagctggtgagcatcgagaaggagaagatcgacgagaagagcgagaccgagaagctgctggagtacatcgaggagatcagctgcgccagcgaccaggtggagaagtacaagctggacatcgcccagctggaggagaacctgaaggagaagaacgacgagatcctgagcctgaagcagagcctggaggagaacatcgtgatcctgagcaagcaggtggaggacctgaacgtgaagtgccagctgctggagaaggagaaggaggaccacgtgaacagaaacagagagcacaacgagaacctgaacgccgagatgcagaacctgaagcagaagttcatcctggagcagcaggagagagagaagctgcagcagaaggagctgcagatcgacagcctgctgcagcaggagaaggagctgagcagcagcctgcaccagaagctgtgcagcttccaggaggagatggtgaaggagaagaacctgttcgaggaggagctgaagcagaccctggacgagctggacaagctgcagcagaaggaggagcaggccgagagactggtgaagcagctggaggaggaggccaagagcagagccgaggagctgaagctgctggaggagaagctgaagggcaaggaggccgagctggagaagagcagcgccgcccacacccaggccaccctgctgctgcaggagaagtacgacagcatggtgcagagcctggaggacgtgaccgcccagttcgagagctacaaggccctgaccgccagcgagatcgaggacctgaagctggagaacagcagcctgcaggagaaggccgccaaggccggcaagaacgccgaggacgtgcagcaccagatcctggccaccgagagcagcaaccaggagtacgtgagaatgctgctggacctgcagaccaagagcgccctgaaggagaccgagatcaaggagatcaccgtgagcttcctgcagaagatcaccgacctgcagaaccagctgaagcagcaggaggaggacttcagaaagcagctggaggacgaggagggcagaaaggccgagaaggagaacaccaccgccgagctgaccgaggagatcaacaagtggagactgctgtacgaggagctgtacaacaagaccaagcccttccagctgcagctggacgccttcgaggtggagaagcaggccctgctgaacgagcacggcgccgcccaggagcagctgaacaagatcagagacagctacgccaagctgctgggccaccagaacctgaagcagaagatcaagcacgtggtgaagctgaaggacgagaacagccagctgaagagcgaggtgagcaagctgagatgccagctggccaagaagaagcagagcgagaccaagctgcaggaggagctgaacaaggtgctgggcatcaagcacttcgaccccagcaaggccttccaccacgagagcaaggagaacttcgccctgaagacccccctgaaggagggcaacaccaactgctacagagcccccatggagtgccaggagagctggaagtag

SEQ ID NO: 11014 - DNA, 2106 bp, Artificial Sequence
  Description of Artificial Sequence: Synthetic coding sequence
atgagcttccccaaggcccccctgaagagattcaacgaccccagcggctgcgcccccagccccggcgcctacgacgtgaagaccctggaggtgctgaagggccccgtgagcttccagaagagccagagattcaagcagcagaaggagagcaagcagaacctgaacgtggacaaggacaccaccctgcccgccagcgccagaaaggtgaagagcagcgagagcaagaaggagagccagaagaacgacaaggacctgaagatcctggagaaggagatcagagtgctgctgcaggagagaggcgcccaggacagaagaatccaggacctggagaccgagctggagaagcagctgatcgagctgaccagaaccaacgagctgctgaagagcaagttcagcgagaacggcaaccagaagaacctgagaatcctgagcctggagctgatgaagctgagaaacaagagagagaccaagatgagaggcatgatggccaagcaggagggcatggagatgaagctgcaggtgacccagagaagcctggaggagagccagggcaagatcgcccagctggagggcaagctggtgagcatcgagaaggagaagatcgacgagaagagcgagaccgagaagctgctggagtacatcgaggagatcagctgcgccagcgaccaggtggagaagtacaagctggacatcgcccagctggaggagaacctgaaggagaagaacgacgagatcctgagcctgaagcagagcctggaggagaacatcgtgatcctgagcaagcaggtggaggacctgaacgtgaagtgccagctgctggagaaggagaaggaggaccacgtgaacagaaacagagagcacaacgagaacctgaacgccgagatgcagaacctgaagcagaagttcatcctggagcagcaggagagagagaagctgcagcagaaggagctgcagatcgacagcctgctgcagcaggagaaggagctgagcagcagcctgcaccagaagctgtgcagcttccaggaggagatggtgaaggagaagaacctgttcgaggaggagctgaagcagaccctggacgagctggacaagctgcagcagaaggaggagcaggccgagagactggtgaagcagctggaggaggaggccaagagcagagccgaggagctgaagctgctggaggagaagctgaagggcaaggaggccgagctggagaagagcagcgccgcccacacccaggccaccctgctgctgcaggagaagtacgacagcatggtgcagagcctggaggacgtgaccgcccagttcgagagctacaaggccctgaccgccagcgagatcgaggacctgaagctggagaacagcagcctgcaggagaaggccgccaaggccggcaagaacgccgaggacgtgcagcaccagatcctggccaccgagagcagcaaccaggagtacgtgagaatgctgctggacctgcagaccaagagcgccctgaaggagaccgagatcaaggagatcaccgtgagcttcctgcagaagatcaccgacctgcagaaccagctgaagcagcaggaggaggacttcagaaagcagctggaggacgaggagggcagaaaggccgagaaggagaacaccaccgccgagctgaccgaggagatcaacaagtggagactgctgtacgaggagctgtacaacaagaccaagcccttccagctgcagctggacgccttcgaggtggagaagcaggccctgctgaacgagcacggcgccgcccaggagcagctgaacaagatcagagacagctacgccaagctgctgggccaccagaacctgaagcagaagatcaagcacgtggtgaagctgaaggacgagaacagccagctgaagagcgaggtgagcaagctgagatgccagctggccaagaagaagcagagcgagaccaagctgcaggaggagctgaacaaggtgctgggcatcaagcacttcgaccccagcaaggccttccaccacgagagcaaggagaacttcgccctgaagacccccctgaaggagggcaacaccaactgctacagagcccccatggagtgccaggagagctggaagtag

SEQ ID NO: 11015 - DNA, 1917 bp, Artificial Sequence
  Description of Artificial Sequence: Synthetic coding sequence
atgaccctgctgatcagagtgctgctgcaggagagaggcgcccaggacagaagaatccaggacctggagaccgagctggagaagatggaggccagactgaacgccgccctgagagagaagaccagcctgagcgccaacaacgccaccctggagaagcagctgatcgagctgaccagaaccaacgagctgctgaagagcaagttcagcgagaacggcaaccagaagaacctgagaatcctgagcctggagctgatgaagctgagaaacaagagagagaccaagatgagaggcatgatggccaagcaggagggcatggagatgaagctgcaggtgacccagagaagcctggaggagagccagggcaagatcgcccagctggagggcaagctggtgagcatcgagaaggagaagatcgacgagaagagcgagaccgagaagctgctggagtacatcgaggagatcagctgcgccagcgaccaggtggagaagtacaagctggacatcgcccagctggaggagaacctgaaggagaagaacgacgagatcctgagcctgaagcagagcctggaggagaacatcgtgatcctgagcaagcaggtggaggacctgaacgtgaagtgccagctgctggagaaggagaaggaggaccacgtgaacagaaacagagagcacaacgagaacctgaacgccgagatgcagaacctgaagcagaagttcatcctggagcagcaggagagagagaagctgcagcagaaggagctgcagatcgacagcctgctgcagcaggagaaggagctgagcagcagcctgcaccagaagctgtgcagcttccaggaggagatggtgaaggagaagaacctgttcgaggaggagctgaagcagaccctggacgagctggacaagctgcagcagaaggaggagcaggccgagagactggtgaagcagctggaggaggaggccaagagcagagccgaggagctgaagctgctggaggagaagctgaagggcaaggaggccgagctggagaagagcagcgccgcccacacccaggccaccctgctgctgcaggagaagtacgacagcatggtgcagagcctggaggacgtgaccgcccagttcgagagctacaaggccctgaccgccagcgagatcgaggacctgaagctggagaacagcagcctgcaggagaaggccgccaaggccggcaagaacgccgaggacgtgcagcaccagatcctggccaccgagagcagcaaccaggagtacgtgagaatgctgctggacctgcagaccaagagcgccctgaaggagaccgagatcaaggagatcaccgtgagcttcctgcagaagatcaccgacctgcagaaccagctgaagcagcaggaggaggacttcagaaagcagctggaggacgaggagggcagaaaggccgagaaggagaacaccaccgccgagctgaccgaggagatcaacaagtggagactgctgtacgaggagctgtacaacaagaccaagcccttccagctgcagctggacgccttcgaggtggagaagcaggccctgctgaacgagcacggcgccgcccaggagcagctgaacaagatcagagacagctacgccaagctgctgggccaccagaacctgaagcagaagatcaagcacgtggtgaagctgaaggacgagaacagccagctgaagagcgaggtgagcaagctgagatgccagctggccaagaagaagcagagcgagaccaagctgcaggaggagctgaacaaggtgctgggcatcaagcacttcgaccccagcaaggccttccaccacgagagcaaggagaacttcgccctgaagacccccctgaaggagggcaacaccaactgctacagagcccccatggagtgccaggagagctggaagtag

SEQ ID NO: 11016 - DNA, 996 bp, Artificial Sequence
  Description of Artificial Sequence: Synthetic coding sequence
atgagcttccccaaggcccccctgaagagattcaacgaccccagcggctgcgcccccagccccggcgcctacgacgtgaagaccctggaggtgctgaagggccccgtgagcttccagaagagccagagattcaagcagcagaaggagagcaagcagaacctgaacgtggacaaggacaccaccctgcccgccagcgccagaaaggtgaagagcagcgagagcaagatcagagtgctgctgcaggagagaggcgcccaggacagaagaatccaggacctggagaccgagctggagaagatggaggccagactgaacgccgccctgagagagaagaccagcctgagcgccaacaacgccaccctggagaagcagctgatcgagctgaccagaaccaacgagctgctgaagagcaagttcagcgagaacggcaaccagaagaacctgagaatcctgagcctggagctgatgaagctgagaaacaagagagagaccaagatgagaggcatgatggccaagcaggagggcatggagatgaagctgcaggtgacccagagaagcctggaggagagccagggcaagatcgcccagctggagggcaagctggtgagcatcgagaaggagaagatcgacgagaagagcgagaccgagaagctgctggagtacatcgaggagatcagctgcgccagcgaccaggtggagaagtacaagctggacatcgcccagctggaggagaacctgaaggagaagaacgacgagatcctgagcctgaagcagagcctggaggagaacatcgtgatcctgagcaagcaggtggaggacctgaacgtgaagtgccagctgctggagaaggagaaggaggaccacgtgaacagaaacagagagcacaacgagaacctgaacgccgagatgcagaacctgaagcagaagttcatcctggagcagcaggagagagagaagctgcagcagaagaagaagcagatgagaagaaagaagtag

SEQ ID NO: 11017 - DNA, 537 bp, Artificial Sequence
  Description of Artificial Sequence: Synthetic coding sequence
atgcacgtgaacggcaaggtggccctggtgaccggcgccgcccagggcatcggcagagccttcgccgaggccctgctgctgaagggcgccaaggtggccctggtggactggaacctggaggccggcgtgcagtgcaaggccgccctggacgagcagttcgagccccagaagaccctgttcatccagtgcgacgtggccgaccagcagcagctgagagacaccttcagaaaggtggtggaccacttcggcagactggacatcctggtgaacaacgccggcgtgaacaacgagaagaactgggagaagaccctgcagatcaacctggtgagcgtgatcagcggcacctacctgggcctggactacatgagcaagcagaacggcggcgagggcggcatcatcatcaacatgagcagcctggccggcctgatgcccgtggcccagcagcccgtgtactgcgccagcaagcacggcatcgtgggcttcaccagaagcgccgcccccaccatcgactgccagtggatcgacaacacccactag

SEQ ID NO: 11018 - DNA, 801 bp, Artificial Sequence
  Description of Artificial Sequence: Synthetic coding sequence
atgcacgtgaacggcaaggtggccctggtgaccggcgccgcccagggcatcggcagagccttcgccgaggccctgctgctgaagggcgccaaggtggccctggtggactggaacctggaggccggcgtgcagtgcaaggccgccctggacgagcagttcgagccccagaagaccctgttcatccagtgcgacgtggccgaccagcagcagctgagagacaccttcagaaaggtggtggaccacttcggcagactggacatcctggtgaacaacgccggcgtgaacaacgagaagaactgggagaagaccctgcagatcaacctggtgagcgtgatcagcggcacctacctgggcctggactacatgagcaagcagaacggcggcgagggcggcatcatcatcaacatgagcagcctggccggcctgatgcccgtggcccagcagcccgtgtactgcgccagcaagcacggcatcgtgggcttcaccagaagcgccgccctggccgccaacctgatgaacagcggcgtgagactgaacgccatctgccccggcttcgtgaacaccgccatcctggagagcatcgagaaggaggagaacatgggccagtacatcgagtacaaggaccacatcaaggacatgatcaagtactacggcatcctggacccccccctgatcgccaacggcctgatcaccctgatcgaggacgacgccctgaacggcgccatcatgaagatcaccaccagcaagggcatccacttccaggactacgacaccacccccttccaggccaagacccagtag

SEQ ID NO: 11019 - DNA, 438 bp, Artificial Sequence
  Description of Artificial Sequence: Synthetic coding sequence
atgagcaagcagaacggcggcgagggcggcatcatcatcaacatgagcagcctggccggcctgatgcccgtggcccagcagcccgtgtactgcgccagcaagcacggcatcgtgggcttcaccagaagcgccgccctggccgccaacctgatgaacagcggcgtgagactgaacgccatctgccccggcttcgtgaacaccgccatcctggagagcatcgagaaggaggagaacatgggccagtacatcgagtacaaggaccacatcaaggacatgatcaagtactacggcatcctggacccccccctgatcgccaacggcctgatcaccctgatcgaggacgacgccctgaacggcgccatcatgaagatcaccaccagcaagggcatccacttccaggactacgacaccacccccttccaggccaagacccagtag

SEQ ID NO: 11020 - DNA, 438 bp, Artificial Sequence; identical to SEQ ID NO: 11019
  Description of Artificial Sequence: Synthetic coding sequence

SEQ ID NO: 11021 - DNA, 432 bp, Artificial Sequence
  Description of Artificial Sequence: Synthetic coding sequence
atgcacgtgaacggcaaggtggccctggtgaccggcgccgcccagggcatcggcagagccttcgccgaggccctgctgctgaagggcgccaaggtggccctggtggactggaacctggaggccggcgtgcagtgcaaggccgccctggacgagcagttcgagccccagaagaccctgttcatccagtgcgacgtggccgaccagcagcagctgagagacaccttcagaaaggtggtggaccacttcggcagactggacatcctggtgaacaacgccggcgtgaacaacgagaagaactgggagaagaccctgcagatcaacctggtgagcgtgatcagcggcacctacctgggcctggactacatgagcaagcagaacggcggcgagggcggcatcatcatcaacatgagcagcctggccgcccaccactag

SEQ ID NO: 11022 - DNA, 2202 bp, Artificial Sequence
  Description of Artificial Sequence: Synthetic coding sequence
atgaccttccccgaggccgacatcctgctgaagagcggcgagtgcgccggccagaccatgctggacaccatggaggcccccggccacagcagacagctgctgctgcagctgaacaaccagagaaccaagggcttcctgtgcgacgtgatcatcgtggtgcagaacgccctgttcagagcccacaagaacgtgctggccgccagcagcgcctacctgaagagcctggtggtgcacgacaacctgctgaacctggaccacgacatggtgagccccgccgtgttcagactggtgctggacttcatctacaccggcagactggccgacggcgccgaggccgccgccgccgccgccgtggcccccggcgccgagcccagcctgggcgccgtgctggccgccgccagctacctgcagatccccgacctggtggccctgtgcaagaagagactgaagagacacggcaagtactgccacctgagaggcggcggcggcggcggcggcggctacgccccctacggcagacccggcagaggcctgagagccgccacccccgtgatccaggcctgctaccccagccccgtgggccccccccccccccccgccgccgagccccccagcggccccgaggccgccgtgaacacccactgcgccgagctgtacgccagcggccccggccccgccgccgccctgtgcgccagcgagagaagatgcagccccctgtgcggcctggacctgagcaagaagagcccccccggcagcgccgcccccgagagacccctggccgagagagagctgccccccagacccgacagcccccccagcgccggccccgccgcctacaaggagccccccctggccctgcccagcctgccccccctgcccttccagaagctggaggaggccgccccccccagcgaccccttcagaggcggcagcggcagccccggccccgagccccccggcagacccgacggccccagcctgctgtacagatggatgaagcacgagcccggcctgggcagctacggcgacgagctgggcagagagagaggcagccccagcgagagatgcgaggagagaggcggcgacgccgccgtgagccccggcggcccccccctgggcctggcccccccccccagataccccggcagcctggacggccccggcgccggcggcgacggcgacgactacaagagcagcagcgaggagaccggcagcagcgaggaccccagcccccccggcggccacctggagggctacccctgcccccacctggcctacggcgagcccgagagcttcggcgacaacctgtacgtgtgcatcccctgcggcaagggcttccccagcagcgagcagctgaacgcccacgtggaggcccacgtggaggaggaggaggccctgtacggcagagccgaggccgccgaggtggccgccggcgccgccggcctgggcccccccttcggcggcggcggcgacaaggtggccggcgcccccggcggcctgggcgagctgctgagaccctacagatgcgccagctgcgacaagagctacaaggaccccgccaccctgagacagcacgagaagacccactggctgaccagaccctacccctgcaccatctgcggcaagaagttcacccagagaggcaccatgaccagacacatgagaagccacctgggcctgaagcccttcgcctgcgacgcctgcggcatgagattcaccagacagtacagactgaccgagcacatgagaatccacagcggcgagaagccctacgagtgccaggtgtgcggcggcaagttcgcccagcagagaaacctgatcagccacatgaagatgcacgccgtgggcggcgccgccggcgccgccggcgccctggccggcctgggcggcctgcccggcgtgcccggccccgacggcaagggcaagctggacttccccgagggcgtgttcgccgtggccagactgaccgccgagcagctgagcctgaagcagcaggacaaggccgccgccgccgagctgctggcccagaccacccacttcctgcacgaccccaaggtggccctggagagcctgtaccccctggccaagttcaccgccgagctgggcctgagccccgacaaggccgccgaggtgctgagccagggcgcccacctggccgccggccccgacggcagaaccatcgacagattcagccccacctag

SEQ ID NO: 11023 - DNA, 2145 bp, Artificial Sequence
  Description of Artificial Sequence: Synthetic coding sequence
atgctggacaccatggaggcccccggccacagcagacagctgctgctgcagctgaacaaccagagaaccaagggcttcctgtgcgacgtgatcatcgtggtgcagaacgccctgttcagagcccacaagaacgtgctggccgccagcagcgcctacctgaagagcctggtggtgcacgacaacctgctgaacctggaccacgacatggtgagccccgccgtgttcagactggtgctggacttcatctacaccggcagactggccgacggcgccgaggccgccgccgccgccgccgtggcccccggcgccgagcccagcctgggcgccgtgctggccgccgccagctacctgcagatccccgacctggtggccctgtgcaagaagagactgaagagacacggcaagtactgccacctgagaggcggcggcggcggcggcggcggctacgccccctacggcagacccggcagaggcctgagagccgccacccccgtgatccaggcctgctaccccagccccgtgggccccccccccccccccgccgccgagccccccagcggccccgaggccgccgtgaacacccactgcgccgagctgtacgccagcggccccggccccgccgccgccctgtgcgccagcgagagaagatgcagccccctgtgcggcctggacctgagcaagaagagcccccccggcagcgccgcccccgagagacccctggccgagagagagctgccccccagacccgacagcccccccagcgccggccccgccgcctacaaggagccccccctggccctgcccagcctgccccccctgcccttccagaagctggaggaggccgccccccccagcgaccccttcagaggcggcagcggcagccccggccccgagccccccggcagacccgacggccccagcctgctgtacagatggatgaagcacgagcccggcctgggcagctacggcgacgagctgggcagagagagaggcagccccagcgagagatgcgaggagagaggcggcgacgccgccgtgagccccggcggcccccccctgggcctggcccccccccccagataccccggcagcctggacggccccggcgccggcggcgacggcgacgactacaagagcagcagcgaggagaccggcagcagcgaggaccccagcccccccggcggccacctggagggctacccctgcccccacctggcctacggcgagcccgagagcttcggcgacaacctgtacgtgtgcatcccctgcggcaagggcttccccagcagcgagcagctgaacgcccacgtggaggcccacgtggaggaggaggaggccctgtacggcagagccgaggccgccgaggtggccgccggcgccgccggcctgggcccccccttcggcggcggcggcgacaaggtggccggcgcccccggcggcctgggcgagctgctgagaccctacagatgcgccagctgcgacaagagctacaaggaccccgccaccctgagacagcacgagaagacccactggctgaccagaccctacccctgcaccatctgcggcaagaagttcacccagagaggcaccatgaccagacacatgagaagccacctgggcctgaagcccttcgcctgcgacgcctgcggcatgagattcaccagacagtacagactgaccgagcacatgagaatccacagcggcgagaagccctacgagtgccaggtgtgcggcggcaagttcgcccagcagagaaacctgatcagccacatgaagatgcacgccgtgggcggcgccgccggcgccgccggcgccctggccggcctgggcggcctgcccggcgtgcccggccccgacggcaagggcaagctggacttccccgagggcgtgttcgccgtggccagactgaccgccgagcagctgagcctgaagcagcaggacaaggccgccgccgccgagctgctggcccagaccacccacttcctgcacgaccccaaggtggccctggagagcctgtaccccctggccaagttcaccgccgagctgggcctgagccccgacaaggccgccgaggtgctgagccagggcgcccacctggccgccggccccgacggcagaaccatcgacagattcagccccacctag

SEQ ID NO: 11024 - DNA, 2208 bp, Artificial Sequence
  Description of Artificial Sequence: Synthetic coding sequence
atggagggcgccggcggcgccaacgacaagaagaagatcagcagcgagagaagaaaggagaagagcagagacgccgccagaagcagaagaagcaaggagagcgaggtgttctacgagctggcccaccagctgcccctgccccacaacgtgagcagccacctggacaaggccagcgtgatgagactgaccatcagctacctgagagtgagaaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgagagagatgctgacccacagaaacggcctggtgaagaagggcaaggagcagaacacccagagaagcttcttcctgagaatgaagtgcaccctgaccagcagaggcagaaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagcagacacagcctggacatgaagttcagctactgcgacgagagaatcaccgagctgatgggctacgagcccgaggagctgctgggcagaagcatctacgagtactaccacgccctggacagcgaccacctgaccaagacccaccacgacatgttcaccaagggccaggtgaccaccggccagtacagaatgctggccaagagaggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgagaagcagcgccgaccccgccctgaaccaggaggtggccctgaagctggagcccaaccccgagagcctggagctgagcttcaccatgccccagatccaggaccagacccccagccccagcgacggcagcaccagacagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgagaagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggacagaatggaggacatcaagatcctgatcgccagccccagccccacccacatccacaaggagaccaccagcgccaccagcagcccctacagagacacccagagcagaaccgccagccccaacagagccggcaagggcgtgatcgagcagaccgagaagagccaccccagaagccccaacgtgctgagcgtggccctgagccagagaaccaccgtgcccgaggaggagctgaaccccaagatcctggccctgcagaacgcccagagaaagagaaagatggagcacgacggcagcctgttccaggccgtgggcatcatctag

SEQ ID NO: 11025 - DNA, 2481 bp, Artificial Sequence
  Description of Artificial Sequence: Synthetic coding sequence
atggagggcgccggcggcgccaacgacaagaagaagatcagcagcgagagaagaaaggagaagagcagagacgccgccagaagcagaagaagcaaggagagcgaggtgttctacgagctggcccaccagctgcccctgccccacaacgtgagcagccacctggacaaggccagcgtgatgagactgaccatcagctacctgagagtgagaaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgagagagatgctgacccacagaaacggcctggtgaagaagggcaaggagcagaacacccagagaagcttcttcctgagaatgaagtgcaccctgaccagcagaggcagaaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagcagacacagcctggacatgaagttcagctactgcgacgagagaatcaccgagctgatgggctacgagcccgaggagctgctgggcagaagcatctacgagtactaccacgccctggacagcgaccacctgaccaagacccaccacgacatgttcaccaagggccaggtgaccaccggccagtacagaatgctggccaagagaggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgagaagcagcgccgaccccgccctgaaccaggaggtggccctgaagctggagcccaaccccgagagcctggagctgagcttcaccatgccccagatccaggaccagacccccagccccagcgacggcagcaccagacagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgagaagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggacagaatggaggacatcaagatcctgatcgccagccccagccccacccacatccacaaggagaccaccagcgccaccagcagcccctacagagacacccagagcagaaccgccagccccaacagagccggcaagggcgtgatcgagcagaccgagaagagccaccccagaagccccaacgtgctgagcgtggccctgagccagagaaccaccgtgcccgaggaggagctgaaccccaagatcctggccctgcagaacgcccagagaaagagaaagatggagcacgacggcagcctgttccaggccgtgggcatcggcaccctgctgcagcagcccgacgaccacgccgccaccaccagcctgagctggaagagagtgaagggctgcaagagcagcgagcagaacggcatggagcagaagaccatcatcctgatccccagcgacctggcctgcagactgctgggccagagcatggacgagagcggcctgccccagctgaccagctacgactgcgaggtgaacgcccccatccagggcagcagaaacctgctgcagggcgaggagctgctgagagccctggaccaggtgaactag

SEQ ID NO: 11026 - DNA, 2304 bp, Artificial Sequence
  Description of Artificial Sequence: Synthetic coding sequence
atgagactgaccatcagctacctgagagtgagaaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgagagagatgctgacccacagaaacggcctggtgaagaagggcaaggagcagaacacccagagaagcttcttcctgagaatgaagtgcaccctgaccagcagaggcagaaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagcagacacagcctggacatgaagttcagctactgcgacgagagaatcaccgagctgatgggctacgagcccgaggagctgctgggcagaagcatctacgagtactaccacgccctggacagcgaccacctgaccaagacccaccacgacatgttcaccaagggccaggtgaccaccggccagtacagaatgctggccaagagaggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgagaagcagcgccgaccccgccctgaaccaggaggtggccctgaagctggagcccaaccccgagagcctggagctgagcttcaccatgccccagatccaggaccagacccccagccccagcgacggcagcaccagacagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgagaagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggacagaatggaggacatcaagatcctgatcgccagccccagccccacccacatccacaaggagaccaccagcgccaccagcagcccctacagagacacccagagcagaaccgccagccccaacagagccggcaagggcgtgatcgagcagaccgagaagagccaccccagaagccccaacgtgctgagcgtggccctgagccagagaaccaccgtgcccgaggaggagctgaaccccaagatcctggccctgcagaacgcccagagaaagagaaagatggagcacgacggcagcctgttccaggccgtgggcatcggcaccctgctgcagcagcccgacgaccacgccgccaccaccagcctgagctggaagagagtgaagggctgcaagagcagcgagcagaacggcatggagcagaagaccatcatcctgatccccagcgacctggcctgcagactgctgggccagagcatggacgagagcggcctgccccagctgaccagctacgactgcgaggtgaacgcccccatccagggcagcagaaacctgctgcagggcgaggagctgctgagagccctggaccaggtgaactag

SEQ ID NO: 11027 - DNA, 2484 bp, Artificial Sequence
  Description of Artificial Sequence: Synthetic coding sequence
atggagggcgccggcggcgccaacgacaagaagaacagaatcagcagcgagagaagaaaggagaagagcagagacgccgccagaagcagaagaagcaaggagagcgaggtgttctacgagctggcccaccagctgcccctgccccacaacgtgagcagccacctggacaaggccagcgtgatgagactgaccatcagctacctgagagtgagaaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgagagagatgctgacccacagaaacggcctggtgaagaagggcaaggagcagaacacccagagaagcttcttcctgagaatgaagtgcaccctgaccagcagaggcagaaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagcagacacagcctggacatgaagttcagctactgcgacgagagaatcaccgagctgatgggctacgagcccgaggagctgctgggcagaagcatctacgagtactaccacgccctggacagcgaccacctgaccaagacccaccacgacatgttcaccaagggccaggtgaccaccggccagtacagaatgctggccaagagaggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgagaagcagcgccgaccccgccctgaaccaggaggtggccctgaagctggagcccaaccccgagagcctggagctgagcttcaccatgccccagatccaggaccagacccccagccccagcgacggcagcaccagacagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgagaagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggacagaatggaggacatcaagatcctgatcgccagccccagccccacccacatccacaaggagaccaccagcgccaccagcagcccctacagagacacccagagcagaaccgccagccccaacagagccggcaagggcgtgatcgagcagaccgagaagagccaccccagaagccccaacgtgctgagcgtggccctgagccagagaaccaccgtgcccgaggaggagctgaaccccaagatcctggccctgcagaacgcccagagaaagagaaagatggagcacgacggcagcctgttccaggccgtgggcatcggcaccctgctgcagcagcccgacgaccacgccgccaccaccagcctgagctggaagagagtgaagggctgcaagagcagcgagcagaacggcatggagcagaagaccatcatcctgatccccagcgacctggcctgcagactgctgggccagagcatggacgagagcggcctgccccagctgaccagctacgactgcgaggtgaacgcccccatccagggcagcagaaacctgctgcagggcgaggagctgctgagagccctggaccaggtgaactag

SEQ ID NO: 11028 - DNA, 2553 bp, Artificial Sequence
  Description of Artificial Sequence: Synthetic coding sequence
atgagcagccagtgcagaagcctggagaacaagttcgtgttcctgaaggagggcctgggcaacagcaagcccgaggagctggaggagatcagaatcgagaacggcagaatcagcagcgagagaagaaaggagaagagcagagacgccgccagaagcagaagaagcaaggagagcgaggtgttctacgagctggcccaccagctgcccctgccccacaacgtgagcagccacctggacaaggccagcgtgatgagactgaccatcagctacctgagagtgagaaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgagagagatgctgacccacagaaacggcctggtgaagaagggcaaggagcagaacacccagagaagcttcttcctgagaatgaagtgcaccctgaccagcagaggcagaaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagcagacacagcctggacatgaagttcagctactgcgacgagagaatcaccgagctgatgggctacgagcccgaggagctgctgggcagaagcatctacgagtactaccacgccctggacagcgaccacctgaccaagacccaccacgacatgttcaccaagggccaggtgaccaccggccagtacagaatgctggccaagagaggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgagaagcagcgccgaccccgccctgaaccaggaggtggccctgaagctggagcccaaccccgagagcctggagctgagcttcaccatgccccagatccaggaccagacccccagccccagcgacggcagcaccagacagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgagaagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggacagaatggaggacatcaagatcctgatcgccagccccagccccacccacatccacaaggagaccaccagcgccaccagcagcccctacagagacacccagagcagaaccgccagccccaacagagccggcaagggcgtgatcgagcagaccgagaagagccaccccagaagccccaacgtgctgagcgtggccctgagccagagaaccaccgtgcccgaggaggagctgaaccccaagatcctggccctgcagaacgcccagagaaagagaaagatggagcacgacggcagcctgttccaggccgtgggcatcggcaccctgctgcagcagcccgacgaccacgccgccaccaccagcctgagctggaagagagtgaagggctgcaagagcagcgagcagaacggcatggagcagaagaccatcatcctgatccccagcgacctggcctgcagactgctgggccagagcatggacgagagcggcctgccccagctgaccagctacgactgcgaggtgaacgcccccatccagggcagcagaaacctgctgcagggcgaggagctgctgagagccctggaccaggtgaactag

SEQ ID NO: 11029 - DNA, 1734 bp, Artificial Sequence
  Description of Artificial Sequence: Synthetic coding sequence
atgaagttcagctactgcgacgagagaatcaccgagctgatgggctacgagcccgaggagctgctgggcagaagcatctacgagtactaccacgccctggacagcgaccacctgaccaagacccaccacgacatgttcaccaagggccaggtgaccaccggccagtacagaatgctggccaagagaggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgagaagcagcgccgaccccgccctgaaccaggaggtggccctgaagctggagcccaaccccgagagcctggagctgagcttcaccatgccccagatccaggaccagacccccagccccagcgacggcagcaccagacagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgagaagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggacagaatggaggacatcaagatcctgatcgccagccccagccccacccacatccacaaggagaccaccagcgccaccagcagcccctacagagacacccagagcagaaccgccagccccaacagagccggcaagggcgtgatcgagcagaccgagaagagccaccccagaagccccaacgtgctgagcgtggccctgagccagagaaccaccgtgcccgaggaggagctgaaccccaagatcctggccctgcagaacgcccagagaaagagaaagatggagcacgacggcagcctgttccaggccgtgggcatcggcaccctgctgcagcagcccgacgaccacgccgccaccaccagcctgagctggaagagagtgaagggctgcaagagcagcgagcagaacggcatggagcagaagaccatcatcctgatccccagcgacctggcctgcagactgctgggccagagcatggacgagagcggcctgccccagctgaccagctacgactgcgaggtgaacgcccccatccagggcagcagaaacctgctgcagggcgaggagctgctgagagccctggaccaggtgaactag

SEQ ID NO: 11030 - DNA, 2304 bp, Artificial Sequence; identical to SEQ ID NO: 11026
  Description of Artificial Sequence: Synthetic coding sequence

SEQ ID NO: 11031 - DNA, 1296 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11032 - DNA, 1245 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11033 - DNA, 1413 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgtggagaagccctacaagtgcgagttctgcggcagaagctacaagcagagaagcagcctggaggagcacaaggagagatgcagaaccttcctgcagagcaccgaccccggcgacaccggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11034 - DNA, 1413 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11035 - DNA, 1101 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgtggagaagccctacaagtgcgagttctgcggcagaagctacaagcagagaagcagcctggaggagcacaaggagagatgcagaaccttcctgcagagcaccgaccccggcgacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11036 - DNA, 1128 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11037 - DNA, 867 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11038 - DNA, 1269 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgtggagaagccctacaagtgcgagttctgcggcagaagctacaagcagagaagcagcctggaggagcacaaggagagatgcagaaccttcctgcagagcaccgaccccggcgacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11039 - DNA, 984 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11040 - DNA, 1392 bp, Artificial Sequence
  Description of Artificial Sequence: Synthetic coding sequence
tgacaggagcagagcgtgcccgccgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgtggagaagccctacaagtgcgagttctgcggcagaagctacaagcagagaagcagcctggaggagcacaaggagagatgcagaaccttcctgcagagcaccgaccccggcgacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11041 - DNA, 1275 bp, Artificial Sequence
  Description of Artificial Sequence: Synthetic coding sequence
tgacaggagcagagcgtgcccgccgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11042 - DNA, 1362 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccgtggagaagccctacaagtgcgagttctgcggcagaagctacaagcagagaagcagcctggaggagcacaaggagagatgcagaaccttcctgcagagcaccgaccccggcgacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11043 - DNA, 1530 bp, Artificial Sequence
  Description of Artificial Sequence: Synthetic coding sequence
atggaggacatccagaccaacgccgagctgaagagcacccaggagcagagcgtgcccgccgagagcgccgccgtgctgaacgactacagcctgaccaagagccacgagatggagaacgtggacagcggcgagggccccgccaacgaggacgaggacatcggcgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgtggagaagccctacaagtgcgagttctgcggcagaagctacaagcagagaagcagcctggaggagcacaaggagagatgcagaaccttcctgcagagcaccgaccccggcgacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11044 - DNA, 1428 bp, Artificial Sequence
  Description of Artificial Sequence: Synthetic coding sequence
atggaggacatccagaccaacgccgagctgaagagcacccaggagcagagcgtgcccgccgacgacagcatgaaggtgaaggacgagtacagcgagagagacgagaacgtgctgaagagcgagcccatgggcaacgccgaggagcccgagatcccctacagctacagcagagagtacaacgagtacgagaacatcaagctggagagacacgtggtgagcttcgacagcagcagacccaccagcggcaagatgaactgcgacgtgtgcggcctgagctgcatcagcttcaacgtgctgatggtgcacaagagaagccacaccggcgagagacccttccagtgcaaccagtgcggcgccagcttcacccagaagggcaacctgctgagacacatcaagctgcacaccggcgagaagcccttcaagtgccacctgtgcaactacgcctgccagagaagagacgccctgaccggccacctgagaacccacagcgtggagaagccctacaagtgcgagttctgcggcagaagctacaagcagagaagcagcctggaggagcacaaggagagatgcagaaccttcctgcagagcaccgaccccggcgacaccgccagcgccgaggccagacacatcaaggccgagatgggcagcgagagagccctggtgctggacagactggccagcaacgtggccaagagaaagagcagcatgccccagaagttcatcggcgagaagagacactgcttcgacgtgaactacaacagcagctacatgtacgagaaggagagcgagctgatccagaccagaatgatggaccaggccatcaacaacgccatcagctacctgggcgccgaggccctgagacccctggtgcagaccccccccgcccccaccagcgagatggtgcccgtgatcagcagcatgtaccccatcgccctgaccagagccgagatgagcaacggcgccccccaggagctggagaagaagagcatccacctgcccgagaagagcgtgcccagcgagagaggcctgagccccaacaacagcggccacgacagcaccgacaccgacagcaaccacgaggagagacagaaccacatctaccagcagaaccacatggtgctgagcagagccagaaacggcatgcccctgctgaaggaggtgcccagaagctacgagctgctgaagcccccccccatctgccccagagacagcgtgaaggtgatcaacaaggagggcgaggtgatggacgtgtacagatgcgaccactgcagagtgctgttcctggactacgtgatgttcaccatccacatgggctgccacggcttcagagaccccttcgagtgcaacatgtgcggctacagaagccacgacagatacgagttcagcagccacatcgccagaggcgagcacagagccctgctgaagtag

SEQ ID NO: 11045 - DNA, 450 bp, Artificial Sequence
  Description of Artificial Sequence: Synthetic coding sequence
atgaaggtggccagcggcagcaccgccaccgccgccgccggccccagctgcgccctgaaggccggcaagaccgccagcggcgccggcgaggtggtgagatgcctgagcgagcagagcgtggccatcagcagatgcgccggcggcgccggcgccagactgcccgccctgctggacgagcagcaggtgaacgtgctgctgtacgacatgaacggctgctacagcagactgaaggagctggtgcccaccctgccccagaacagaaaggtgagcaaggtggagatcctgcagcacgtgatcgactacatcagagacctgcagctggagctgaacagcgagagcgaggtgggcacccccggcggcagaggcctgcccgtgagagcccccctgagcaccctgaacggcgagatcagcgccctgaccgccgaggtgagaagcagaagcgaccactag

SEQ ID NO: 11046 - DNA, 468 bp, Artificial Sequence
  Description of Artificial Sequence: Synthetic coding sequence
atgaaggtggccagcggcagcaccgccaccgccgccgccggccccagctgcgccctgaaggccggcaagaccgccagcggcgccggcgaggtggtgagatgcctgagcgagcagagcgtggccatcagcagatgcgccggcggcgccggcgccagactgcccgccctgctggacgagcagcaggtgaacgtgctgctgtacgacatgaacggctgctacagcagactgaaggagctggtgcccaccctgccccagaacagaaaggtgagcaaggtggagatcctgcagcacgtgatcgactacatcagagacctgcagctggagctgaacagcgagagcgaggtgggcacccccggcggcagaggcctgcccgtgagagcccccctgagcaccctgaacggcgagatcagcgccctgaccgccgaggccgcctgcgtgcccgccgacgacagaatcctgtgcagatag

SEQ ID NO: 11047 - DNA, 738 bp, Artificial Sequence
  Description of Artificial Sequence: Synthetic coding sequence
atggccgccggcatgtacctggagcactacctggacagcatcgagaacctgcccttcgagctgcagagaaacttccagctgatgagagacctggaccagagaaccgaggacctgaaggccgagatcgacaagctggccaccgagtacatgagcagcgccagaagcctgagcagcgaggagaagctggccctgctgaagcagatccaggaggcctacggcaagtgcaaggagttcggcgacgacaaggtgcagctggccatgcagacctacgagatggtggacaagcacatcagaagactggacaccgacctggccagattcgaggccgacctgaaggagaagcagatcgagagcagcgactacgacagcagcagcagcaagggcagaacccagaaggagaagaaggccgccagagccagaagcaagggcaagaacagcgacgaggaggcccccaagaccgcccagaagaagctgaagctggtgagaaccagccccgagtacggcatgcccagcgtgaccttcggcagcgtgcaccccagcgacgtgctggacatgcccgtggaccccaacgagcccacctactgcctgtgccaccaggtgagctacggcgagatgatcggctgcgacaaccccgactgcagcatcgagtggttccacttcgcctgcgtgggcctgaccaccaagcccagaggcaagtggttctgccccagatgcagccaggagagaaagaagaagtag

SEQ ID NO: 11048 - DNA, 840 bp, Artificial Sequence
  Description of Artificial Sequence: Synthetic coding sequence
atgctgagccccgccaacggcgagcagctgcacctggtgaactacgtggaggactacctggacagcatcgagagcctgcccttcgacctgcagagaaacgtgagcctgatgagagagatcgacgccaagtaccaggagatcctgaaggagctggacgagtgctacgagagattcagcagagagaccgacggcgcccagaagagaagaatgctgcactgcgtgcagagagccctgatcagaagccaggagctgggcgacgagaagatccagatcgtgagccagatggtggagctggtggagaacagaaccagacaggtggacagccacgtggagctgttcgaggcccagcaggagctgggcgacaccgccggcaacagcggcaaggccggcgccgacagacccaagggcgaggccgccgcccaggccgacaagcccaacagcaagagaagcagaagacagagaaacaacgagaacagagagaacgccagcagcaaccacgaccacgacgacggcgccagcggcacccccaaggagaagaaggccaagaccagcaagaagaagaagagaagcaaggccaaggccgagagagaggccagccccgccgacctgcccatcgaccccaacgagcccacctactgcctgtgcaaccaggtgagctacggcgagatgatcggctgcgacaacgacgagtgccccatcgagtggttccacttcagctgcgtgggcctgaaccacaagcccaagggcaagtggtactgccccaagtgcagaggcgagaacgagaagaccatggacaaggccctggagaagagcaagaaggagagagcctacaacagatag

SEQ ID NO: 11049 - DNA, 708 bp, Artificial Sequence
  Description of Artificial Sequence: Synthetic coding sequence
atggagatcctgaaggagctggacgagtgctacgagagattcagcagagagaccgacggcgcccagaagagaagaatgctgcactgcgtgcagagagccctgatcagaagccaggagctgggcgacgagaagatccagatcgtgagccagatggtggagctggtggagaacagaaccagacaggtggacagccacgtggagctgttcgaggcccagcaggagctgggcgacaccgccggcaacagcggcaaggccggcgccgacagacccaagggcgaggccgccgcccaggccgacaagcccaacagcaagagaagcagaagacagagaaacaacgagaacagagagaacgccagcagcaaccacgaccacgacgacggcgccagcggcacccccaaggagaagaaggccaagaccagcaagaagaagaagagaagcaaggccaaggccgagagagaggccagccccgccgacctgcccatcgaccccaacgagcccacctactgcctgtgcaaccaggtgagctacggcgagatgatcggctgcgacaacgacgagtgccccatcgagtggttccacttcagctgcgtgggcctgaaccacaagcccaagggcaagtggtactgccccaagtgcagaggcgagaacgagaagaccatggacaaggccctggagaagagcaagaaggagagagcctacaacagatag

SEQ ID NO: 11050 - DNA, 1269 bp, Artificial Sequence
  Description of Artificial Sequence: Synthetic coding sequence
atgagcttcgtggagtgcccctaccacagccccgccgagagactggtggccgaggccgacgagggcggccccagcgccatcaccggcatgggcctgtgcttcagatgcctgctgttcagcttcagcggcagaagcggcgtggagggcggcagagtggacctgaacgtgttcggcagcctgggcctgcagccctggatcggcagcagcagatgctggggcggcccctgcagcagcgccctgagatgcggctggttcagcagctggcccccccccagcaagagcgccatccccatcggcggcggcagcagaggcgccggcagagtgagcagatggccccccccccactggctggaggcctggagagtgagccccctgcccctgagccccctgagccccgccaccttcggcagaggcttcatcgccgtggccgtgatccccggcctgtgggccagaggcagaggctgcagcagcgacagactgcccagacccgccggccccgccagaagacagttccaggccgccagcctgctgaccagaggctggggcagagcctggccctggaagcagatcctgaaggagctggacgagtgctacgagagattcagcagagagaccgacggcgcccagaagagaagaatgctgcactgcgtgcagagagccctgatcagaagccaggagctgggcgacgagaagatccagatcgtgagccagatggtggagctggtggagaacagaaccagacaggtggacagccacgtggagctgttcgaggcccagcaggagctgggcgacaccgccggcaacagcggcaaggccggcgccgacagacccaagggcgaggccgccgcccaggccgacaagcccaacagcaagagaagcagaagacagagaaacaacgagaacagagagaacgccagcagcaaccacgaccacgacgacggcgccagcggcacccccaaggagaagaaggccaagaccagcaagaagaagaagagaagcaaggccaaggccgagagagaggccagccccgccgacctgcccatcgaccccaacgagcccacctactgcctgtgcaaccaggtgagctacggcgagatgatcggctgcgacaacgacgagtgccccatcgagtggttccacttcagctgcgtgggcctgaaccacaagcccaagggcaagtggtactgccccaagtgcagaggcgagaacgagaagaccatggacaaggccctggagaagagcaagaaggagagagcctacaacagatag

SEQ ID NO: 11051 - DNA, 633 bp, Artificial Sequence
  Description of Artificial Sequence: Synthetic coding sequence
atgctgcactgcgtgcagagagccctgatcagaagccaggagctgggcgacgagaagatccagatcgtgagccagatggtggagctggtggagaacagaaccagacaggtggacagccacgtggagctgttcgaggcccagcaggagctgggcgacaccgccggcaacagcggcaaggccggcgccgacagacccaagggcgaggccgccgcccaggccgacaagcccaacagcaagagaagcagaagacagagaaacaacgagaacagagagaacgccagcagcaaccacgaccacgacgacggcgccagcggcacccccaaggagaagaaggccaagaccagcaagaagaagaagagaagcaaggccaaggccgagagagaggccagccccgccgacctgcccatcgaccccaacgagcccacctactgcctgtgcaaccaggtgagctacggcgagatgatcggctgcgacaacgacgagtgccccatcgagtggttccacttcagctgcgtgggcctgaaccacaagcccaagggcaagtggtactgccccaagtgcagaggcgagaacgagaagaccatggacaaggccctggagaagagcaagaaggagagagcctacaacagatag

SEQ ID NO: 11052 - DNA, 747 bp, Artificial Sequence
  Description of Artificial Sequence: Synthetic coding sequence
atggccgccggcatgtacctggagcactacctggacagcatcgagaacctgcccttcgagctgcagagaaacttccagctgatgagagacctggaccagagaaccgaggacctgaaggccgagatcgacaagctggccaccgagtacatgagcagcgccagaagcctgagcagcgaggagaagctggccctgctgaagcagatccaggaggcctacggcaagtgcaaggagttcggcgacgacaaggtgcagctggccatgcagacctacgagatggtggacaagcacatcagaagactggacaccgacctggccagattcgaggccgacctgaaggagaagcagatcgagagcagcgactacgacagcagcagcagcaagggcaagaagagcagaacccagaaggagaagaaggccgccagagccagaagcaagggcaagaacagcgacgaggaggcccccaagaccgcccagaagaagctgaagctggtgagaaccagccccgagtacggcatgcccagcgtgaccttcggcagcgtgcaccccagcgacgtgctggacatgcccgtggaccccaacgagcccacctactgcctgtgccaccaggtgagctacggcgagatgatcggctgcgacaaccccgactgcagcatcgagtggttccacttcgcctgcgtgggcctgaccaccaagcccagaggcaagtggttctgccccagatgcagccaggagagaaagaagaagtag

SEQ ID NO: 11053 - DNA, 750 bp, Artificial Sequence
  Description of Artificial Sequence: Synthetic coding sequence
atggccgccggcatgtacctggagcactacctggacagcatcgagaacctgcccttcgagctgcagagaaacttccagctgatgagagacctggaccagagaaccgaggacctgaaggccgagatcgacaagctggccaccgagtacatgagcagcgccagaagcctgagcagcgaggagaagctggccctgctgaagcagatccaggaggcctacggcaagtgcaaggagttcggcgacgacaaggtgcagctggccatgcagacctacgagatggtggacaagcacatcagaagactggacaccgacctggccagattcgaggccgacctgaaggagaagcagatcgagagcagcgactacgacagcagcagcagcaagggcaagaagaagggcagaacccagaaggagaagaaggccgccagagccagaagcaagggcaagaacagcgacgaggaggcccccaagaccgcccagaagaagctgaagctggtgagaaccagccccgagtacggcatgcccagcgtgaccttcggcagcgtgcaccccagcgacgtgctggacatgcccgtggaccccaacgagcccacctactgcctgtgccaccaggtgagctacggcgagatgatcggctgcgacaaccccgactgcagcatcgagtggttccacttcgcctgcgtgggcctgaccaccaagcccagaggcaagtggttctgccccagatgcagccaggagagaaagaagaagtag

SEQ ID NO: 11054 - DNA, 741 bp, Artificial Sequence
  Description of Artificial Sequence: Synthetic coding sequence
atggccgccggcatgtacctggagcactacctggacagcatcgagaacctgcccttcgagctgcagagaaacttccagctgatgagagacctggaccagagaaccgaggacctgaaggccgagatcgacaagctggccaccgagtacatgagcagcgccagaagcctgagcagcgaggagaagctggccctgctgaagcagatccaggaggcctacggcaagtgcaaggagttcggcgacgacaaggtgcagctggccatgcagacctacgagatggtggacaagcacatcagaagactggacaccgacctggccagattcgaggccgacctgaaggagaagcagatcgagagcagcgactacgacagcagcagcagcaaggagggcagaacccagaaggagaagaaggccgccagagccagaagcaagggcaagaacagcgacgaggaggcccccaagaccgcccagaagaagctgaagctggtgagaaccagccccgagtacggcatgcccagcgtgaccttcggcagcgtgcaccccagcgacgtgctggacatgcccgtggaccccaacgagcccacctactgcctgtgccaccaggtgagctacggcgagatgatcggctgcgacaaccccgactgcagcatcgagtggttccacttcgcctgcgtgggcctgaccaccaagcccagaggcaagtggttctgccccagatgcagccaggagagaaagaagaagtag

SEQ ID NO: 11055 - DNA, 540 bp, Artificial Sequence
  Description of Artificial Sequence: Synthetic coding sequence
atggccgccggcatgtacctggagcactacctggacagcatcgagaacctgcccttcgagctgcagagaaacttccagctgatgagagacctggaccagagaaccgaggacctgaaggccgagatcgacaagctggccaccgagtacatgagcagcgccagaagcctgagcagcgaggagaagctggccctgctgaagcagatccaggaggcctacggcaagtgcaaggagttcggcgacgacaaggtgcagctggccatgcagacctacgagatggtggacaagcacatcagaagactggacaccgacctggccagattcgaggccgacctgaaggagaagcagatcgagagcagcgactacgacagcagcagcagcaagggcaagaagaagggcagaacccagaaggagaagaaggccgccagagccagaagcaagggcaagaacagcgacgaggaggcccccaagaccgcccagaagaagctgaagctggtgagaaccgtgcccctgagcggcagcatcctgcccgtgtggggctag

SEQ ID NO: 11056 - DNA, 678 bp, Artificial Sequence
  Description of Artificial Sequence: Synthetic coding sequence
atggccgccggcatgtacctggagcactacctggacaacctgaaggccgagatcgacaagctggccaccgagtacatgagcagcgccagaagcctgagcagcgaggagaagctggccctgctgaagcagatccaggaggcctacggcaagtgcaaggagttcggcgacgacaaggtgcagctggccatgcagacctacgagatggtggacaagcacatcagaagactggacaccgacctggccagattcgaggccgacctgaaggagaagcagatcgagagcagcgactacgacagcagcagcagcaagggcaagaagaagggcagaacccagaaggagaagaaggccgccagagccagaagcaagggcaagaacagcgacgaggaggcccccaagaccgcccagaagaagctgaagctggtgagaaccagccccgagtacggcatgcccagcgtgaccttcggcagcgtgcaccccagcgacgtgctggacatgcccgtggaccccaacgagcccacctactgcctgtgccaccaggtgagctacggcgagatgatcggctgcgacaaccccgactgcagcatcgagtggttccacttcgcctgcgtgggcctgaccaccaagcccagaggcaagtggttctgccccagatgcagccaggagagaaagaagaagtag

SEQ ID NO: 11057 - DNA, 3729 bp, Artificial Sequence
  Description of Artificial Sequence: Synthetic coding sequence
atggccagcccccccgagagcgacggcttcagcgacgtgagaaaggtgggctacctgagaaagcccaagagcatgcacaagagattcttcgtgctgagagccgccagcgaggccggcggccccgccagactggagtactacgagaacgagaagaagtggagacacaagagcagcgcccccaagagaagcatccccctggagagctgcttcaacatcaacaagagagccgacagcaagaacaagcacctggtggccctgtacaccagagacgagcacttcgccatcgccgccgacagcgaggccgagcaggacagctggtaccaggccctgctgcagctgcacaacagagccaagggccaccacgacggcgccgccgccctgggcgccggcggcggcggcggcagctgcagcggcagcagcggcctgggcgaggccggcgaggacctgagctacggcgacgtgccccccggccccgccttcaaggaggtgtggcaggtgatcctgaagcccaagggcctgggccagaccaagaacctgatcggcatctacagactgtgcctgaccagcaagaccatcagcttcgtgaagctgaacagcgaggccgccgccgtggtgctgcagctgatgaacatcagaagatgcggccacagcgagaacttcttcttcatcgaggtgggcagaagcgccgtgaccggccccggcgagttctggatgcaggtggacgacagcgtggtggcccagaacatgcacgagaccatcctggaggccatgagagccatgagcgacgagttcagacccagaagcaagagccagagcagcagcaactgcagcaaccccatcagcgtgcccctgagaagacaccacctgaacaaccccccccccagccaggtgggcctgaccagaagaagcagaaccgagagcatcaccgccaccagccccgccagcatggtgggcggcaagcccggcagcttcagagtgagagccagcagcgacggcgagggcaccatgagcagacccgccagcgtggacggcagccccgtgagccccagcaccaacagaacccacgcccacagacacagaggcagcgccagactgcacccccccctgaaccacagcagaagcatccccatgcccgccagcagatgcagccccagcgccaccagccccgtgagcctgagcagcagcagcaccagcggccacggcagcaccagcgactgcctgttccccagaagaagcagcgccagcgtgagcggcagccccagcgacggcggcttcatcagcagcgacgagtacggcagcagcccctgcgacttcagaagcagcttcagaagcgtgacccccgacagcctgggccacaccccccccgccagaggcgaggaggagctgagcaactacatctgcatgggcggcaagggccccagcaccctgaccgcccccaacggccactacatcctgagcagaggcggcaacggccacagatgcacccccggcaccggcctgggcaccagccccgccctggccggcgacgaggccgccagcgccgccgacctggacaacagattcagaaagagaacccacagcgccggcaccagccccaccatcacccaccagaagacccccagccagagcagcgtggccagcatcgaggagtacaccgagatgatgcccgcctacccccccggcggcggcagcggcggcagactgcccggccacagacacagcgccttcgtgcccaccagaagctaccccgaggagggcctggagatgcaccccctggagagaagaggcggccaccacagacccgacagcagcaccctgcacaccgacgacggctacatgcccatgagccccggcgtggcccccgtgcccagcggcagaaagggcagcggcgactacatgcccatgagccccaagagcgtgagcgccccccagcagatcatcaaccccatcagaagacacccccagagagtggaccccaacggctacatgatgatgagccccagcggcggctgcagccccgacatcggcggcggccccagcagcagcagcagcagcagcaacgccgtgcccagcggcaccagctacggcaagctgtggaccaacggcgtgggcggccaccacagccacgtgctgccccaccccaagccccccgtggagagcagcggcggcaagctgctgccctgcaccggcgactacatgaacatgagccccgtgggcgacagcaacaccagcagccccagcgactgctactacggccccgaggacccccagcacaagcccgtgctgagctactacagcctgcccagaagcttcaagcacacccagagacccggcgagcccgaggagggcgccagacaccagcacctgagactgagcaccagcagcggcagactgctgtacgccgccaccgccgacgacagcagcagcagcaccagcagcgacagcctgggcggcggctactgcggcgccagactggagcccagcctgccccacccccaccaccaggtgctgcagccccacctgcccagaaaggtggacaccgccgcccagaccaacagcagactggccagacccaccagactgagcctgggcgaccccaaggccagcaccctgcccagagccagagagcagcagcagcagcagcagcccctgctgcacccccccgagcccaagagccccggcgagtacgtgaacatcgagttcggcagcgaccagagcggctacctgagcggccccgtggccttccacagcagccccagcgtgagatgccccagccagctgcagcccgcccccagagaggaggagaccggcaccgaggagtacatgaagatggacctgggccccggcagaagagccgcctggcaggagagcaccggcgtggagatgggcagactgggccccgccccccccggcgccgccagcatctgcagacccaccagagccgtgcccagcagcagaggcgactacatgaccatgcagatgagctgccccagacagagctacgtggacaccagccccgccgcccccgtgagctacgccgacatgagaaccggcatcgccgccgaggaggtgagcctgcccagagccaccatggccgccgccagcagcagcagcgccgccagcgccagccccaccggcccccagggcgccgccgagctggccgcccacagcagcctgctgggcggcccccagggccccggcggcatgagcgccttcaccagagtgaacctgagccccaacagaaaccagagcgccaaggtgatcagagccgacccccagggctgcagaagaagacacagcagcgagaccttcagcagcacccccagcgccaccagagtgggcaacaccgtgcccttcggcgccggcgccgccgtgggcggcggcggcggcagcagcagcagcagcgaggacgtgaagagacacagcagcgccagcttcgagaacgtgtggctgagacccggcgagctgggcggcgcccccaaggagcccgccaagctgtgcggcgccgccggcggcctggagaacggcctgaactacatcgacctggacctggtgaaggacttcaagcagtgcccccaggagtgcacccccgagccccagccccccccccccccccccccccaccagcccctgggcagcggcgagagcagcagcaccagaagaagcagcgaggacctgagcgcctacgccagcatcagcttccagaagcagcccgaggacagacagtag

SEQ ID NO: 11058 - DNA, 588 bp, Artificial Sequence
  Description of Artificial Sequence: Synthetic coding sequence
atgggcaagatcagcagcctgcccacccagctgttcaagtgctgcttctgcgacttcctgaaggtgaagatgcacaccatgagcagcagccacctgttctacctggccctgtgcctgctgaccttcaccagcagcgccaccgccggccccgagaccctgtgcggcgccgagctggtggacgccctgcagttcgtgtgcggcgacagaggcttctacttcaacaagcccaccggctacggcagcagcagcagaagagccccccagaccggcatcgtggacgagtgctgcttcagaagctgcgacctgagaagactggagatgtactgcgcccccctgaagcccgccaagagcgccagaagcgtgagagcccagagacacaccgacatgcccaagacccagaagtaccagccccccagcaccaacaagaacaccaagagccagagaagaaagggctggcccaagacccaccccggcggcgagcagaaggagggcaccgaggccagcctgcagatcagaggcaagaagaaggagcagagaagagagatcggcagcagaaacgccgagtgcagaggcaagaagggcaagtag

SEQ ID NO: 11059 - DNA, 462 bp, Artificial Sequence
  Description of Artificial Sequence: Synthetic coding sequence
atgggcaagatcagcagcctgcccacccagctgttcaagtgctgcttctgcgacttcctgaaggtgaagatgcacaccatgagcagcagccacctgttctacctggccctgtgcctgctgaccttcaccagcagcgccaccgccggccccgagaccctgtgcggcgccgagctggtggacgccctgcagttcgtgtgcggcgacagaggcttctacttcaacaagcccaccggctacggcagcagcagcagaagagccccccagaccggcatcgtggacgagtgctgcttcagaagctgcgacctgagaagactggagatgtactgcgcccccctgaagcccgccaagagcgccagaagcgtgagagcccagagacacaccgacatgcccaagacccagaaggaggtgcacctgaagaacgccagcagaggcagcgccggcaacaagaactacagaatgtag

SEQ ID NO: 11060 - DNA, 477 bp, Artificial Sequence
  Description of Artificial Sequence: Synthetic coding sequence
atgggcaagatcagcagcctgcccacccagctgttcaagtgctgcttctgcgacttcctgaaggtgaagatgcacaccatgagcagcagccacctgttctacctggccctgtgcctgctgaccttcaccagcagcgccaccgccggccccgagaccctgtgcggcgccgagctggtggacgccctgcagttcgtgtgcggcgacagaggcttctacttcaacaagcccaccggctacggcagcagcagcagaagagccccccagaccggcatcgtggacgagtgctgcttcagaagctgcgacctgagaagactggagatgtactgcgcccccctgaagcccgccaagagcgccagaagcgtgagagcccagagacacaccgacatgcccaagacccagaagtaccagccccccagcaccaacaagaacaccaagagccagagaagaaagggcagcaccttcgaggagagaaagtag

SEQ ID NO: 11061 - DNA, 420 bp, Artificial Sequence
  Description of Artificial Sequence: Synthetic coding sequence
ctgaaggtgaagatgcacaccatgagcagcagccacctgttctacctggccctgtgcctgctgaccttcaccagcagcgccaccgccggccccgagaccctgtgcggcgccgagctggtggacgccctgcagttcgtgtgcggcgacagaggcttctacttcaacaagcccaccggctacggcagcagcagcagaagagccccccagaccggcatcgtggacgagtgctgcttcagaagctgcgacctgagaagactggagatgtactgcgcccccctgaagcccgccaagagcgccagaagcgtgagagcccagagacacaccgacatgcccaagacccagaagtaccagccccccagcaccaacaagaacaccaagagccagagaagaaagggcagcaccttcgaggagagaaagtag

SEQ ID NO: 11062 - DNA, 414 bp, Artificial Sequence
  Description of Artificial Sequence: Synthetic coding sequence
atgatcacccccaccgtgaagatgcacaccatgagcagcagccacctgttctacctggccctgtgcctgctgaccttcaccagcagcgccaccgccggccccgagaccctgtgcggcgccgagctggtggacgccctgcagttcgtgtgcggcgacagaggcttctacttcaacaagcccaccggctacggcagcagcagcagaagagccccccagaccggcatcgtggacgagtgctgcttcagaagctgcgacctgagaagactggagatgtactgcgcccccctgaagcccgccaagagcgccagaagcgtgagagcccagagacacaccgacatgcccaagacccagaaggaggtgcacctgaagaacgccagcagaggcagcgccggcaacaagaactacagaatgtag

SEQ ID NO: 11063 - DNA, 477 bp, Artificial Sequence; identical to SEQ ID NO: 11060
  Description of Artificial Sequence: Synthetic coding sequence

SEQ ID NO: 11064 - DNA, 4104 bp, Artificial Sequence
  Description of Artificial Sequence: Synthetic coding sequence
atgaagagcggcagcggcggcggcagccccaccagcctgtggggcctgctgttcctgagcgccgccctgagcctgtggcccaccagcggcgagatctgcggccccggcatcgacatcagaaacgactaccagcagctgaagagactggagaactgcaccgtgatcgagggctacctgcacatcctgctgatcagcaaggccgaggactacagaagctacagattccccaagctgaccgtgatcaccgagtacctgctgctgttcagagtggccggcctggagagcctgggcgacctgttccccaacctgaccgtgatcagaggctggaagctgttctacaactacgccctggtgatcttcgagatgaccaacctgaaggacatcggcctgtacaacctgagaaacatcaccagaggcgccatcagaatcgagaagaacgccgacctgtgctacctgagcaccgtggactggagcctgatcctggacgccgtgagcaacaactacatcgtgggcaacaagccccccaaggagtgcggcgacctgtgccccggcaccatggaggagaagcccatgtgcgagaagaccaccatcaacaacgagtacaactacagatgctggaccaccaacagatgccagaagatgtgccccagcacctgcggcaagagagcctgcaccgagaacaacgagtgctgccaccccgagtgcctgggcagctgcagcgcccccgacaacgacaccgcctgcgtggcctgcagacactactactacgccggcgtgtgcgtgcccgcctgcccccccaacacctacagattcgagggctggagatgcgtggacagagacttctgcgccaacatcctgagcgccgagagcagcgacagcgagggcttcgtgatccacgacggcgagtgcatgcaggagtgccccagcggcttcatcagaaacggcagccagagcatgtactgcatcccctgcgagggcccctgccccaaggtgtgcgaggaggagaagaagaccaagaccatcgacagcgtgaccagcgcccagatgctgcagggctgcaccatcttcaagggcaacctgctgatcaacatcagaagaggcaacaacatcgccagcgagctggagaacttcatgggcctgatcgaggtggtgaccggctacgtgaagatcagacacagccacgccctggtgagcctgagcttcctgaagaacctgagactgatcctgggcgaggagcagctggagggcaactacagcttctacgtgctggacaaccagaacctgcagcagctgtgggactgggaccacagaaacctgaccatcaaggccggcaagatgtacttcgccttcaaccccaagctgtgcgtgagcgagatctacagaatggaggaggtgaccggcaccaagggcagacagagcaagggcgacatcaacaccagaaacaacggcgagagagccagctgcgagagcgacgtgctgcacttcaccagcaccaccaccagcaagaacagaatcatcatcacctggcacagatacagaccccccgactacagagacctgatcagcttcaccgtgtactacaaggaggcccccttcaagaacgtgaccgagtacgacggccaggacgcctgcggcagcaacagctggaacatggtggacgtggacctgccccccaacaaggacgtggagcccggcatcctgctgcacggcctgaagccctggacccagtacgccgtgtacgtgaaggccgtgaccctgaccatggtggagaacgaccacatcagaggcgccaagagcgagatcctgtacatcagaaccaacgccagcgtgcccagcatccccctggacgtgctgagcgccagcaacagcagcagccagctgatcgtgaagtggaacccccccagcctgcccaacggcaacctgagctactacatcgtgagatggcagagacagccccaggacggctacctgtacagacacaactactgcagcaaggacaagatccccatcagaaagtacgccgacggcaccatcgacatcgaggaggtgaccgagaaccccaagaccgaggtgtgcggcggcgagaagggcccctgctgcgcctgccccaagaccgaggccgagaagcaggccgagaaggaggaggccgagtacagaaaggtgttcgagaacttcctgcacaacagcatcttcgtgcccagacccgagagaaagagaagagacgtgatgcaggtggccaacaccaccatgagcagcagaagcagaaacaccaccgccgccgacacctacaacatcaccgaccccgaggagctggagaccgagtaccccttcttcgagagcagagtggacaacaaggagagaaccgtgatcagcaacctgagacccttcaccctgtacagaatcgacatccacagctgcaaccacgaggccgagaagctgggctgcagcgccagcaacttcgtgttcgccagaaccatgcccgccgagggcgccgacgacatccccggccccgtgacctgggagcccagacccgagaacagcatcttcctgaagtggcccgagcccgagaaccccaacggcctgatcctgatgtacgagatcaagtacggcagccaggtggaggaccagagagagtgcgtgagcagacaggagtacagaaagtacggcggcgccaagctgaacagactgaaccccggcaactacaccgccagaatccaggccaccagcctgagcggcaacggcagctggaccgaccccgtgttcttctacgtgcaggccaagaccggctacgagaacttcatccacctgatcatcgccctgcccgtggccgtgctgctgatcgtgggcggcctggtgatcatgctgtacgtgttccacagaaagagaaacaacagcagactgggcaacggcgtgctgtacgccagcgtgaaccccgagtacttcagcgccgccgacgtgtacgtgcccgacgagtgggaggtggccagagagaagatcaccatgagcagagagctgggccagggcagcttcggcatggtgtacgagggcgtggccaagggcgtggtgaaggacgagcccgagaccagagtggccatcaagaccgtgaacgaggccgccagcatgagagagagaatcgagttcctgaacgaggccagcgtgatgaaggagttcaactgccaccacgtggtgagactgctgggcgtggtgagccagggccagcccaccctggtgatcatggagctgatgaccagaggcgacctgaagagctacctgagaagcctgagacccgagatggagaacaaccccgtgctggccccccccagcctgagcaagatgatccagatggccggcgagatcgccgacggcatggcctacctgaacgccaacaagttcgtgcacagagacctggccgccagaaactgcatggtggccgaggacttcaccgtgaagatcggcgacttcggcatgaccagagacatctacgagaccgactactacagaaagggcggcaagggcctgctgcccgtgagatggatgagccccgagagcctgaaggacggcgtgttcaccacctacagcgacgtgtggagcttcggcgtggtgctgtgggagatcgccaccctggccgagcagccctaccagggcctgagcaacgagcaggtgctgagattcgtgatggagggcggcctgctggacaagcccgacaactgccccgacatgctgttcgagctgatgagaatgtgctggcagtacaaccccaagatgagacccagcttcctggagatcatcagcagcatcaaggaggagatggagcccggcttcagagaggtgagcttctactacagcgaggagaacaagctgcccgagcccgaggagctggacctggagcccgagaacatggagagcgtgcccctggaccccagcgccagcagcagcagcctgcccctgcccgacagacacagcggccacaaggccgagaacggccccggccccggcgtgctggtgctgagagccagcttcgacgagagacagccctacgcccacatgaacggcggcagaaagaacgagagagccctgcccctgccccagagcagcacctgctag

SEQ ID NO: 11065 - DNA, 543 bp, Artificial Sequence
  Description of Artificial Sequence: Synthetic coding sequence
atgggcatccccatgggcaagagcatgctggtgctgctgaccttcctggccttcgccagctgctgcatcgccgcctacagacccagcgagaccctgtgcggcggcgagctggtggacaccctgcagttcgtgtgcggcgacagaggcttctacttcagcagacccgccagcagagtgagcagaagaagcagaggcatcgtggaggagtgctgcttcagaagctgcgacctggccctgctggagacctactgcgccacccccgccaagagcgagagagacgtgagcaccccccccaccgtgctgcccgacaacttccccagataccccgtgggcaagttcttccagtacgacacctggaagcagagcacccagagactgagaagaggcctgcccgccctgctgagagccagaagaggccacgtgctggccaaggagctggaggccttcagagaggccaagagacacagacccctgatcgccctgcccacccaggaccccgcccacggcggcgccccccccgagatggccagcaacagaaagtag

SEQ ID NO: 11066 - DNA, 543 bp, Artificial Sequence; identical to SEQ ID NO: 11065
  Description of Artificial Sequence: Synthetic coding sequence

SEQ ID NO: 11067 - DNA, 552 bp, Artificial Sequence
  Description of Artificial Sequence: Synthetic coding sequence
atgggcatccccatgggcaagagcatgctggtgctgctgaccttcctggccttcgccagctgctgcatcgccgcctacagacccagcgagaccctgtgcggcggcgagctggtggacaccctgcagttcgtgtgcggcgacagaggcttctacttcagactgcccggcagacccgccagcagagtgagcagaagaagcagaggcatcgtggaggagtgctgcttcagaagctgcgacctggccctgctggagacctactgcgccacccccgccaagagcgagagagacgtgagcaccccccccaccgtgctgcccgacaacttccccagataccccgtgggcaagttcttccagtacgacacctggaagcagagcacccagagactgagaagaggcctgcccgccctgctgagagccagaagaggccacgtgctggccaaggagctggaggccttcagagaggccaagagacacagacccctgatcgccctgcccacccaggaccccgcccacggcggcgccccccccgagatggccagcaacagaaagtag

SEQ ID NO: 11068 - DNA, 552 bp, Artificial Sequence; identical to SEQ ID NO: 11067
  Description of Artificial Sequence: Synthetic coding sequence

SEQ ID NO: 11069 - DNA, 543 bp, Artificial Sequence; identical to SEQ ID NO: 11065
  Description of Artificial Sequence: Synthetic coding sequence

SEQ ID NO: 11070 - DNA, 552 bp, Artificial Sequence; identical to SEQ ID NO: 11067
  Description of Artificial Sequence: Synthetic coding sequence

SEQ ID NO: 11071 - DNA, 543 bp, Artificial Sequence; identical to SEQ ID NO: 11065
  Description of Artificial Sequence: Synthetic coding sequence

SEQ ID NO: 11072 - DNA, 552 bp, Artificial Sequence; identical to SEQ ID NO: 11067
  Description of Artificial Sequence: Synthetic coding sequence

SEQ ID NO: 11073 - DNA, 543 bp, Artificial Sequence; identical to SEQ ID NO: 11065
  Description of Artificial Sequence: Synthetic coding sequence

SEQ ID NO: 11074 - DNA, 543 bp, Artificial Sequence; identical to SEQ ID NO: 11065
  Description of Artificial Sequence: Synthetic coding sequence

SEQ ID NO: 11075 - DNA, 711 bp, Artificial Sequence
  Description of Artificial Sequence: Synthetic coding sequence
atggtgagccccgacccccagatcatcgtggtggcccccgagaccgagctggccagcatgcaggtgcagagaaccgaggacggcgtgaccatcatccagatcttctgggtgggcagaaagggcgagctgctgagaagaacccccgtgagcagcgccatgcagacccccatgggcatccccatgggcaagagcatgctggtgctgctgaccttcctggccttcgccagctgctgcatcgccgcctacagacccagcgagaccctgtgcggcggcgagctggtggacaccctgcagttcgtgtgcggcgacagaggcttctacttcagcagacccgccagcagagtgagcagaagaagcagaggcatcgtggaggagtgctgcttcagaagctgcgacctggccctgctggagacctactgcgccacccccgccaagagcgagagagacgtgagcaccccccccaccgtgctgcccgacaacttccccagataccccgtgggcaagttcttccagtacgacacctggaagcagagcacccagagactgagaagaggcctgcccgccctgctgagagccagaagaggccacgtgctggccaaggagctggaggccttcagagaggccaagagacacagacccctgatcgccctgcccacccaggaccccgcccacggcggcgccccccccgagatggccagcaacagaaagtag

SEQ ID NO: 11076 - DNA, 876 bp, Artificial Sequence
  Description of Artificial Sequence: Synthetic coding sequence
atgcagagagccagacccaccctgtgggccgccgccctgaccctgctggtgctgctgagaggcccccccgtggccagagccggcgccagcagcgccggcctgggccccgtggtgagatgcgagccctgcgacgccagagccctggcccagtgcgcccccccccccgccgtgtgcgccgagctggtgagagagcccggctgcggctgctgcctgacctgcgccctgagcgagggccagccctgcggcatctacaccgagagatgcggcagcggcctgagatgccagcccagccccgacgaggccagacccctgcaggccctgctggacggcagaggcctgtgcgtgaacgccagcgccgtgagcagactgagagcctacctgctgcccgccccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11077 - DNA, 894 bp, Artificial Sequence
  Description of Artificial Sequence: Synthetic coding sequence
atgcagagagccagacccaccctgtgggccgccgccctgaccctgctggtgctgctgagaggcccccccgtggccagagccggcgccagcagcgccggcctgggccccgtggtgagatgcgagccctgcgacgccagagccctggcccagtgcgcccccccccccgccgtgtgcgccgagctggtgagagagcccggctgcggctgctgcctgacctgcgccctgagcgagggccagccctgcggcatctacaccgagagatgcggcagcggcctgagatgccagcccagccccgacgaggccagacccctgcaggccctgctggacggcagaggcctgtgcgtgaacgccagcgccgtgagcagactgagagcctacctgctgcccgccccccccgcccccggcgagccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11078 - DNA, 585 bp, Artificial Sequence
  Description of Artificial Sequence: Synthetic coding sequence
atgcagagagccagacccctgcaggccctgctggacggcagaggcctgtgcgtgaacgccagcgccgtgagcagactgagagcctacctgctgcccgccccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11079 - DNA, 462 bp, Artificial Sequence
  Description of Artificial Sequence: Synthetic coding sequence
tgaagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11080 - DNA, 432 bp, Artificial Sequence
  Description of Artificial Sequence: Synthetic coding sequence
tgagagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11081 - DNA, 792 bp, Artificial Sequence
  Description of Artificial Sequence: Synthetic coding sequence
atgcagagagccagacccaccctgtgggccgcctgcgagccctgcgacgccagagccctggcccagtgcgcccccccccccgccgtgtgcgccgagctggtgagagagcccggctgcggctgctgcctgacctgcgccctgagcgagggccagccctgcggcatctacaccgagagatgcggcagcggcctgagatgccagcccagccccgacgaggccagacccctgcaggccctgctggacggcagaggcctgtgcgtgaacgccagcgccgtgagcagactgagagcctacctgctgcccgccccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11082 - DNA, 834 bp, Artificial Sequence
  Description of Artificial Sequence: Synthetic coding sequence
atgagagccctgagactgggcgccgaggaccagcccctgcccgcctggatcccccagctgagagccgtgtactgcagacccatccccgccagacccgcctgccaggccgcctgccccggctgcagaagacacgccgccggcgccacccacgccctgggcagatgcgccgacagcgccggcgccgcccccagagccgccggcggcgccggctggagagagctgggcggcctgggcagcagaggcgccctgagagccgtgagacacctgcacagagccctgctggacggcagaggcctgtgcgtgaacgccagcgccgtgagcagactgagagcctacctgctgcccgccccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11083 - DNA, 570 bp, Artificial Sequence
  Description of Artificial Sequence: Synthetic coding sequence
atgcagagagccagacccaccctgtgggccgccgccctgaccctgctggacggcagaggcctgtgcgcctacctgctgcccgccccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11084 - DNA, 807 bp, Artificial Sequence
  Description of Artificial Sequence: Synthetic coding sequence
atgcagagagccagacccaccctgtgggccgccgccctgaccctgctggtgctgctgagaggcccccccgtggccagagccggcgccagcagcgccggcctgggccccgtggtgagaagagagcccggctgcggctgctgcctgacctgcgccctgagcgagggccagccctgcggcatctacaccgagagatgcggcagcggcctgagatgccagcccagccccgacgaggccagacccctgcaggccctgctggacggcagaggcctgtgcgtgaacgccagcgccgtgagcagactgagagcctacctgctgcccgccccccccgcccccggcaacgccagcgagagcgaggaggacagaagcgccggcagcgtggagagccccagcgtgagcagcacccacagagtgagcgaccccaagttccaccccctgcacagcaagatcatcatcatcaagaagggccacgccaaggacagccagagatacaaggtggactacgagagccagagcaccgacacccagaacttcagcagcgagagcaagagagagaccgagtacggcccctgcagaagagagatggaggacaccctgaaccacctgaagttcctgaacgtgctgagccccagaggcgtgcacatccccaactgcgacaagaagggcttctacaagaagaagcagtgcagacccagcaagggcagaaagagaggcttctgctggtgcgtggacaagtacggccagcccctgcccggctacaccaccaagggcaaggaggacgtgcactgctacagcatgcagagcaagtag

SEQ ID NO: 11085 - DNA, 978 bp, Artificial Sequence
  Description of Artificial Sequence: Synthetic coding sequence
atgctgcccagagtgggctgccccgccctgcccctgccccccccccccctgctgcccctgctgctgctgctgctgggcgccagcggcggcggcggcggcgccagagccgaggtgctgttcagatgccccccctgcacccccgagagactggccgcctgcggccccccccccgtggccccccccgccgccgtggccgccgtggccggcggcgccagaatgccctgcgccgagctggtgagagagcccggctgcggctgctgcagcgtgtgcgccagactggagggcgaggcctgcggcgtgtacacccccagatgcggccagggcctgagatgctacccccaccccggcagcgagctgcccctgcaggccctggtgatgggcgagggcacctgcgagaagagaagagacgccgagtacggcgccagccccgagcaggtggccgacaacggcgacgaccacagcgagggcggcctggtggagaaccacgtggacagcaccatgaacatgctgggcggcggcggcagcgccggcagaaagcccctgaagagcggcatgaaggagctggccgtgttcagagagaaggtgaccgagcagcacagacagatgggcaagggcggcaagcaccacctgggcctggaggagcccaagaagctgagacccccccccgccagaaccccctgccagcaggagctggaccaggtgctggagagaatcagcaccatgagactgcccgacgagagaggccccctggagcacctgtacagcctgcacatccccaactgcgacaagcacggcctgtacaacctgaagcagtgcaagatgagcctgaacggccagagaggcgagtgctggtgcgtgaaccccaacaccggcaagctgatccagggcgcccccaccatcagaggcgaccccgagtgccacctgttctacaacgagcagcaggaggccagaggcgtgcacacccagagaatgcagtag

SEQ ID NO: 11086 - DNA, 3099 bp, Artificial Sequence
  Description of Artificial Sequence: Synthetic coding sequence
atggcctgggaggccagaagagagcccggccccagaagagccgccgtgagagagaccgtgatgctgctgctgtgcctgggcgtgcccaccggcagaccctacaacgtggacaccgagagcgccctgctgtaccagggcccccacaacaccctgttcggctacagcgtggtgctgcacagccacggcgccaacagatggctgctggtgggcgcccccaccgccaactggctggccaacgccagcgtgatcaaccccggcgccatctacagatgcagaatcggcaagaaccccggccagacctgcgagcagctgcagctgggcagccccaacggcgagccctgcggcaagacctgcctggaggagagagacaaccagtggctgggcgtgaccctgagcagacagcccggcgagaacggcagcatcgtgacctgcggccacagatggaagaacatcttctacatcaagaacgagaacaagctgcccaccggcggctgctacggcgtgccccccgacctgagaaccgagctgagcaagagaatcgccccctgctaccaggactacgtgaagaagttcggcgagaacttcgccagctgccaggccggcatcagcagcttctacaccaaggacctgatcgtgatgggcgcccccggcagcagctactggaccggcagcctgttcgtgtacaacatcaccaccaacaagtacaaggccttcctggacaagcagaaccaggtgaagttcggcagctacctgggctacagcgtgggcgccggccacttcagaagccagcacaccaccgaggtggtgggcggcgccccccagcacgagcagatcggcaaggcctacatcttcagcatcgacgagaaggagctgaacatcctgcacgagatgaagggcaagaagctgggcagctacttcggcgccagcgtgtgcgccgtggacctgaacgccgacggcttcagcgacctgctggtgggcgcccccatgcagagcaccatcagagaggagggcagagtgttcgtgtacatcaacagcggcagcggcgccgtgatgaacgccatggagaccaacctggtgggcagcgacaagtacgccgccagattcggcgagagcatcgtgaacctgggcgacatcgacaacgacggcttcgaggacgtggccatcggcgccccccaggaggacgacctgcagggcgccatctacatctacaacggcagagccgacggcatcagcagcaccttcagccagagaatcgagggcctgcagatcagcaagagcctgagcatgttcggccagagcatcagcggccagatcgacgccgacaacaacggctacgtggacgtggccgtgggcgccttcagaagcgacagcgccgtgctgctgagaaccagacccgtggtgatcgtggacgccagcctgagccaccccgagagcgtgaacagaaccaagttcgactgcgtggagaacggctggcccagcgtgtgcatcgacctgaccctgtgcttcagctacaagggcaaggaggtgcccggctacatcgtgctgttctacaacatgagcctggacgtgaacagaaaggccgagagcccccccagattctacttcagcagcaacggcaccagcgacgtgatcaccggcagcatccaggtgagcagcagagaggccaactgcagaacccaccaggccttcatgagaaaggacgtgagagacatcctgacccccatccagatcgaggccgcctaccacctgggcccccacgtgatcagcaagagaagcaccgaggagttcccccccctgcagcccatcctgcagcagaagaaggagaaggacatcatgaagaagaccatcaacttcgccagattctgcgcccacgagaactgcagcgccgacctgcaggtgagcgccaagatcggcttcctgaagccccacgagaacaagacctacctggccgtgggcagcatgaagaccctgatgctgaacgtgagcctgttcaacgccggcgacgacgcctacgagaccaccctgcacgtgaagctgcccgtgggcctgtacttcatcaagatcctggagctggaggagaagcagatcaactgcgaggtgaccgacaacagcggcgtggtgcagctggactgcagcatcggctacatctacgtggaccacctgagcagaatcgacatcagcttcctgctggacgtgagcagcctgagcagagccgaggaggacctgagcatcaccgtgcacgccacctgcgagaacgaggaggagatggacaacctgaagcacagcagagtgaccgtggccatccccctgaagtacgaggtgaagctgaccgtgcacggcttcgtgaaccccaccagcttcgtgtacggcagcaacgacgagaacgagcccgagacctgcatggtggagaagatgaacctgaccttccacgtgatcaacaccggcaacagcatggcccccaacgtgagcgtggagatcatggtgcccaacagcttcagcccccagaccgacaagctgttcaacatcctggacgtgcagaccaccaccggcgagtgccacttcgagaactaccagagagtgtgcgccctggagcagcagaagagcgccatgcagaccctgaagggcatcgtgagattcctgagcaagaccgacaagagactgctgtactgcatcaaggccgacccccactgcctgaacttcctgtgcaacttcggcaagatggagagcggcaaggaggccagcgtgcacatccagctggagggcagacccagcatcctggagatggacgagaccagcgccctgaagttcgagatcagagccaccggcttccccgagcccaaccccagagtgatcgagctgaacaaggacgagaacgtggcccacgtgctgctggagggcctgcaccaccagagacccaagagatacttcaccatcgtgatcatcagcagcagcctgctgctgggcctgatcgtgctgctgctgatcagctacgtgatgtggaaggccggcttcttcaagagacagtacaagagcatcctgcaggaggagaacagaagagacagctggagctacatcaacagcaagagcaacgacgactag

SEQ ID NO: 11087 - DNA, 1854 bp, Artificial Sequence
  Description of Artificial Sequence: Synthetic coding sequence
atggcctgggaggccagaagagagcccggccccagaagagccgccgtgagagagaccgtgatgctgctgctgtgcctgggcgtgcccaccggcagaccctacaacgtggacaccgagagcgccctgctgtaccagggcccccacaacaccctgttcggctacagcgtggtgctgcacagccacggcgccaacagatggctgctggtgggcgcccccaccgccaactggctggccaacgccagcgtgatcaaccccggcgccatctacagatgcagaatcggcaagaaccccggccagacctgcgagcagctgcagctgggcagccccaacggcgagccctgcggcaagacctgcctggaggagagagacaaccagtggctgggcgtgaccctgagcagacagcccggcgagaacggcagcatcgtgacctgcggccacagatggaagaacatcttctacatcaagaacgagaacaagctgcccaccggcggctgctacggcgtgccccccgacctgagaaccgagctgagcaagagaatcgccccctgctaccaggactacgtgaagaagttcggcgagaacttcgccagctgccaggccggcatcagcagcttctacaccaaggacctgatcgtgatgggcgcccccggcagcagctactggaccggcagcctgttcgtgtacaacatcaccaccaacaagtacaaggccttcctggacaagcagaaccaggtgaagttcggcagctacctgggctacagcgtgggcgccggccacttcagaagccagcacaccaccgaggtggtgggcggcgccccccagcacgagcagatcggcaaggcctacatcttcagcatcgacgagaaggagctgaacatcctgcacgagatgaagggcaagaagctgggcagctacttcggcgccagcgtgtgcgccgtggacctgaacgccgacggcttcagcgacctgctggtgggcgcccccatgcagagcaccatcagagaggagggcagagtgttcgtgtacatcaacagcggcagcggcgccgtgatgaacgccatggagaccaacctggtgggcagcgacaagtacgccgccagattcggcgagagcatcgtgaacctgggcgacatcgacaacgacggcttcgaggacgtggccatcggcgccccccaggaggacgacctgcagggcgccatctacatctacaacggcagagccgacggcatcagcagcaccttcagccagagaatcgagggcctgcagatcagcaagagcctgagcatgttcggccagagcatcagcggccagatcgacgccgacaacaacggctacgtggacgtggccgtgggcgccttcagaagcgacagcgccgtgctgctgagaaccagacccgtggtgatcgtggacgccagcctgagccaccccgagagcgtgaacagaaccaagttcgactgcgtggagaacggctggcccagcgtgtgcatcgacctgaccctgtgcttcagctacaagggcaaggaggtgcccggctacatcgtgctgttctacaacatgagcctggacgtgaacagaaaggccgagagcccccccagattctacttcagcagcaacggcaccagcgacgtgatcaccggcagcatccaggtgagcagcagagaggccaactgcagaacccaccaggccttcatgagaaaggacgtgagagacatcctgacccccatccagatcgaggccgcctaccacctgggcccccacgtgatcagcaagagaagcaccgaggagttcccccccctgcagcccatcctgcagcagaagaaggagaaggacatcatgaagaagaccaagaagtag

SEQ ID NO: 11088 - DNA, 3150 bp, Artificial Sequence
  Description of Artificial Sequence: Synthetic coding sequence
atgggcagcagaacccccgagagccccctgcacgccgtgcagctgagatggggccccagaagaagaccccccctgctgcccctgctgctgctgctgctgccccccccccccagagtgggcggcttcaacctggacgccgaggcccccgccgtgctgagcggcccccccggcagcttcttcggcttcagcgtggagttctacagacccggcaccgacggcgtgagcgtgctggtgggcgcccccaaggccaacaccagccagcccggcgtgctgcagggcggcgccgtgtacctgtgcccctggggcgccagccccacccagtgcacccccatcgagttcgacagcaagggcagcagactgctggagagcagcctgagcagcagcgagggcgaggagcccgtggagtacaagagcctgcagtggttcggcgccaccgtgagagcccacggcagcagcatcctggcctgcgcccccctgtacagctggagaaccgagaaggagcccctgagcgaccccgtgggcacctgctacctgagcaccgacaacttcaccagaatcctggagtacgccccctgcagaagcgacttcagctgggccgccggccagggctactgccagggcggcttcagcgccgagttcaccaagaccggcagagtggtgctgggcggccccggcagctacttctggcagggccagatcctgagcgccacccaggagcagatcgccgagagctactaccccgagtacctgatcaacctggtgcagggccagctgcagaccagacaggccagcagcatctacgacgacagctacctgggctacagcgtggccgtgggcgagttcagcggcgacgacaccgaggacttcgtggccggcgtgcccaagggcaacctgacctacggctacgtgaccatcctgaacggcagcgacatcagaagcctgtacaacttcagcggcgagcagatggccagctacttcggctacgccgtggccgccaccgacgtgaacggcgacggcctggacgacctgctggtgggcgcccccctgctgatggacagaacccccgacggcagaccccaggaggtgggcagagtgtacgtgtacctgcagcaccccgccggcatcgagcccacccccaccctgaccctgaccggccacgacgagttcggcagattcggcagcagcctgacccccctgggcgacctggaccaggacggctacaacgacgtggccatcggcgcccccttcggcggcgagacccagcagggcgtggtgttcgtgttccccggcggccccggcggcctgggcagcaagcccagccaggtgctgcagcccctgtgggccgccagccacacccccgacttcttcggcagcgccctgagaggcggcagagacctggacggcaacggctaccccgacctgatcgtgggcagcttcggcgtggacaaggccgtggtgtacagaggcagacccatcgtgagcgccagcgccagcctgaccatcttccccgccatgttcaaccccgaggagagaagctgcagcctggagggcaaccccgtggcctgcatcaacctgagcttctgcctgaacgccagcggcaagcacgtggccgacagcatcggcttcaccgtggagctgcagctggactggcagaagcagaagggcggcgtgagaagagccctgttcctggccagcagacaggccaccctgacccagaccctgctgatccagaacggcgccagagaggactgcagagagatgaagatctacctgagaaacgagagcgagttcagagacaagctgagccccatccacatcgccctgaacttcagcctggacccccaggcccccgtggacagccacggcctgagacccgccctgcactaccagagcaagagcagaatcgaggacaaggcccagatcctgctggactgcggcgaggacaacatctgcgtgcccgacctgcagctggaggtgttcggcgagcagaaccacgtgtacctgggcgacaagaacgccctgaacctgaccttccacgcccagaacgtgggcgagggcggcgcctacgaggccgagctgagagtgaccgccccccccgaggccgagtacagcggcctggtgagacaccccggcaacttcagcagcctgagctgcgactacttcgccgtgaaccagagcagactgctggtgtgcgacctgggcaaccccatgaaggccggcgccagcctgtggggcggcctgagattcaccgtgccccacctgagagacaccaagaagaccatccagttcgacttccagatcctgagcaagaacctgaacaacagccagagcgacgtggtgagcttcagactgagcgtggaggcccaggcccaggtgaccctgaacggcgtgagcaagcccgaggccgtgctgttccccgtgagcgactggcaccccagagaccagccccagaaggaggaggacctgggccccgccgtgcaccacgtgtacgagctgatcaaccagggccccagcagcatcagccagggcgtgctggagctgagctgcccccaggccctggagggccagcagctgctgtacgtgaccagagtgaccggcctgaactgcaccaccaaccaccccatcaaccccaagggcctggagctggaccccgagggcagcctgcaccaccagcagaagagagaggcccccagcagaagcagcgccagcagcggcccccagatcctgaagtgccccgaggccgagtgcttcagactgagatgcgagctgggccccctgcaccagcaggagagccagagcctgcagctgcacttcagagtgtgggccaagaccttcctgcagagagagcaccagcccttcagcctgcagtgcgaggccgtgtacaaggccctgaagatgccctacagaatcctgcccagacagctgccccagaaggagagacaggtggccaccgccgtgcagtggaccaaggccgagggcagctacggcgtgcccctgtggatcatcatcctggccatcctgttcggcctgctgctgctgggcctgctgatctacatcctgtacaagctgggcttcttcaagagaagcctgccctacggcaccgccatggagaaggcccagctgaagccccccgccaccagcgacgcctag

SEQ ID NO: 11089 - DNA, 3393 bp, Artificial Sequence
  Description of Artificial Sequence: Synthetic coding sequence
atggccgccgccggccagctgtgcctgctgtacctgagcgccggcctgctgagcagactgggcgccgccttcaacctggacaccagagaggacaacgtgatcagaaagtacggcgaccccggcagcctgttcggcttcagcctggccatgcactggcagctgcagcccgaggacaagagactgctgctggtgggcgcccccagagccgaggccctgcccctgcagagagccaacagaaccggcggcctgtacagctgcgacatcaccgccagaggcccctgcaccagaatcgagttcgacaacgacgccgaccccaccagcgagagcaaggaggaccagtggatgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcatcgtgagagtggagcagaagaacaacaccttcttcgacatgaacatcttcgaggacggcccctacgaggtgggcggcgagaccgagcacgacgagagcctggtgcccgtgcccgccaacagctacctgggcctgctgttcctgaccagcgtgagctacaccgaccccgaccagttcgtgtacaagaccagaccccccagagagcagcccgacaccttccccgacgtgatgatgaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaagcagatacgacgacagcgtgcccagataccacgccgtgagaatcagaaaggaggagagagagatcaaggacgagaagtacatcgacaacctggagaagaagcagtggatcaccaagtggaacgagaacgagagctacagctag

SEQ ID NO: 11090 - DNA, 3222 bp, Artificial Sequence
  Description of Artificial Sequence: Synthetic coding sequence
atggccgccgccggccagctgtgcctgctgtacctgagcgccggcctgctgagcagactgggcgccgccttcaacctggacaccagagaggacaacgtgatcagaaagtacggcgaccccggcagcctgttcggcttcagcctggccatgcactggcagctgcagcccgaggacaagagactgctgctggtgggcgcccccagagccgaggccctgcccctgcagagagccaacagaaccggcggcctgtacagctgcgacatcaccgccagaggcccctgcaccagaatcgagttcgacaacgacgccgaccccaccagcgagagcaaggaggaccagtggatgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcatcgtgagagtggagcagaagaacaacaccttcttcgacatgaacatcttcgaggacggcccctacgaggtgggcggcgagaccgagcacgacgagagcctggtgcccgtgcccgccaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaaacaagaaggaccactacgacgccacctaccacaaggccgagatccacgcccagcccagcgacaaggagagactgaccagcgacgcctag

SEQ ID NO: 11091 - DNA, 3207 bp, Artificial Sequence
  Description of Artificial Sequence: Synthetic coding sequence
atggccgccgccggccagctgtgcctgctgtacctgagcgccggcctgctgagcagactgggcgccgccttcaacctggacaccagagaggacaacgtgatcagaaagtacggcgaccccggcagcctgttcggcttcagcctggccatgcactggcagctgcagcccgaggacaagagactgctgctggtgggcgcccccagagccgaggccctgcccctgcagagagccaacagaaccggcggcctgtacagctgcgacatcaccgccagaggcccctgcaccagaatcgagttcgacaacgacgccgaccccaccagcgagagcaaggaggaccagtggatgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcctgctgttcctgaccagcgtgagctacaccgaccccgaccagttcgtgtacaagaccagaccccccagagagcagcccgacaccttccccgacgtgatgatgaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaaacaagaaggaccactacgacgccacctaccacaaggccgagatccacgcccagcccagcgacaaggagagactgaccagcgacgcctag

SEQ ID NO: 11092 - DNA, 3339 bp, Artificial Sequence
  Description of Artificial Sequence: Synthetic coding sequence
atggccgccgccggccagctgtgcctgctgtacctgagcgccggcctgctgagcagactgggcgccgccttcaacctggacaccagagaggacaacgtgatcagaaagtacggcgaccccggcagcctgttcggcttcagcctggccatgcactggcagctgcagcccgaggacaagagactgctgctggtgggcgcccccagagccgaggccctgcccctgcagagagccaacagaaccggcggcctgtacagctgcgacatcaccgccagaggcccctgcaccagaatcgagttcgacaacgacgccgaccccaccagcgagagcaaggaggaccagtggatgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcatcgtgagagtggagcagaagaacaacaccttcttcgacatgaacatcttcgaggacggcccctacgaggtgggcggcgagaccgagcacgacgagagcctggtgcccgtgcccgccaacagctacctgggcctgctgttcctgaccagcgtgagctacaccgaccccgaccagttcgtgtacaagaccagaccccccagagagcagcccgacaccttccccgacgtgatgatgaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaaacaagaaggaccactacgacgccacctaccacaaggccgagatccacgcccagcccagcgacaaggagagactgaccagcgacgcctag

SEQ ID NO: 11093 - DNA, 3276 bp, Artificial Sequence
  Description of Artificial Sequence: Synthetic coding sequence
atggccgccgccggccagctgtgcctgctgtacctgagcgccggcctgctgagcagactgggcgccgccttcaacctggacaccagagaggacaacgtgatcagaaagtacggcgaccccggcagcctgttcggcttcagcctggccatgcactggcagctgcagcccgaggacaagagactgctgctggtgggcgcccccagagccgaggccctgcccctgcagagagccaacagaaccggcggcctgtacagctgcgacatcaccgccagaggcccctgcaccagaatcgagttcgacaacgacgccgaccccaccagcgagagcaaggaggaccagtggatgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcatcgtgagagtggagcagaagaacaacaccttcttcgacatgaacatcttcgaggacggcccctacgaggtgggcggcgagaccgagcacgacgagagcctggtgcccgtgcccgccaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaagcagatacgacgacagcgtgcccagataccacgccgtgagaatcagaaaggaggagagagagatcaaggacgagaagtacatcgacaacctggagaagaagcagtggatcaccaagtggaacgagaacgagagctacagctag

SEQ ID NO: 11094 - DNA, 2865 bp, Artificial Sequence
  Description of Artificial Sequence: Synthetic coding sequence
atgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcctgctgttcctgaccagcgtgagctacaccgaccccgaccagttcgtgtacaagaccagaccccccagagagcagcccgacaccttccccgacgtgatgatgaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaaacaagaaggaccactacgacgccacctaccacaaggccgagatccacgcccagcccagcgacaaggagagactgaccagcgacgcctag

SEQ ID NO: 11095 - DNA, 3393 bp, Artificial Sequence; identical to SEQ ID NO: 11089
  Description of Artificial Sequence: Synthetic coding sequence

SEQ ID NO: 11096 - DNA, 3261 bp, Artificial Sequence
  Description of Artificial Sequence: Synthetic coding sequence
atggccgccgccggccagctgtgcctgctgtacctgagcgccggcctgctgagcagactgggcgccgccttcaacctggacaccagagaggacaacgtgatcagaaagtacggcgaccccggcagcctgttcggcttcagcctggccatgcactggcagctgcagcccgaggacaagagactgctgctggtgggcgcccccagagccgaggccctgcccctgcagagagccaacagaaccggcggcctgtacagctgcgacatcaccgccagaggcccctgcaccagaatcgagttcgacaacgacgccgaccccaccagcgagagcaaggaggaccagtggatgggcgtgaccgtgcagagccagggccccggcggcaaggtggtgacctgcgcccacagatacgagaagagacagcacgtgaacaccaagcaggagagcagagacatcttcggcagatgctacgtgctgagccagaacctgagaatcgaggacgacatggacggcggcgactggagcttctgcgacggcagactgagaggccacgagaagttcggcagctgccagcagggcgtggccgccaccttcaccaaggacttccactacatcgtgttcggcgcccccggcacctacaactggaagggcctgctgttcctgaccagcgtgagctacaccgaccccgaccagttcgtgtacaagaccagaccccccagagagcagcccgacaccttccccgacgtgatgatgaacagctacctgggcttcagcctggacagcggcaagggcatcgtgagcaaggacgagatcaccttcgtgagcggcgcccccagagccaaccacagcggcgccgtggtgctgctgaagagagacatgaagagcgcccacctgctgcccgagcacatcttcgacggcgagggcctggccagcagcttcggctacgacgtggccgtggtggacctgaacaaggacggctggcaggacatcgtgatcggcgccccccagtacttcgacagagacggcgaggtgggcggcgccgtgtacgtgtacatgaaccagcagggcagatggaacaacgtgaagcccatcagactgaacggcaccaaggacagcatgttcggcatcgccgtgaagaacatcggcgacatcaaccaggacggctaccccgacatcgccgtgggcgccccctacgacgacctgggcaaggtgttcatctaccacggcagcgccaacggcatcaacaccaagcccacccaggtgctgaagggcatcagcccctacttcggctacagcatcgccggcaacatggacctggacagaaacagctaccccgacgtggccgtgggcagcctgagcgacagcgtgaccatcttcagaagcagacccgtgatcaacatccagaagaccatcaccgtgacccccaacagaatcgacctgagacagaagaccgcctgcggcgcccccagcggcatctgcctgcaggtgaagagctgcttcgagtacaccgccaaccccgccggctacaaccccagcatcagcatcgtgggcaccctggaggccgagaaggagagaagaaagagcggcctgagcagcagagtgcagttcagaaaccagggcagcgagcccaagtacacccaggagctgaccctgaagagacagaagcagaaggtgtgcatggaggagaccctgtggctgcaggacaacatcagagacaagctgagacccatccccatcaccgccagcgtggagatccaggagcccagcagcagaagaagagtgaacagcctgcccgaggtgctgcccatcctgaacagcgacgagcccaagaccgcccacatcgacgtgcacttcctgaaggagggctgcggcgacgacaacgtgtgcaacagcaacctgaagctggagtacaagttctgcaccagagagggcaaccaggacaagttcagctacctgcccatccagaagggcgtgcccgagctggtgctgaaggaccagaaggacatcgccctggagatcaccgtgaccaacagccccagcaaccccagaaaccccaccaaggacggcgacgacgcccacgaggccaagctgatcgccaccttccccgacaccctgacctacagcgcctacagagagctgagagccttccccgagaagcagctgagctgcgtggccaaccagaacggcagccaggccgactgcgagctgggcaaccccttcaagagaaacagcaacgtgaccttctacctggtgctgagcaccaccgaggtgaccttcgacacccccgacctggacatcaacctgaagctggagaccaccagcaaccaggacaacctggcccccatcaccgccaaggccaaggtggtgatcgagctgctgctgagcgtgagcggcgtggccaagcccagccaggtgtacttcggcggcaccgtggtgggcgagcaggccatgaagagcgaggacgaggtgggcagcctgatcgagtacgagttcagagtgatcaacctgggcaagcccctgaccaacctgggcaccgccaccctgaacatccagtggcccaaggagatcagcaacggcaagtggctgctgtacctggtgaaggtggagagcaagggcctggagaaggtgacctgcgagccccagaaggagatcaacagcctgaacctgaccgagagccacaacagcagaaagaagagagagatcaccgagaagcagatcgacgacaacagaaagttcagcctgttcgccgagagaaagtaccagaccctgaactgcagcgtgaacgtgaactgcgtgaacatcagatgccccctgagaggcctggacagcaaggccagcctgatcctgagaagcagactgtggaacagcaccttcctggaggagtacagcaagctgaactacctggacatcctgatgagagccttcatcgacgtgaccgccgccgccgagaacatcagactgcccaacgccggcacccaggtgagagtgaccgtgttccccagcaagaccgtggcccagtacagcggcgtgccctggtggatcatcctggtggccatcctggccggcatcctgatgctggccctgctggtgttcatcctgtggaagtgcggcttcttcaagagaagcagatacgacgacagcgtgcccagataccacgccgtgagaatcagaaaggaggagagagagatcaaggacgagaagtacatcgacaacctggagaagaagcagtggatcaccaagtggaacgagaacgagagctacagctag

SEQ ID NO: 11097 - DNA, 3414 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcctgctgttcgtgaccaacatcgacagcagcgaccccgaccagctggtgtacaagaccctggaccccgccgacagactgcccggccccgccggcgacctggccctgaacagctacctgggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagatgggcttcttcaagagagccaagcaccccgaggccaccgtgccccagtaccacgccgtgaagatccccagagaggacagacagcagttcaaggaggagaagaccggcaccatcctgagaaacaactggggcagccccagaagagagggccccgacgcccaccccatcctggccgccgacggccaccccgagctgggccccgacggccaccccggccccggcaccgcctag

SEQ ID NO: 11098 - DNA, 3489 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcaccgccagagtggagctgtgcgcccagggcagcgccgacctggcccacctggacgacggcccctacgaggccggcggcgagaaggagcaggaccccagactgatccccgtgcccgccaacagctacttcggcctgctgttcgtgaccaacatcgacagcagcgaccccgaccagctggtgtacaagaccctggaccccgccgacagactgcccggccccgccggcgacctggccctgaacagctacctgggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagtgcggcttcttccacagaagcagccagagcagcagcttccccaccaactaccacagagcctgcctggccgtgcagcccagcgccatggaggtgggcggccccggcaccgtgggctgggacagcagcaacggcagaagcacccccagacccccctgccccagcaccatgagatag

SEQ ID NO: 11099 - DNA, 2976 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcaccgccagagtggagctgtgcgcccagggcagcgccgacctggcccacctggacgacggcccctacgaggccggcggcgagaaggagcaggaccccagactgatccccgtgcccgccaacagctacttcggcctgctgttcgtgaccaacatcgacagcagcgaccccgaccagctggtgtacaagaccctggaccccgccgacagactgcccggccccgccggcgacctggccctgaacagctacctgggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagtgcggcttcttccacagaagcagccagagcagcagcttccccaccaactaccacagagcctgcctggccgtgcagcccagcgccatggaggtgggcggccccggcaccgtgggctgggacagcagcaacggcagaagcacccccagacccccctgccccagcaccatgagatag

SEQ ID NO: 11100 - DNA, 3357 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcctgctgttcgtgaccaacatcgacagcagcgaccccgaccagctggtgtacaagaccctggaccccgccgacagactgcccggccccgccggcgacctggccctgaacagctacctgggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagtgcggcttcttccacagaagcagccagagcagcagcttccccaccaactaccacagagcctgcctggccgtgcagcccagcgccatggaggtgggcggccccggcaccgtgggctgggacagcagcaacggcagaagcacccccagacccccctgccccagcaccatgagatag

SEQ ID NO: 11101 - DNA, 3369 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcaccgccagagtggagctgtgcgcccagggcagcgccgacctggcccacctggacgacggcccctacgaggccggcggcgagaaggagcaggaccccagactgatccccgtgcccgccaacagctacttcggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagtgcggcttcttccacagaagcagccagagcagcagcttccccaccaactaccacagagcctgcctggccgtgcagcccagcgccatggaggtgggcggccccggcaccgtgggctgggacagcagcaacggcagaagcacccccagacccccctgccccagcaccatgagatag

SEQ ID NO: 11102 - DNA, 3135 bp, Artificial Sequence
  Description of Artificial Sequence: Synthetic coding sequence
atggcccccttcgccacccccatggtgcaggccctgaccaccaccagaatccagagacaggccgagggcttccagtgctggagagagtgcggcaccagaagaagccccttcgagggcaaggagacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcaccgccagagtggagctgtgcgcccagggcagcgccgacctggcccacctggacgacggcccctacgaggccggcggcgagaaggagcaggaccccagactgatccccgtgcccgccaacagctacttcggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagatgggcttcttcaagagagccaagcaccccgaggccaccgtgccccagtaccacgccgtgaagatccccagagaggacagacagcagttcaaggaggagaagaccggcaccatcctgagaaacaactggggcagccccagaagagagggccccgacgcccaccccatcctggccgccgacggccaccccgagctgggccccgacggccaccccggccccggcaccgcctag

SEQ ID NO: 11103 - DNA, 3426 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcaccgccagagtggagctgtgcgcccagggcagcgccgacctggcccacctggacgacggcccctacgaggccggcggcgagaaggagcaggaccccagactgatccccgtgcccgccaacagctacttcggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagatgggcttcttcaagagagccaagcaccccgaggccaccgtgccccagtaccacgccgtgaagatccccagagaggacagacagcagttcaaggaggagaagaccggcaccatcctgagaaacaactggggcagccccagaagagagggccccgacgcccaccccatcctggccgccgacggccaccccgagctgggccccgacggccaccccggccccggcaccgcctag

SEQ ID NO: 11104 - DNA, 3546 bp, Artificial Sequence
  Description of Artificial Sequence: Synthetic coding sequence
atggccggcgccagaagcagagacccctggggcgccagcggcatctgctacctgttcggcagcctgctggtggagctgctgttcagcagagccgtggccttcaacctggacgtgatgggcgccctgagaaaggagggcgagcccggcagcctgttcggcttcagcgtggccctgcacagacagctgcagcccagaccccagagctggctgctggtgggcgccccccaggccctggccctgcccggccagcaggccaacagaaccggcggcctgttcgcctgccccctgagcctggaggagaccgactgctacagagtggacatcgaccagggcgccgacatgcagaaggagagcaaggagaaccagtggctgggcgtgagcgtgagaagccagggccccggcggcaagatcgtgacctgcgcccacagatacgaggccagacagagagtggaccagatcctggagaccagagacatgatcggcagatgcttcgtgctgagccaggacctggccatcagagacgagctggacggcggcgagtggaagttctgcgagggcagaccccagggccacgagcagttcggcttctgccagcagggcaccgccgccgccttcagccccgacagccactacctgctgttcggcgcccccggcacctacaactggaagggcaccgccagagtggagctgtgcgcccagggcagcgccgacctggcccacctggacgacggcccctacgaggccggcggcgagaaggagcaggaccccagactgatccccgtgcccgccaacagctacttcggcctgctgttcgtgaccaacatcgacagcagcgaccccgaccagctggtgtacaagaccctggaccccgccgacagactgcccggccccgccggcgacctggccctgaacagctacctgggcttcagcatcgacagcggcaagggcctggtgagagccgaggagctgagcttcgtggccggcgcccccagagccaaccacaagggcgccgtggtgatcctgagaaaggacagcgccagcagactggtgcccgaggtgatgctgagcggcgagagactgaccagcggcttcggctacagcctggccgtggccgacctgaacagcgacggctggcccgacctgatcgtgggcgccccctacttcttcgagagacaggaggagctgggcggcgccgtgtacgtgtacctgaaccagggcggccactgggccggcatcagccccctgagactgtgcggcagccccgacagcatgttcggcatcagcctggccgtgctgggcgacctgaaccaggacggcttccccgacatcgccgtgggcgcccccttcgacggcgacggcaaggtgttcatctaccacggcagcagcctgggcgtggtggccaagcccagccaggtgctggagggcgaggccgtgggcatcaagagcttcggctacagcctgagcggcagcctggacatggacggcaaccagtaccccgacctgctggtgggcagcctggccgacaccgccgtgctgttcagagccagacccatcctgcacgtgagccacgaggtgagcatcgcccccagaagcatcgacctggagcagcccaactgcgccggcggccacagcgtgtgcgtggacctgagagtgtgcttcagctacatcgccgtgcccagcagctacagccccaccgtggccctggactacgtgctggacgccgacaccgacagaagactgagaggccaggtgcccagagtgaccttcctgagcagaaacctggaggagcccaagcaccaggccagcggcaccgtgtggctgaagcaccagcacgacagagtgtgcggcgacgccatgttccagctgcaggagaacgtgaaggacaagctgagagccatcgtggtgaccctgagctacagcctgcagacccccagactgagaagacaggcccccggccagggcctgccccccgtggcccccatcctgaacgcccaccagcccagcacccagagagccgagatccacttcctgaagcagggctgcggcgaggacaagatctgccagagcaacctgcagctggtgagagccagattctgcaccagagtgagcgacaccgagttccagcccctgcccatggacgtggacggcaccaccgccctgttcgccctgagcggccagcccgtgatcggcctggagctgatggtgaccaacctgcccagcgaccccgcccagccccaggccgacggcgacgacgcccacgaggcccagctgctggtgatgctgcccgacagcctgcactacagcggcgtgagagccctggaccccgccgagaagcccctgtgcctgagcaacgagaacgccagccacgtggagtgcgagctgggcaaccccatgaagagaggcgcccaggtgaccttctacctgatcctgagcaccagcggcatcagcatcgagaccaccgagctggaggtggagctgctgctggccaccatcagcgagcaggagctgcaccccgtgagcgccagagccagagtgttcatcgagctgcccctgagcatcgccggcatggccatcccccagcagctgttcttcagcggcgtggtgagaggcgagagagccatgcagagcgagagagacgtgggcagcaaggtgaagtacgaggtgaccgtgagcaaccagggccagagcctgagaaccctgggcagcgccttcctgaacatcatgtggccccacgagatcgccaacggcaagtggctgctgtaccccatgcaggtggagctggagggcggccagggccccggccagaagggcctgtgcagccccagacccaacatcctgcacctggacgtggacagcagagacagaagaagaagagagctggagccccccgagcagcaggagcccggcgagagacaggagcccagcatgagctggtggcccgtgagcagcgccgagaagaagaagaacatcaccctggactgcgccagaggcaccgccaactgcgtggtgttcagctgccccctgtacagcttcgacagagccgccgtgctgcacgtgtggggcagactgtggaacagcaccttcctggaggagtacagcgccgtgaagagcctggaggtgatcgtgagagccaacatcaccgtgaagagcagcatcaagaacctgatgctgagagacgccagcaccgtgatccccgtgatggtgtacctggaccccatggccgtggtggccgagggcgtgccctggtgggtgatcctgctggccgtgctggccggcctgctggtgctggccctgctggtgctgctgctgtggaagatgggcttcttcaagagagccaagcaccccgaggccaccgtgccccagtaccacgccgtgaagatccccagagaggacagacagcagttcaaggaggagaagaccggcaccatcctgagaaacaactggggcagccccagaagagagggccccgacgcccaccccatcctggccgccgacggccaccccgagctgggccccgacggccaccccggccccggcaccgcctag

SEQ ID NO: 11105 - DNA, 3147 bp, Artificial Sequence
  Description of Artificial Sequence: Synthetic coding sequence
atggccttcccccccagaagaagactgagactgggccccagaggcctgcccctgctgctgagcggcctgctgctgcccctgtgcagagccttcaacctggacgtggacagccccgccgagtacagcggccccgagggcagctacttcggcttcgccgtggacttcttcgtgcccagcgccagcagcagaatgttcctgctggtgggcgcccccaaggccaacaccacccagcccggcatcgtggagggcggccaggtgctgaagtgcgactggagcagcaccagaagatgccagcccatcgagttcgacgccaccggcaacagagactacgccaaggacgaccccctggagttcaagagccaccagtggttcggcgccagcgtgagaagcaagcaggacaagatcctggcctgcgcccccctgtaccactggagaaccgagatgaagcaggagagagagcccgtgggcacctgcttcctgcaggacggcaccaagaccgtggagtacgccccctgcagaagccaggacatcgacgccgacggccagggcttctgccagggcggcttcagcatcgacttcaccaaggccgacagagtgctgctgggcggccccggcagcttctactggcagggccagctgatcagcgaccaggtggccgagatcgtgagcaagtacgaccccaacgtgtacagcatcaagtacaacaaccagctggccaccagaaccgcccaggccatcttcgacgacagctacctgggctacagcgtggccgtgggcgacttcaacggcgacggcatcgacgacttcgtgagcggcgtgcccagagccgccagaaccctgggcatggtgtacatctacgacggcaagaacatgagcagcctgtacaacttcaccggcgagcagatggccgcctacttcggcttcagcgtggccgccaccgacatcaacggcgacgactacgccgacgtgttcatcggcgcccccctgttcatggacagaggcagcgacggcaagctgcaggaggtgggccaggtgagcgtgagcctgcagagagccagcggcgacttccagaccaccaagctgaacggcttcgaggtgttcgccagattcggcagcgccatcgcccccctgggcgacctggaccaggacggcttcaacgacatcgccatcgccgccccctacggcggcgaggacaagaagggcatcgtgtacatcttcaacggcagaagcaccggcctgaacgccgtgcccagccagatcctggagggccagtgggccgccagaagcatgccccccagcttcggctacagcatgaagggcgccaccgacatcgacaagaacggctaccccgacctgatcgtgggcgccttcggcgtggacagagccatcctgtacagagccagacccgtgatcaccgtgaacgccggcctggaggtgtaccccagcatcctgaaccaggacaacaagacctgcagcctgcccggcaccgccctgaaggtgagctgcttcaacgtgagattctgcctgaaggccgacggcaagggcgtgctgcccagaaagctgaacttccaggtggagctgctgctggacaagctgaagcagaagggcgccatcagaagagccctgttcctgtacagcagaagccccagccacagcaagaacatgaccatcagcagaggcggcctgatgcagtgcgaggagctgatcgcctacctgagagacgagagcgagttcagagacaagctgacccccatcaccatcttcatggagtacagactggactacagaaccgccgccgacaccaccggcctgcagcccatcctgaaccagttcacccccgccaacatcagcagacaggcccacatcctgctggactgcggcgaggacaacgtgtgcaagcccaagctggaggtgagcgtggacagcgaccagaagaagatctacatcggcgacgacaaccccctgaccctgatcgtgaaggcccagaaccagggcgagggcgcctacgaggccgagctgatcgtgagcatccccctgcaggccgacttcatcggcgtggtgagaaacaacgaggccctggccagactgagctgcgccttcaagaccgagaaccagaccagacaggtggtgtgcgacctgggcaaccccatgaaggccggcacccagctgctggccggcctgagattcagcgtgcaccagcagagcgagatggacaccagcgtgaagttcgacctgcagatccagagcagcaacctgttcgacaaggtgagccccgtggtgagccacaaggtggacctggccgtgctggccgccgtggagatcagaggcgtgagcagccccgaccacgtgttcctgcccatccccaactgggagcacaaggagaaccccgagaccgaggaggacgtgggccccgtggtgcagcacatctacgagctgagaaacaacggccccagcagcttcagcaaggccatgctgcacctgcagtggccctacaagtacaacaacaacaccctgctgtacatcctgcactacgacatcgacggccccatgaactgcaccagcgacatggagatcaaccccctgagaatcaagatcagcagcctgcagaccaccgagaagaacgacaccgtggccggccagggcgagagagaccacctgatcaccaagagagacctggccctgagcgagggcgacatccacaccctgggctgcggcgtggcccagtgcctgaagatcgtgtgccaggtgggcagactggacagaggcaagagcgccatcctgtacgtgaagagcctgctgtggaccgagaccttcatgaacaaggagaaccagaaccacagctacagcctgaagagcagcgccagcttcaacgtgatcgagttcccctacaagaacctgcccatcgaggacatcaccaacagcaccctggtgaccaccaacgtgacctggggcatccagcccgcccccatgcccgtgcccgtgtgggtgatcatcctggccgtgctggccggcctgctgctgctggccgtgctggtgttcgtgatgtacagaatgggcttcttcaagagagtgagacccccccaggaggagcaggagagagagcagctgcagccccacgagaacggcgagggcaacagcgagacctag

SEQ ID NO: 11106 - DNA, 3039 bp, Artificial Sequence
  Description of Artificial Sequence: Synthetic coding sequence
atggccttcccccccagaagaagactgagactgggccccagaggcctgcccctgctgctgagcggcctgctgctgcccctgtgcagagccttcaacctggacgtggacagccccgccgagtacagcggccccgagggcagctacttcggcttcgccgtggacttcttcgtgcccagcgccagcagcagaatgttcctgctggtgggcgcccccaaggccaacaccacccagcccggcatcgtggagggcggccaggtgctgaagtgcgactggagcagcaccagaagatgccagcccatcgagttcgacgccaccggcaacagagactacgccaaggacgaccccctggagttcaagagccaccagtggttcggcgccagcgtgagaagcaagcaggacaagatcctggcctgcgcccccctgtaccactggagaaccgagatgaagcaggagagagagcccgtgggcacctgcttcctgcaggacggcaccaagaccgtggagtacgccccctgcagaagcagacagctgatcagcgaccaggtggccgagatcgtgagcaagtacgaccccaacgtgtacagcatcaagtacaacaaccagctggccaccagaaccgcccaggccatcttcgacgacagctacctgggctacagcgtggccgtgggcgacttcaacggcgacggcatcgacgacttcgtgagcggcgtgcccagagccgccagaaccctgggcatggtgtacatctacgacggcaagaacatgagcagcctgtacaacttcaccggcgagcagatggccgcctacttcggcttcagcgtggccgccaccgacatcaacggcgacgactacgccgacgtgttcatcggcgcccccctgttcatggacagaggcagcgacggcaagctgcaggaggtgggccaggtgagcgtgagcctgcagagagccagcggcgacttccagaccaccaagctgaacggcttcgaggtgttcgccagattcggcagcgccatcgcccccctgggcgacctggaccaggacggcttcaacgacatcgccatcgccgccccctacggcggcgaggacaagaagggcatcgtgtacatcttcaacggcagaagcaccggcctgaacgccgtgcccagccagatcctggagggccagtgggccgccagaagcatgccccccagcttcggctacagcatgaagggcgccaccgacatcgacaagaacggctaccccgacctgatcgtgggcgccttcggcgtggacagagccatcctgtacagagccagacccgtgatcaccgtgaacgccggcctggaggtgtaccccagcatcctgaaccaggacaacaagacctgcagcctgcccggcaccgccctgaaggtgagctgcttcaacgtgagattctgcctgaaggccgacggcaagggcgtgctgcccagaaagctgaacttccaggtggagctgctgctggacaagctgaagcagaagggcgccatcagaagagccctgttcctgtacagcagaagccccagccacagcaagaacatgaccatcagcagaggcggcctgatgcagtgcgaggagctgatcgcctacctgagagacgagagcgagttcagagacaagctgacccccatcaccatcttcatggagtacagactggactacagaaccgccgccgacaccaccggcctgcagcccatcctgaaccagttcacccccgccaacatcagcagacaggcccacatcctgctggactgcggcgaggacaacgtgtgcaagcccaagctggaggtgagcgtggacagcgaccagaagaagatctacatcggcgacgacaaccccctgaccctgatcgtgaaggcccagaaccagggcgagggcgcctacgaggccgagctgatcgtgagcatccccctgcaggccgacttcatcggcgtggtgagaaacaacgaggccctggccagactgagctgcgccttcaagaccgagaaccagaccagacaggtggtgtgcgacctgggcaaccccatgaaggccggcacccagctgctggccggcctgagattcagcgtgcaccagcagagcgagatggacaccagcgtgaagttcgacctgcagatccagagcagcaacctgttcgacaaggtgagccccgtggtgagccacaaggtggacctggccgtgctggccgccgtggagatcagaggcgtgagcagccccgaccacgtgttcctgcccatccccaactgggagcacaaggagaaccccgagaccgaggaggacgtgggccccgtggtgcagcacatctacgagctgagaaacaacggccccagcagcttcagcaaggccatgctgcacctgcagtggccctacaagtacaacaacaacaccctgctgtacatcctgcactacgacatcgacggccccatgaactgcaccagcgacatggagatcaaccccctgagaatcaagatcagcagcctgcagaccaccgagaagaacgacaccgtggccggccagggcgagagagaccacctgatcaccaagagagacctggccctgagcgagggcgacatccacaccctgggctgcggcgtggcccagtgcctgaagatcgtgtgccaggtgggcagactggacagaggcaagagcgccatcctgtacgtgaagagcctgctgtggaccgagaccttcatgaacaaggagaaccagaaccacagctacagcctgaagagcagcgccagcttcaacgtgatcgagttcccctacaagaacctgcccatcgaggacatcaccaacagcaccctggtgaccaccaacgtgacctggggcatccagcccgcccccatgcccgtgcccgtgtgggtgatcatcctggccgtgctggccggcctgctgctgctggccgtgctggtgttcgtgatgtacagaatgggcttcttcaagagagtgagacccccccaggaggagcaggagagagagcagctgcagccccacgagaacggcgagggcaacagcgagacctag

SEQ ID NO: 11107 - DNA, 3009 bp, Artificial Sequence
  Description of Artificial Sequence: Synthetic coding sequence
atgctgctgggcaccctgctgctgatcctgtacatcctgatgctgtgcagaatgttcctgctggtgggcgcccccaaggccaacaccacccagcccggcatcgtggagggcggccaggtgctgaagtgcgactggagcagcaccagaagatgccagcccatcgagttcgacgccaccggcaacagagactacgccaaggacgaccccctggagttcaagagccaccagtggttcggcgccagcgtgagaagcaagcaggacaagatcctggcctgcgcccccctgtaccactggagaaccgagatgaagcaggagagagagcccgtgggcacctgcttcctgcaggacggcaccaagaccgtggagtacgccccctgcagaagccaggacatcgacgccgacggccagggcttctgccagggcggcttcagcatcgacttcaccaaggccgacagagtgctgctgggcggccccggcagcttctactggcagggccagctgatcagcgaccaggtggccgagatcgtgagcaagtacgaccccaacgtgtacagcatcaagtacaacaaccagctggccaccagaaccgcccaggccatcttcgacgacagctacctgggctacagcgtggccgtgggcgacttcaacggcgacggcatcgacgacttcgtgagcggcgtgcccagagccgccagaaccctgggcatggtgtacatctacgacggcaagaacatgagcagcctgtacaacttcaccggcgagcagatggccgcctacttcggcttcagcgtggccgccaccgacatcaacggcgacgactacgccgacgtgttcatcggcgcccccctgttcatggacagaggcagcgacggcaagctgcaggaggtgggccaggtgagcgtgagcctgcagagagccagcggcgacttccagaccaccaagctgaacggcttcgaggtgttcgccagattcggcagcgccatcgcccccctgggcgacctggaccaggacggcttcaacgacatcgccatcgccgccccctacggcggcgaggacaagaagggcatcgtgtacatcttcaacggcagaagcaccggcctgaacgccgtgcccagccagatcctggagggccagtgggccgccagaagcatgccccccagcttcggctacagcatgaagggcgccaccgacatcgacaagaacggctaccccgacctgatcgtgggcgccttcggcgtggacagagccatcctgtacagagccagacccgtgatcaccgtgaacgccggcctggaggtgtaccccagcatcctgaaccaggacaacaagacctgcagcctgcccggcaccgccctgaaggtgagctgcttcaacgtgagattctgcctgaaggccgacggcaagggcgtgctgcccagaaagctgaacttccaggtggagctgctgctggacaagctgaagcagaagggcgccatcagaagagccctgttcctgtacagcagaagccccagccacagcaagaacatgaccatcagcagaggcggcctgatgcagtgcgaggagctgatcgcctacctgagagacgagagcgagttcagagacaagctgacccccatcaccatcttcatggagtacagactggactacagaaccgccgccgacaccaccggcctgcagcccatcctgaaccagttcacccccgccaacatcagcagacaggcccacatcctgctggactgcggcgaggacaacgtgtgcaagcccaagctggaggtgagcgtggacagcgaccagaagaagatctacatcggcgacgacaaccccctgaccctgatcgtgaaggcccagaaccagggcgagggcgcctacgaggccgagctgatcgtgagcatccccctgcaggccgacttcatcggcgtggtgagaaacaacgaggccctggccagactgagctgcgccttcaagaccgagaaccagaccagacaggtggtgtgcgacctgggcaaccccatgaaggccggcacccagctgctggccggcctgagattcagcgtgcaccagcagagcgagatggacaccagcgtgaagttcgacctgcagatccagagcagcaacctgttcgacaaggtgagccccgtggtgagccacaaggtggacctggccgtgctggccgccgtggagatcagaggcgtgagcagccccgaccacgtgttcctgcccatccccaactgggagcacaaggagaaccccgagaccgaggaggacgtgggccccgtggtgcagcacatctacgagctgagaaacaacggccccagcagcttcagcaaggccatgctgcacctgcagtggccctacaagtacaacaacaacaccctgctgtacatcctgcactacgacatcgacggccccatgaactgcaccagcgacatggagatcaaccccctgagaatcaagatcagcagcctgcagaccaccgagaagaacgacaccgtggccggccagggcgagagagaccacctgatcaccaagagagacctggccctgagcgagggcgacatccacaccctgggctgcggcgtggcccagtgcctgaagatcgtgtgccaggtgggcagactggacagaggcaagagcgccatcctgtacgtgaagagcctgctgtggaccgagaccttcatgaacaaggagaaccagaaccacagctacagcctgaagagcagcgccagcttcaacgtgatcgagttcccctacaagaacctgcccatcgaggacatcaccaacagcaccctggtgaccaccaacgtgacctggggcatccagcccgcccccatgcccgtgcccgtgtgggtgatcatcctggccgtgctggccggcctgctgctgctggccgtgctggtgttcgtgatgtacagaatgggcttcttcaagagagtgagacccccccaggaggagcaggagagagagcagctgcagccccacgagaacggcgagggcaacagcgagacctag

SEQ ID NO: 11108 - DNA, 1449 bp, Artificial Sequence
  Description of Artificial Sequence: Synthetic coding sequence
atggccttcccccccagaagaagactgagactgggccccagaggcctgcccctgctgctgagcggcctgctgctgcccctgtgcagagccttcaacctggacgtggacagccccgccgagtacagcggccccgagggcagctacttcggcttcgccgtggacttcttcgtgcccagcgccagcagcagaatgttcctgctggtgggcgcccccaaggccaacaccacccagcccggcatcgtggagggcggccaggtgctgaagtgcgactggagcagcaccagaagatgccagcccatcgagttcgacgccaccggcaacagagactacgccaaggacgaccccctggagttcaagagccaccagtggttcggcgccagcgtgagaagcaagcaggacaagatcctggcctgcgcccccctgtaccactggagaaccgagatgaagcaggagagagagcccgtgggcacctgcttcctgcaggacggcaccaagaccgtggagtacgccccctgcagaagccaggacatcgacgccgacggccagggcttctgccagggcggcttcagcatcgacttcaccaaggccgacagagtgctgctgggcggccccggcagcttctactggcagggccagctgatcagcgaccaggtggccgagatcgtgagcaagtacgaccccaacgtgtacagcatcaagtacaacaaccagctggccaccagaaccgcccaggccatcttcgacgacagctacctgggctacagcgtggccgtgggcgacttcaacggcgacggcatcgacgacttcgtgagcggcgtgcccagagccgccagaaccctgggcatggtgtacatctacgacggcaagaacatgagcagcctgtacaacttcaccggcgagcagatggccgcctacttcggcttcagcgtggccgccaccgacatcaacggcgacgactacgccgacgtgttcatcggcgcccccctgttcatggacagaggcagcgacggcaagctgcaggaggtgggccaggtgagcgtgagcctgcagagagccagcggcgacttccagaccaccaagctgaacggcttcgaggtgttcgccagattcggcagcgccatcgcccccctgggcgacctggaccaggacggcttcaacgacatcgccatcgccgccccctacggcggcgaggacaagaagggcatcgtgtacatcttcaacggcagaagcaccggcctgaacgccgtgcccagccagatcctggagggccagtgggccgccagaagcatgccccccagcttcggctacagcatgaagggcgccaccgacatcgacaagaacggctaccccgacctgatcgtgggcgccttcggcgtggacagagccatcctgtacagagccagacccgtgatccccatcttcgtgcagctgcaccacgtggtgcactag

SEQ ID NO: 11109 - DNA, 2397 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagagagccgaggactaccccatcgacctgtactacctgatggacctgagctacagcatgaaggacgacctggagaacgtgaagagcctgggcaccgacctgatgaacgagatgagaagaatcaccagcgacttcagaatcggcttcggcagcttcgtggagaagaccgtgatgccctacatcagcaccacccccgccaagctgagaaacccctgcaccagcgagcagaactgcaccagccccttcagctacaagaacgtgctgagcctgaccaacaagggcgaggtgttcaacgagctggtgggcaagcagagaatcagcggcaacctggacagccccgagggcggcttcgacgccatcatgcaggtggccgtgtgcggcagcctgatcggctggagaaacgtgaccagactgctggtgttcagcaccgacgccggcttccacttcgccggcgacggcaagctgggcggcatcgtgctgcccaacgacggccagtgccacctggagaacaacatgtacaccatgagccactactacgactaccccagcatcgcccacctggtgcagaagctgagcgagaacaacatccagaccatcttcgccgtgaccgaggagttccagcccgtgtacaaggagctgaagaacctgatccccaagagcgccgtgggcaccctgagcgccaacagcagcaacgtgatccagctgatcatcgacgcctacaacagcctgagcagcgaggtgatcctggagaacggcaagctgagcgagggcgtgaccatcagctacaagagctactgcaagaacggcgtgaacggcaccggcgagaacggcagaaagtgcagcaacatcagcatcggcgacgaggtgcagttcgagatcagcatcaccagcaacaagtgccccaagaaggacagcgacagcttcaagatcagacccctgggcttcaccgaggaggtggaggtgatcctgcagtacatctgcgagtgcgagtgccagagcgagggcatccccgagagccccaagtgccacgagggcaacggcaccttcgagtgcggcgcctgcagatgcaacgagggcagagtgggcagacactgcgagtgcagcaccgacgaggtgaacagcgaggacatggacgcctactgcagaaaggagaacagcagcgagatctgcagcaacaacggcgagtgcgtgtgcggccagtgcgtgtgcagaaagagagacaacaccaacgagatctacagcggcaagttctgcgagtgcgacaacttcaactgcgacagaagcaacggcctgatctgcggcggcaacggcgtgtgcaagtgcagagtgtgcgagtgcaaccccaactacaccggcagcgcctgcgactgcagcctggacaccagcacctgcgaggccagcaacggccagatctgcaacggcagaggcatctgcgagtgcggcgtgtgcaagtgcaccgaccccaagttccagggccagacctgcgagatgtgccagacctgcctgggcgtgtgcgccgagcacaaggagtgcgtgcagtgcagagccttcaacaagggcgagaagaaggacacctgcacccaggagtgcagctacttcaacatcaccaaggtggagagcagagacaagctgccccagcccgtgcagcccgaccccgtgagccactgcaaggagaaggacgtggacgactgctggttctacttcacctacagcgtgaacggcaacaacgaggtgatggtgcacgtggtggagaaccccgagtgccccaccggccccgacatcatccccatcgtggccggcgtggtggccggcatcgtgctgatcggcctggccctgctgctgatctggaagctgctgatgatcatccacgacagaagagagttcgccaagttcgagaaggagaagatgaacgccaagtgggacaccggcgagaaccccatctacaagagcgccgtgaccaccgtggtgaaccccaagtacgagggcaagtag

SEQ ID NO: 11110 - DNA, 2478 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagagagccgaggactaccccatcgacctgtactacctgatggacctgagctacagcatgaaggacgacctggagaacgtgaagagcctgggcaccgacctgatgaacgagatgagaagaatcaccagcgacttcagaatcggcttcggcagcttcgtggagaagaccgtgatgccctacatcagcaccacccccgccaagctgagaaacccctgcaccagcgagcagaactgcaccagccccttcagctacaagaacgtgctgagcctgaccaacaagggcgaggtgttcaacgagctggtgggcaagcagagaatcagcggcaacctggacagccccgagggcggcttcgacgccatcatgcaggtggccgtgtgcggcagcctgatcggctggagaaacgtgaccagactgctggtgttcagcaccgacgccggcttccacttcgccggcgacggcaagctgggcggcatcgtgctgcccaacgacggccagtgccacctggagaacaacatgtacaccatgagccactactacgactaccccagcatcgcccacctggtgcagaagctgagcgagaacaacatccagaccatcttcgccgtgaccgaggagttccagcccgtgtacaaggagctgaagaacctgatccccaagagcgccgtgggcaccctgagcgccaacagcagcaacgtgatccagctgatcatcgacgcctacaacagcctgagcagcgaggtgatcctggagaacggcaagctgagcgagggcgtgaccatcagctacaagagctactgcaagaacggcgtgaacggcaccggcgagaacggcagaaagtgcagcaacatcagcatcggcgacgaggtgcagttcgagatcagcatcaccagcaacaagtgccccaagaaggacagcgacagcttcaagatcagacccctgggcttcaccgaggaggtggaggtgatcctgcagtacatctgcgagtgcgagtgccagagcgagggcatccccgagagccccaagtgccacgagggcaacggcaccttcgagtgcggcgcctgcagatgcaacgagggcagagtgggcagacactgcgagtgcagcaccgacgaggtgaacagcgaggacatggacgcctactgcagaaaggagaacagcagcgagatctgcagcaacaacggcgagtgcgtgtgcggccagtgcgtgtgcagaaagagagacaacaccaacgagatctacagcggcaagttctgcgagtgcgacaacttcaactgcgacagaagcaacggcctgatctgcggcggcaacggcgtgtgcaagtgcagagtgtgcgagtgcaaccccaactacaccggcagcgcctgcgactgcagcctggacaccagcacctgcgaggccagcaacggccagatctgcaacggcagaggcatctgcgagtgcggcgtgtgcaagtgcaccgaccccaagttccagggccagacctgcgagatgtgccagacctgcctgggcgtgtgcgccgagcacaaggagtgcgtgcagtgcagagccttcaacaagggcgagaagaaggacacctgcacccaggagtgcagctacttcaacatcaccaaggtggagagcagagacaagctgccccagcccgtgcagcccgaccccgtgagccactgcaaggagaaggacgtggacgactgctggttctacttcacctacagcgtgaacggcaacaacgaggtgatggtgcacgtggtggagaaccccgagtgccccaccggccccgacatcatccccatcgtggccggcgtggtggccggcatcgtgctgatcggcctggccctgctgctgatctggaagctgctgatgatcatccacgacagaagagagttcgccaagttcgagaaggagaagatgaacgccaagtgggacaccagcctgagcgtggcccagcccggcgtgcagtggtgcgacatcagcagcctgcagcccctgaccagcagattccagcagttcagctgcctgagcctgcccagcacctgggactacagagtgaagatcctgttcatcagagtgccctag

SEQ ID NO: 11111 - DNA, 2397 bp, Artificial Sequence; identical to SEQ ID NO: 11109
  Description of Artificial Sequence: Synthetic coding sequence

SEQ ID NO: 11112 - DNA, 150 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcacctag

SEQ ID NO: 11113 - DNA, 270 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatctag

SEQ ID NO: 11114 - DNA, 2406 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagagagccgaggactaccccatcgacctgtactacctgatggacctgagctacagcatgaaggacgacctggagaacgtgaagagcctgggcaccgacctgatgaacgagatgagaagaatcaccagcgacttcagaatcggcttcggcagcttcgtggagaagaccgtgatgccctacatcagcaccacccccgccaagctgagaaacccctgcaccagcgagcagaactgcaccagccccttcagctacaagaacgtgctgagcctgaccaacaagggcgaggtgttcaacgagctggtgggcaagcagagaatcagcggcaacctggacagccccgagggcggcttcgacgccatcatgcaggtggccgtgtgcggcagcctgatcggctggagaaacgtgaccagactgctggtgttcagcaccgacgccggcttccacttcgccggcgacggcaagctgggcggcatcgtgctgcccaacgacggccagtgccacctggagaacaacatgtacaccatgagccactactacgactaccccagcatcgcccacctggtgcagaagctgagcgagaacaacatccagaccatcttcgccgtgaccgaggagttccagcccgtgtacaaggagctgaagaacctgatccccaagagcgccgtgggcaccctgagcgccaacagcagcaacgtgatccagctgatcatcgacgcctacaacagcctgagcagcgaggtgatcctggagaacggcaagctgagcgagggcgtgaccatcagctacaagagctactgcaagaacggcgtgaacggcaccggcgagaacggcagaaagtgcagcaacatcagcatcggcgacgaggtgcagttcgagatcagcatcaccagcaacaagtgccccaagaaggacagcgacagcttcaagatcagacccctgggcttcaccgaggaggtggaggtgatcctgcagtacatctgcgagtgcgagtgccagagcgagggcatccccgagagccccaagtgccacgagggcaacggcaccttcgagtgcggcgcctgcagatgcaacgagggcagagtgggcagacactgcgagtgcagcaccgacgaggtgaacagcgaggacatggacgcctactgcagaaaggagaacagcagcgagatctgcagcaacaacggcgagtgcgtgtgcggccagtgcgtgtgcagaaagagagacaacaccaacgagatctacagcggcaagttctgcgagtgcgacaacttcaactgcgacagaagcaacggcctgatctgcggcggcaacggcgtgtgcaagtgcagagtgtgcgagtgcaaccccaactacaccggcagcgcctgcgactgcagcctggacaccagcacctgcgaggccagcaacggccagatctgcaacggcagaggcatctgcgagtgcggcgtgtgcaagtgcaccgaccccaagttccagggccagacctgcgagatgtgccagacctgcctgggcgtgtgcgccgagcacaaggagtgcgtgcagtgcagagccttcaacaagggcgagaagaaggacacctgcacccaggagtgcagctacttcaacatcaccaaggtggagagcagagacaagctgccccagcccgtgcagcccgaccccgtgagccactgcaaggagaaggacgtggacgactgctggttctacttcacctacagcgtgaacggcaacaacgaggtgatggtgcacgtggtggagaaccccgagtgccccaccggccccgacatcatccccatcgtggccggcgtggtggccggcatcgtgctgatcggcctggccctgctgctgatctggaagctgctgatgatcatccacgacagaagagagttcgccaagttcgagaaggagaagatgaacgccaagtgggacacccaggagaaccccatctacaagagccccatcaacaacttcaagaaccccaactacggcagaaaggccggcctgtag

SEQ ID NO: 11115 - DNA, 411 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagtag

SEQ ID NO: 11116 - DNA, 378 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagctag

SEQ ID NO: 11117 - DNA, 492 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagagagccgaggactaccccatcgacctgtactacctgatggacctgagctacagcatgaaggacgacctggagaacgtgaagtag

SEQ ID NO: 11118 - DNA, 459 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcgtgagcaagaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagagagccgaggactaccccatcgacctgtactacctgatgtag

SEQ ID NO: 11119 - DNA, 315 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagtag

SEQ ID NO: 11120 - DNA, 432 bp, Artificial Sequence
  Description of Artificial Sequence: Synthetic coding sequence
atgaacctgcagcccatcttctggatcggcctgatcagcagcgtgtgctgcgtgttcgcccagaccgacgagaacagatgcctgaaggccaacgccaagagctgcggcgagtgcatccaggccggccccaactgcggctggtgcaccaacagcaccttcctgcaggagggcatgcccaccagcgccagatgcgacgacctggaggccctgaagaagaagggctgcccccccgacgacatcgagaaccccagaggcagcaaggacatcaagaagaacaagaacgtgaccaacagaagcaagggcaccgccgagaagctgaagcccgaggacatcacccagatccagccccagcagctggtgctgagactgagaagcggcgagccccagaccttcaccctgaagttcaagagagccgaggactaccccatctag

SEQ ID NO: 11121 - DNA, 2310 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgagaggctgcgccgccgacgacatcatggaccccaccagcctggccgagacccaggaggaccacaacggcggccagaagcagctgagcccccagaaggtgaccctgtacctgagacccggccaggccgccgccttcaacgtgaccttcagaagagccaagggctaccccatcgacctgtactacctgatggacctgagctacagcatgctggacgacctgagaaacgtgaagaagctgggcggcgacctgctgagagccctgaacgagatcaccgagagcggcagaatcggcttcggcagcttcgtggacaagaccgtgctgcccttcgtgaacacccaccccgacaagctgagaaacccctgccccaacaaggagaaggagtgccagccccccttcgccttcagacacgtgctgaagctgaccaacaacagcaaccagttccagaccgaggtgggcaagcagctgatcagcggcaacctggacgcccccgagggcggcctggacgccatgatgcaggtggccgcctgccccgaggagatcggctggagaaacgtgaccagactgctggtgttcgccaccgacgacggcttccacttcgccggcgacggcaagctgggcgccatcctgacccccaacgacggcagatgccacctggaggacaacctgtacaagagaagcaacgagttcgactaccccagcgtgggccagctggcccacaagctggccgagaacaacatccagcccatcttcgccgtgaccagcagaatggtgaagacctacgagaagctgaccgagatcatccccaagagcgccgtgggcgagctgagcgaggacagcagcaacgtggtgcagctgatcaagaacgcctacaacaagctgagcagcagagtgttcctggaccacaacgccctgcccgacaccctgaaggtgacctacgacagcttctgcagcaacggcgtgacccacagaaaccagcccagaggcgactgcgacggcgtgcagatcaacgtgcccatcaccttccaggtgaaggtgaccgccaccgagtgcatccaggagcagagcttcgtgatcagagccctgggcttcaccgacatcgtgaccgtgcaggtgctgccccagtgcgagtgcagatgcagagaccagagcagagacagaagcctgtgccacggcaagggcttcctggagtgcggcatctgcagatgcgacaccggctacatcggcaagaactgcgagtgccagacccagggcagaagcagccaggagctggagggcagctgcagaaaggacaacaacagcatcatctgcagcggcctgggcgactgcgtgtgcggccagtgcctgtgccacaccagcgacgtgcccggcaagctgatctacggccagtactgcgagtgcgacaccatcaactgcgagagatacaacggccaggtgtgcggcggccccggcagaggcctgtgcttctgcggcaagtgcagatgccaccccggcttcgagggcagcgcctgccagtgcgagagaaccaccgagggctgcctgaaccccagaagagtggagtgcagcggcagaggcagatgcagatgcaacgtgtgcgagtgccacagcggctaccagctgcccctgtgccaggagtgccccggctgccccagcccctgcggcaagtacatcagctgcgccgagtgcctgaagttcgagaagggccccttcggcaagaactgcagcgccgcctgccccggcctgcagctgagcaacaaccccgtgaagggcagaacctgcaaggagagagacagcgagggctgctgggtggcctacaccctggagcagcaggacggcatggacagatacctgatctacgtggacgagagcagagagtgcgtggccggccccaacatcgccgccatcgtgggcggcaccgtggccggcatcgtgctgatcggcatcctgctgctggtgatctggaaggccctgatccacctgagcgacctgagagagtacagaagattcgagaaggagaagctgaagagccagtggaacaacgacaaccccctgttcaagagcgccaccaccaccgtgatgaaccccaagttcgccgagagctag

SEQ ID NO: 11122 - DNA, 969 bp, Artificial Sequence
  Description of Artificial Sequence: Synthetic coding sequence
ggcagactgggcaaggacctggccaccggcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgagaggctgcgccgccgacgacatcatggaccccaccagcctggccgagacccaggaggaccacaacggcggccagaagcagctgagcccccagaaggtgaccctgtacctgagacccggccaggccgccgccttcaacgtgaccttcagaagagccaagggctaccccatcgacctgtactacctgatggacctgagctacagcatgctggacgacctgagaaacgtgaagaagctgggcggcgacctgctgagagccctgaacgagatcaccgagagcggcagaatcggcttcggcagcttcgtggacaagaccgtgctgcccttcgtgaacacccaccccgacaagctgagaaacccctgccccaacaaggagaaggagtgccagccccccttcgccttcagacacgtgctgaagctgaccaacaacagcaaccagttccagaccgaggtgggcaagcagctgatcagcggcaacctggacgcccccgagggcggcctggacgccatgatgcaggtggccgcctgccccgaggagatcggctggagaaacgtgaccagactgctggtgttcgccaccgacgacggcttccacttcgccggcgacggcaagctgggcgccatcctgacccccaacgacggcagatgccacctggaggacaacctgtacaagagaagcaacgagttcgactaccccagcgtgggccagctggcccacaagctggccgagaacaacatccagcccatcttcgccgtgaccagcagaatggtgaagacctacgagtag

SEQ ID NO: 11123 - DNA, 2310 bp, Artificial Sequence; identical to SEQ ID NO: 11121
  Description of Artificial Sequence: Synthetic coding sequence

SEQ ID NO: 11124 - DNA, 2310 bp, Artificial Sequence; identical to SEQ ID NO: 11121
  Description of Artificial Sequence: Synthetic coding sequence

SEQ ID NO: 11125 - DNA, 2310 bp, Artificial Sequence; identical to SEQ ID NO: 11121
  Description of Artificial Sequence: Synthetic coding sequence

SEQ ID NO: 11126 - DNA, 2310 bp, Artificial Sequence; identical to SEQ ID NO: 11121
  Description of Artificial Sequence: Synthetic coding sequence

SEQ ID NO: 11127 - DNA, 363 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgagaggctgcgccgccgacgacatcatggaccccaccagcctggccgagacccaggaggaccacaacggcggccagaagcagctgagcccccagaaggtgaccctgtacctgagacccggccaggccgccgccttcaacgtgaccttcagatag

SEQ ID NO: 11128 - DNA, 213 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgtag

SEQ ID NO: 11129 - DNA, 150 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgtag

SEQ ID NO: 11130 - DNA, 483 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgagaggctgcgccgccgacgacatcatggaccccaccagcctggccgagacccaggaggaccacaacggcggccagaagcagctgagcccccagaaggtgaccctgtacctgagacccggccaggccgccgccttcaacgtgaccttcagaagagccaagggctaccccatcgacctgtactacctgatggacctgagctacagcatgctggacgacctgagaaacgtgaagaagctgggcggcgacctgctgagagccctgaacgagatctag

SEQ ID NO: 11131 - DNA, 501 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgagaggctgcgccgccgacgacatcatggaccccaccagcctggccgagacccaggaggaccacaacggcggccagaagcagctgagcccccagaaggtgaccctgtacctgagacccggccaggccgccgccttcaacgtgaccttcagaagagccaagggctaccccatcgacctgtactacctgatggacctgagctacagcatgctggacgacctgagaaacgtgaagaagctgggcggcgacctgctgagagccctgaacgagatcaccgagagcggcagaatctag

SEQ ID NO: 11132 - DNA, 1137 bp, Artificial Sequence
  Description of Artificial Sequence: Synthetic coding sequence
atgctgggcctgagaccccccctgctggccctggtgggcctgctgagcctgggctgcgtgctgagccaggagtgcaccaagttcaaggtgagcagctgcagagagtgcatcgagagcggccccggctgcacctggtgccagaagctgaacttcaccggccccggcgaccccgacagcatcagatgcgacaccagaccccagctgctgatgagaggctgcgccgccgacgacatcatggaccccaccagcctggccgagacccaggaggaccacaacggcggccagaagcagctgagcccccagaaggtgaccctgtacctgagacccggcttcggcagcttcgtggacaagaccgtgctgcccttcgtgaacacccaccccgacaagctgagaaacccctgccccaacaaggagaaggagtgccagccccccttcgccttcagacacgtgctgaagctgaccaacaacagcaaccagttccagaccgaggtgggcaagcagctgatcagcggcaacctggacgcccccgagggcggcctggacgccatgatgcaggtggccgcctgccccgaggagatcggctggagaaacgtgaccagactgctggtgttcgccaccgacgacggcttccacttcgccggcgacggcaagctgggcgccatcctgacccccaacgacggcagatgccacctggaggacaacctgtacaagagaagcaacgagttcgactaccccagcgtgggccagctggcccacaagctggccgagaacaacatccagcccatcttcgccgtgaccagcagaatggtgaagacctacgagaagctgaccgagatcatccccaagagcgccgtgggcgagctgagcgaggacagcagcaacgtggtgcagctgatcaagaacgcctacaacaagctgagcagcagagtgttcctggaccacaacgccctgcccgacaccctgaaggtgacctacgacagcttctgcagcaacggcgtgacccacagaaaccagcccagaggcgactgcgacggcgtgcagatcaacgtgcccatcaccttccaggtgaaggtgaccgccaccgagtgcatccaggagcagagcttcgtgatcggcagatgggccagcagaacctag

SEQ ID NO: 11133 - DNA, 2367 bp, Artificial Sequence
  Description of Artificial Sequence: Synthetic coding sequence
atgagagccagacccagacccagacccctgtgggccaccgtgctggccctgggcgccctggccggcgtgggcgtgggcggccccaacatctgcaccaccagaggcgtgagcagctgccagcagtgcctggccgtgagccccatgtgcgcctggtgcagcgacgaggccctgcccctgggcagccccagatgcgacctgaaggagaacctgctgaaggacaactgcgcccccgagagcatcgagttccccgtgagcgaggccagagtgctggaggacagacccctgagcgacaagggcagcggcgacagcagccaggtgacccaggtgagcccccagagaatcgccctgagactgagacccgacgacagcaagaacttcagcatccaggtgagacaggtggaggactaccccgtggacatctactacctgatggacctgagctacagcatgaaggacgacctgtggagcatccagaacctgggcaccaagctggccacccagatgagaaagctgaccagcaacctgagaatcggcttcggcgccttcgtggacaagcccgtgagcccctacatgtacatcagcccccccgaggccctggagaacccctgctacgacatgaagaccacctgcctgcccatgttcggctacaagcacgtgctgaccctgaccgaccaggtgaccagattcaacgaggaggtgaagaagcagagcgtgagcagaaacagagacgcccccgagggcggcttcgacgccatcatgcaggccaccgtgtgcgacgagaagatcggctggagaaacgacgccagccacctgctggtgttcaccaccgacgccaagacccacatcgccctggacggcagactggccggcatcgtgcagcccaacgacggccagtgccacgtgggcagcgacaaccactacagcgccagcaccaccatggactaccccagcctgggcctgatgaccgagaagctgagccagaagaacatcaacctgatcttcgccgtgaccgagaacgtggtgaacctgtaccagaactacagcgagctgatccccggcaccaccgtgggcgtgctgagcatggacagcagcaacgtgctgcagctgatcgtggacgcctacggcaagatcagaagcaaggtggagctggaggtgagagacctgcccgaggagctgagcctgagcttcaacgccacctgcctgaacaacgaggtgatccccggcctgaagagctgcatgggcctgaagatcggcgacaccgtgagcttcagcatcgaggccaaggtgagaggctgcccccaggagaaggagaagagcttcaccatcaagcccgtgggcttcaaggacagcctgatcgtgcaggtgaccttcgactgcgactgcgcctgccaggcccaggccgagcccaacagccacagatgcaacaacggcaacggcaccttcgagtgcggcgtgtgcagatgcggccccggctggctgggcagccagtgcgagtgcagcgaggaggactacagacccagccagcaggacgagtgcagccccagagagggccagcccgtgtgcagccagagaggcgagtgcctgtgcggccagtgcgtgtgccacagcagcgacttcggcaagatcaccggcaagtactgcgagtgcgacgacttcagctgcgtgagatacaagggcgagatgtgcagcggccacggccagtgcagctgcggcgactgcctgtgcgacagcgactggaccggctactactgcaactgcaccaccagaaccgacacctgcatgagcagcaacggcctgctgtgcagcggcagaggcaagtgcgagtgcggcagctgcgtgtgcatccagcccggcagctacggcgacacctgcgagaagtgccccacctgccccgacgcctgcaccttcaagaaggagtgcgtggagtgcaagaagttcgacagaggcgccctgcacgacgagaacacctgcaacagatactgcagagacgagatcgagagcgtgaaggagctgaaggacaccggcaaggacgccgtgaactgcacctacaagaacgaggacgactgcgtggtgagattccagtactacgaggacagcagcggcaagagcatcctgtacgtggtggaggagcccgagtgccccaagggccccgacatcctggtggtgctgctgagcgtgatgggcgccatcctgctgatcggcctggccgccctgctgatctggaagctgctgatcaccatccacgacagaaaggagttcgccaagttcgaggaggagagagccagagccaagtgggacaccgccaacaaccccctgtacaaggaggccaccagcaccttcaccaacatcacctacagaggcacctag

SEQ ID NO: 11134 - DNA, 2256 bp, Artificial Sequence
  Description of Artificial Sequence: Synthetic coding sequence
atgtgcgcctggtgcagcgacgaggccctgcccctgggcagccccagatgcgacctgaaggagaacctgctgaaggacaactgcgcccccgagagcatcgagttccccgtgagcgaggccagagtgctggaggacagacccctgagcgacaagggcagcggcgacagcagccaggtgacccaggtgagcccccagagaatcgccctgagactgagacccgacgacagcaagaacttcagcatccaggtgagacaggtggaggactaccccgtggacatctactacctgatggacctgagctacagcatgaaggacgacctgtggagcatccagaacctgggcaccaagctggccacccagatgagaaagctgaccagcaacctgagaatcggcttcggcgccttcgtggacaagcccgtgagcccctacatgtacatcagcccccccgaggccctggagaacccctgctacgacatgaagaccacctgcctgcccatgttcggctacaagcacgtgctgaccctgaccgaccaggtgaccagattcaacgaggaggtgaagaagcagagcgtgagcagaaacagagacgcccccgagggcggcttcgacgccatcatgcaggccaccgtgtgcgacgagaagatcggctggagaaacgacgccagccacctgctggtgttcaccaccgacgccaagacccacatcgccctggacggcagactggccggcatcgtgcagcccaacgacggccagtgccacgtgggcagcgacaaccactacagcgccagcaccaccatggactaccccagcctgggcctgatgaccgagaagctgagccagaagaacatcaacctgatcttcgccgtgaccgagaacgtggtgaacctgtaccagaactacagcgagctgatccccggcaccaccgtgggcgtgctgagcatggacagcagcaacgtgctgcagctgatcgtggacgcctacggcaagatcagaagcaaggtggagctggaggtgagagacctgcccgaggagctgagcctgagcttcaacgccacctgcctgaacaacgaggtgatccccggcctgaagagctgcatgggcctgaagatcggcgacaccgtgagcttcagcatcgaggccaaggtgagaggctgcccccaggagaaggagaagagcttcaccatcaagcccgtgggcttcaaggacagcctgatcgtgcaggtgaccttcgactgcgactgcgcctgccaggcccaggccgagcccaacagccacagatgcaacaacggcaacggcaccttcgagtgcggcgtgtgcagatgcggccccggctggctgggcagccagtgcgagtgcagcgaggaggactacagacccagccagcaggacgagtgcagccccagagagggccagcccgtgtgcagccagagaggcgagtgcctgtgcggccagtgcgtgtgccacagcagcgacttcggcaagatcaccggcaagtactgcgagtgcgacgacttcagctgcgtgagatacaagggcgagatgtgcagcggccacggccagtgcagctgcggcgactgcctgtgcgacagcgactggaccggctactactgcaactgcaccaccagaaccgacacctgcatgagcagcaacggcctgctgtgcagcggcagaggcaagtgcgagtgcggcagctgcgtgtgcatccagcccggcagctacggcgacacctgcgagaagtgccccacctgccccgacgcctgcaccttcaagaaggagtgcgtggagtgcaagaagttcgacagaggcgccctgcacgacgagaacacctgcaacagatactgcagagacgagatcgagagcgtgaaggagctgaaggacaccggcaaggacgccgtgaactgcacctacaagaacgaggacgactgcgtggtgagattccagtactacgaggacagcagcggcaagagcatcctgtacgtggtggaggagcccgagtgccccaagggccccgacatcctggtggtgctgctgagcgtgatgggcgccatcctgctgatcggcctggccgccctgctgatctggaagctgctgatcaccatccacgacagaaaggagttcgccaagttcgaggaggagagagccagagccaagtgggacaccgagatcctgctgtactactgcagcttcatcctggtgcaccagagcctggagagcctgagaaccgagttcaccagcaagcagaaggacggcaactag

SEQ ID NO: 11135 - DNA, 2367 bp, Artificial Sequence; identical to SEQ ID NO: 11133
  Description of Artificial Sequence: Synthetic coding sequence

SEQ ID NO: 11136 - DNA, 1359 bp, Artificial Sequence
  Description of Artificial Sequence: Synthetic coding sequence
atggacgacatcttcacccagtgcagagagggcaacgccgtggccgtgagactgtggctggacaacaccgagaacgacctgaaccagggcgacgaccacggcttcagccccctgcactgggcctgcagagagggcagaagcgccgtggtggagatgctgatcatgagaggcgccagaatcaacgtgatgaacagaggcgacgacacccccctgcacctggccgccagccacggccacagagacatcgtgcagaagctgctgcagtacaaggccgacatcaacgccgtgaacgagcacggcaacgtgcccctgcactacgcctgcttctggggccaggaccaggtggccgaggacctggtggccaacggcgccctggtgagcatctgcaacaagtacggcgagatgcccgtggacaaggccaaggcccccctgagagagctgctgagagagagagccgagaagatgggccagaacctgaacagaatcccctacaaggacaccttctggaagggcaccaccagaaccagacccagaaacggcaccctgaacaagcacagcggcatcgacttcaagcagctgaacttcctgaccaagctgaacgagaaccacagcggcgagctgtggaagggcagatggcagggcaacgacatcgtggtgaaggtgctgaaggtgagagactggagcaccagaaagagcagagacttcaacgaggagtgccccagactgagaatcttcagccaccccaacgtgctgcccgtgctgggcgcctgccagagcccccccgccccccaccccaccctgatcacccactggatgccctacggcagcctgtacaacgtgctgcacgagggcaccaacttcgtggtggaccagagccaggccgtgaagttcgccctggacatggccagaggcatggccttcctgcacaccctggagcccctgatccccagacacgccctgaacagcagaagcgtgatgatcgacgaggacatgaccgccagaatcagcatggccgacgtgaagttcagcttccagtgccccggcagaatgtacgcccccgcctgggtggcccccgaggccctgcagaagaagcccgaggacaccaacagaagaagcgccgacatgtggagcttcgccgtgctgctgtgggagctggtgaccagagaggtgcccttcgccgacctgagcaacatggagatcggcatgaaggtggccctggagggcctgagacccaccatcccccccggcatcagcccccacgtgtgcaagctgatgaagatctgcatgaacgaggaccccgccaagagacccaagttcgacatgatcgtgcccatcctggagaagatgcaggacaagtag

SEQ ID NO: 11137 - DNA, 1359 bp, Artificial Sequence; identical to SEQ ID NO: 11136
  Description of Artificial Sequence: Synthetic coding sequence

SEQ ID NO: 11138 - DNA, 1359 bp, Artificial Sequence; identical to SEQ ID NO: 11136
  Description of Artificial Sequence: Synthetic coding sequence

SEQ ID NO: 11139 - DNA, 957 bp, Artificial Sequence
  Description of Artificial Sequence: Synthetic coding sequence
atgcccgtggacaaggccaaggcccccctgagagagctgctgagagagagagccgagaagatgggccagaacctgaacagaatcccctacaaggacaccttctggaagggcaccaccagaaccagacccagaaacggcaccctgaacaagcacagcggcatcgacttcaagcagctgaacttcctgaccaagctgaacgagaaccacagcggcgagctgtggaagggcagatggcagggcaacgacatcgtggtgaaggtgctgaaggtgagagactggagcaccagaaagagcagagacttcaacgaggagtgccccagactgagaatcttcagccaccccaacgtgctgcccgtgctgggcgcctgccagagcccccccgccccccaccccaccctgatcacccactggatgccctacggcagcctgtacaacgtgctgcacgagggcaccaacttcgtggtggaccagagccaggccgtgaagttcgccctggacatggccagaggcatggccttcctgcacaccctggagcccctgatccccagacacgccctgaacagcagaagcgtgatgatcgacgaggacatgaccgccagaatcagcatggccgacgtgaagttcagcttccagtgccccggcagaatgtacgcccccgcctgggtggcccccgaggccctgcagaagaagcccgaggacaccaacagaagaagcgccgacatgtggagcttcgccgtgctgctgtgggagctggtgaccagagaggtgcccttcgccgacctgagcaacatggagatcggcatgaaggtggccctggagggcctgagacccaccatcccccccggcatcagcccccacgtgtgcaagctgatgaagatctgcatgaacgaggaccccgccaagagacccaagttcgacatgatcgtgcccatcctggagaagatgcaggacaagtag

SEQ ID NO: 11140 - DNA, 978 bp, Artificial Sequence
  Description of Artificial Sequence: Synthetic coding sequence
atgcccatcaccagaatgagaatgagaccctggctggagatgcagatcaacagcaaccagatccccggcctgatctggatcaacaaggaggagatgatcttccagatcccctggaagcacgccgccaagcacggctgggacatcaacaaggacgcctgcctgttcagaagctgggccatccacaccggcagatacaaggccggcgagaaggagcccgaccccaagacctggaaggccaacttcagatgcgccatgaacagcctgcccgacatcgaggaggtgaaggaccagagcagaaacaagggcagcagcgccgtgagagtgtacagaatgctgccccccctgaccaagaaccagagaaaggagagaaagagcaagagcagcagagacgccaagagcaaggccaagagaaagagctgcggcgacagcagccccgacaccttcagcgacggcctgagcagcagcaccctgcccgacgaccacagcagctacaccgtgcccggctacatgcaggacctggaggtggagcaggccctgacccccgccctgagcccctgcgccgtgagcagcaccctgcccgactggcacatccccgtggaggtggtgcccgacagcaccagcgacctgtacaacttccaggtgagccccatgcccagcaccagcgaggccaccaccgacgaggacgaggagggcaagctgcccgaggacatcatgaagctgctggagcagagcgagtggcagcccaccaacgtggacggcaagggctacctgctgaacgagcccggcgtgcagcccaccagcgtgtacggcgacttcagctgcaaggaggagcccgagatcgacagccccggcggcgacatcggcctgagcctgcagagagtgttcaccgacctgaagaacatggacgccacctggctggacagcctgctgacccccgtgagactgcccagcatccaggccatcccctgcgccccctag

SEQ ID NO: 11141 - DNA, 978 bp, Artificial Sequence; identical to SEQ ID NO: 11140
  Description of Artificial Sequence: Synthetic coding sequence

SEQ ID NO: 11142 - DNA, 579 bp, Artificial Sequence
  Description of Artificial Sequence: Synthetic coding sequence
atgcccatcaccagaatgagaatgagaccctggctggagatgcagatcaacagcaaccagatccccggcctgatctggatcaacaaggaggagatgatcttccagatcccctggaagcacgccgccaagcacggctgggacatcaacaaggacgcctgcctgttcagaagctgggccatccacaccggcagatacaaggccggcgagaaggagcccgaccccaagacctggaaggccaacttcagatgcgccatgaacagcctgcccgacatcgaggaggtgaaggaccagagcagaaacaagggcagcagcgccgtgagagtgtacagaatgctgccccccctgaccaagaaccagagaaaggagagaaagagcaagagcagcagagacgccaagagcaaggccaagagaaagagctgcggcgacagcagccccgacaccttcagcgacggcctgagcagcagcaccctgcccgacgaccacagcagctacaccgtgcccggctacatgcaggacctggaggtggagcaggccctgacccccgccctgagcccctgcgccgtgagcagcaccctgtag

SEQ ID NO: 11143 - DNA, 1356 bp, Artificial Sequence
  Description of Artificial Sequence: Synthetic coding sequence
atgaacctggagggcggcggcagaggcggcgagttcggcatgagcgccgtgagctgcggcaacggcaagctgagacagtggctgatcgaccagatcgacagcggcaagtaccccggcctggtgtgggagaacgaggagaagagcatcttcagaatcccctggaagcacgccggcaagcaggactacaacagagaggaggacgccgccctgttcaaggcctgggccctgttcaagggcaagttcagagagggcatcgacaagcccgacccccccacctggaagaccagactgagatgcgccctgaacaagagcaacgacttcgaggagctggtggagagaagccagctggacatcagcgacccctacaaggtgtacagaatcgtgcccgagggcgccaagaagggcgccaagcagctgaccctggaggacccccagatgagcatgagccacccctacaccatgaccaccccctaccccagcctgcccgcccagcaggtgcacaactacatgatgccccccctggacagaagctggagagactacgtgcccgaccagccccaccccgagatcccctaccagtgccccatgaccttcggccccagaggccaccactggcagggccccgcctgcgagaacggctgccaggtgaccggcaccttctacgcctgcgccccccccgagagccaggcccccggcgtgcccaccgagcccagcatcagaagcgccgaggccctggccttcagcgactgcagactgcacatctgcctgtactacagagagatcctggtgaaggagctgaccaccagcagccccgagggctgcagaatcagccacggccacacctacgacgccagcaacctggaccaggtgctgttcccctaccccgaggacaacggccagagaaagaacatcgagaagctgctgagccacctggagagaggcgtggtgctgtggatggcccccgacggcctgtacgccaagagactgtgccagagcagaatctactgggacggccccctggccctgtgcaacgacagacccaacaagctggagagagaccagacctgcaagctgttcgacacccagcagttcctgagcgagctgcaggccttcgcccaccacggcagaagcctgcccagattccaggtgaccctgtgcttcggcgaggagttccccgacccccagagacagagaaagctgatcaccgcccacgtggagcccctgctggccagacagctgtactacttcgcccagcagaacagcggccacttcctgagaggctacgacctgcccgagcacatcagcaaccccgaggactaccacagaagcatcagacacagcagcatccaggagtag

SEQ ID NO: 11144 - DNA, 1443 bp, Artificial Sequence
  Description of Artificial Sequence: Synthetic coding sequence
ctgggccccaccgccgccctgagcagcgagagcagagccagagccgcccaggccggcggcggccccagagccagagccagaaccagaggcatgaacctggagggcggcggcagaggcggcgagttcggcatgagcgccgtgagctgcggcaacggcaagctgagacagtggctgatcgaccagatcgacagcggcaagtaccccggcctggtgtgggagaacgaggagaagagcatcttcagaatcccctggaagcacgccggcaagcaggactacaacagagaggaggacgccgccctgttcaaggcctgggccctgttcaagggcaagttcagagagggcatcgacaagcccgacccccccacctggaagaccagactgagatgcgccctgaacaagagcaacgacttcgaggagctggtggagagaagccagctggacatcagcgacccctacaaggtgtacagaatcgtgcccgagggcgccaagaagggcgccaagcagctgaccctggaggacccccagatgagcatgagccacccctacaccatgaccaccccctaccccagcctgcccgcccaggtgcacaactacatgatgccccccctggacagaagctggagagactacgtgcccgaccagccccaccccgagatcccctaccagtgccccatgaccttcggccccagaggccaccactggcagggccccgcctgcgagaacggctgccaggtgaccggcaccttctacgcctgcgccccccccgagagccaggcccccggcgtgcccaccgagcccagcatcagaagcgccgaggccctggccttcagcgactgcagactgcacatctgcctgtactacagagagatcctggtgaaggagctgaccaccagcagccccgagggctgcagaatcagccacggccacacctacgacgccagcaacctggaccaggtgctgttcccctaccccgaggacaacggccagagaaagaacatcgagaagctgctgagccacctggagagaggcgtggtgctgtggatggcccccgacggcctgtacgccaagagactgtgccagagcagaatctactgggacggccccctggccctgtgcaacgacagacccaacaagctggagagagaccagacctgcaagctgttcgacacccagcagttcctgagcgagctgcaggccttcgcccaccacggcagaagcctgcccagattccaggtgaccctgtgcttcggcgaggagttccccgacccccagagacagagaaagctgatcaccgcccacgtggagcccctgctggccagacagctgtactacttcgcccagcagaacagcggccacttcctgagaggctacgacctgcccgagcacatcagcaaccccgaggactaccacagaagcatcagacacagcagcatccaggagtag

SEQ ID NO: 11145 - DNA, 1497 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggagctgcagagaatgctgcccagcctgagcctgaccgaggacgtgaagtggccccccaccctgcagccccccaccctgagaccccccaccctgcagccccccaccctgcagccccccgtggtgctgggcccccccgcccccgaccccagccccctggcccccccccccggcaaccccgccggcttcagagagctgctgagcgaggtgctggagcccggccccctgcccgccagcctgccccccgccggcgagcagctgctgcccgacctgctgatcagcccccacatgctgcccctgaccgacctggagatcaagttccagtacagaggcagaccccccagagccctgaccatcagcaacccccacggctgcagactgttctacagccagctggaggccacccaggagcaggtggagctgttcggccccatcagcctggagcaggtgagattccccagccccgaggacatccccagcgacaagcagagattctacaccaaccagctgctggacgtgctggacagaggcctgatcctgcagctgcagggccaggacctgtacgccatcagactgtgccagtgcaaggtgttctggagcggcccctgcgccagcgcccacgacagctgccccaaccccatccagagagaggtgaagaccaagctgttcagcctggagcacttcctgaacgagctgatcctgttccagaagggccagaccaacacccccccccccttcgagatcttcttctgcttcggcgaggagtggcccgacagaaagcccagagagaagaagctgatcaccgtgcaggtggtgcccgtggccgccagactgctgctggagatgttcagcggcgagctgagctggagcgccgacagcatcagactgcagatcagcaaccccgacctgaaggacagaatggtggagcagttcaaggagctgcaccacatctggcagagccagcagagactgcagcccgtggcccaggccccccccggcgccggcctgggcgtgggccagggcccctggcccatgcaccccgccggcatgcagtag

SEQ ID NO: 11146 - DNA, 1545 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggagctgcagagaatgctgcccagcctgagcctgaccgacgccgtgcagagcggcccccacatgaccccctacagcctgctgaaggaggacgtgaagtggccccccaccctgcagccccccaccctgagaccccccaccctgcagccccccaccctgcagccccccgtggtgctgggcccccccgcccccgaccccagccccctggcccccccccccggcaaccccgccggcttcagagagctgctgagcgaggtgctggagcccggccccctgcccgccagcctgccccccgccggcgagcagctgctgcccgacctgctgatcagcccccacatgctgcccctgaccgacctggagatcaagttccagtacagaggcagaccccccagagccctgaccatcagcaacccccacggctgcagactgttctacagccagctggaggccacccaggagcaggtggagctgttcggccccatcagcctggagcaggtgagattccccagccccgaggacatccccagcgacaagcagagattctacaccaaccagctgctggacgtgctggacagaggcctgatcctgcagctgcagggccaggacctgtacgccatcagactgtgccagtgcaaggtgttctggagcggcccctgcgccagcgcccacgacagctgccccaaccccatccagagagaggtgaagaccaagctgttcagcctggagcacttcctgaacgagctgatcctgttccagaagggccagaccaacacccccccccccttcgagatcttcttctgcttcggcgaggagtggcccgacagaaagcccagagagaagaagctgatcaccgtgcaggtggtgcccgtggccgccagactgctgctggagatgttcagcggcgagctgagctggagcgccgacagcatcagactgcagatcagcaaccccgacctgaaggacagaatggtggagcagttcaaggagctgcaccacatctggcagagccagcagagactgcagcccgtggcccaggccccccccggcgccggcctgggcgtgggccagggcccctggcccatgcaccccgccggcatgcagtag

SEQ ID NO: 11147 - DNA, 1497 bp, Artificial Sequence; identical to SEQ ID NO: 11145
  Description of Artificial Sequence: Synthetic coding sequence

SEQ ID NO: 11148 - DNA, 1467 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggagctgcagagaatgctgcccagcctgagcctgaccgaggacgtgaagtggccccccaccctgcagccccccaccctgcagccccccgtggtgctgggcccccccgcccccgaccccagccccctggcccccccccccggcaaccccgccggcttcagagagctgctgagcgaggtgctggagcccggccccctgcccgccagcctgccccccgccggcgagcagctgctgcccgacctgctgatcagcccccacatgctgcccctgaccgacctggagatcaagttccagtacagaggcagaccccccagagccctgaccatcagcaacccccacggctgcagactgttctacagccagctggaggccacccaggagcaggtggagctgttcggccccatcagcctggagcaggtgagattccccagccccgaggacatccccagcgacaagcagagattctacaccaaccagctgctggacgtgctggacagaggcctgatcctgcagctgcagggccaggacctgtacgccatcagactgtgccagtgcaaggtgttctggagcggcccctgcgccagcgcccacgacagctgccccaaccccatccagagagaggtgaagaccaagctgttcagcctggagcacttcctgaacgagctgatcctgttccagaagggccagaccaacacccccccccccttcgagatcttcttctgcttcggcgaggagtggcccgacagaaagcccagagagaagaagctgatcaccgtgcaggtggtgcccgtggccgccagactgctgctggagatgttcagcggcgagctgagctggagcgccgacagcatcagactgcagatcagcaaccccgacctgaaggacagaatggtggagcagttcaaggagctgcaccacatctggcagagccagcagagactgcagcccgtggcccaggccccccccggcgccggcctgggcgtgggccagggcccctggcccatgcaccccgccggcatgcagtag

SEQ ID NO: 11149 - DNA, 684 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggagagaatgagcagcggcagacccctgtgcagcagacccctgtgcggcagactgctgtgcagcagacccctgtgcagcagaccctggtgctgggtgcccctgctgcagacccccgccccctggctgctgcccctggccaccctgctggccagcggcagcttcagcctgagaagctggagcctgggcccctgcctgcccgcctgccccctgcaggccaacagcagctgccagacctgctag

SEQ ID NO: 11150 - DNA, 474 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggagatgcagtgcagcctggcccccacctag

SEQ ID NO: 11151 - DNA, 321 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggctag

SEQ ID NO: 11152 - DNA, 180 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggctag

SEQ ID NO: 11153 - DNA, 1497 bp, Artificial Sequence; identical to SEQ ID NO: 11145
  Description of Artificial Sequence: Synthetic coding sequence

SEQ ID NO: 11154 - DNA, 426 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggctag

SEQ ID NO: 11155 - DNA, 459 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggaggtgagcgtgtag

SEQ ID NO: 11156 - DNA, 1239 bp, Artificial Sequence
  Description of Artificial Sequence: Synthetic coding sequence
atgaaccagagcatccccgtggcccccaccccccccagaagagtgagactgaagccctggctggtggcccaggtgaacagctgccagtaccccggcctgcagtgggtgaacggcgagaagaagctgttctgcatcccctggagacacgccaccagacacggccccagccaggacggcgacaacaccatcttcaaggcctgggccaaggagaccggcaagtacaccgagggcgtggacgaggccgaccccgccaagtggaaggccaacctgagatgcgccctgaacaagagcagagacttcagactgatctacgacggccccagagacatgcccccccagccctacaagatctacgaggtgtgcagcaacggccccgcccccaccgacagccagccccccgaggactacagcttcggcgccggcgaggaggaggaggaggaggaggagctgcagagaatgctgcccagcctgagcctgaccgtgaccgacctggagatcaagttccagtacagaggcagaccccccagagccctgaccatcagcaacccccacggctgcagactgttctacagccagctggaggccacccaggagcaggtggagctgttcggccccatcagcctggagcaggtgagattccccagccccgaggacatccccagcgacaagcagagattctacaccaaccagctgctggacgtgctggacagaggcctgatcctgcagctgcagggccaggacctgtacgccatcagactgtgccagtgcaaggtgttctggagcggcccctgcgccagcgcccacgacagctgccccaaccccatccagagagaggtgaagaccaagctgttcagcctggagcacttcctgaacgagctgatcctgttccagaagggccagaccaacacccccccccccttcgagatcttcttctgcttcggcgaggagtggcccgacagaaagcccagagagaagaagctgatcaccgtgcaggtggtgcccgtggccgccagactgctgctggagatgttcagcggcgagctgagctggagcgccgacagcatcagactgcagatcagcaaccccgacctgaaggacagaatggtggagcagttcaaggagctgcaccacatctggcagagccagcagagactgcagcccgtggcccaggccccccccggcgccggcctgggcgtgggccagggcccctggcccatgcaccccgccggcatgcagtag

SEQ ID NO: 11157 - DNA, 570 bp, Artificial Sequence
  Description of Artificial Sequence: Synthetic coding sequence
atggccagccccttcgccctgctgatggtgctggtggtgctgagctgcaagagcagctgcagcctgggctgcgacctgcccgagacccacagcctggacaacagaagaaccctgatgctgctggcccagatgagcagaatcagccccagcagctgcctgatggacagacacgacttcggcttcccccaggaggagttcgacggcaaccagttccagaaggcccccgccatcagcgtgctgcacgagctgatccagcagatcttcaacctgttcaccaccaaggacagcagcgccgcctgggacgaggacctgctggacaagttctgcaccgagctgtaccagcagctgaacgacctggaggcctgcgtgatgcaggaggagagagtgggcgagacccccctgatgaacgccgacagcatcctggccgtgaagaagtacttcagaagaatcaccctgtacctgaccgagaagaagtacagcccctgcgcctgggaggtggtgagagccgagatcatgagaagcctgagcctgagcaccaacctgcaggagagactgagaagaaaggagtag

SEQ ID NO: 11158 - DNA, 516 bp, Artificial Sequence
  Description of Artificial Sequence: Synthetic coding sequence
atgctggtgaacttcatcctgagatgcggcctgctgctggtgaccctgagcctggccatcgccaagcacaagcagagcagcttcaccaagagctgctaccccagaggcaccctgagccaggccgtggacgccctgtacatcaaggccgcctggctgaaggccaccatccccgaggacagaatcaagaacatcagactgctgaagaagaagaccaagaagcagttcatgaagaactgccagttccaggagcagctgctgagcttcttcatggaggacgtgttcggccagctgcagctgcagggctgcaagaagatcagattcgtggaggacttccacagcctgagacagaagctgagccactgcatcagctgcgccagcagcgccagagagatgaagagcatcaccagaatgaagagaatcttctacagaatcggcaacaagggcatctacaaggccatcagcgagctggacatcctgctgagctggatcaagaagctgctggagagcagccagtag

SEQ ID NO: 11159 - DNA, 543 bp, Artificial Sequence
  Description of Artificial Sequence: Synthetic coding sequence
atggccctggccgacctgtacgaggagggcggcggcggcggcggcgagggcgaggacaacgccgacagcaaggagaccatctgcagacccagcggcagaaagagcagcaagatgcaggccttcagaatctgggacgtgaaccagaagaccttctacctgagaaacaaccagctggtggccggctacctgcagggccccaacgtgaacctggaggagaagatcgacgtggtgcccatcgagccccacgccctgttcctgggcatccacggcggcaagatgtgcctgagctgcgtgaagagcggcgacgagaccagactgcagctggaggccgtgaacatcaccgacctgagcgagaacagaaagcaggacaagagattcgccttcatcagaagcgacagcggccccaccaccagcttcgagagcgccgcctgccccggctggttcctgtgcaccgccatggaggccgaccagcccgtgagcctgaccaacatgcccgacgagggcgtgatggtgaccaagttctacttccaggaggacgagtag

SEQ ID NO: 11160 - DNA, 480 bp, Artificial Sequence
  Description of Artificial Sequence: Synthetic coding sequence
atggccctggagaccatctgcagacccagcggcagaaagagcagcaagatgcaggccttcagaatctgggacgtgaaccagaagaccttctacctgagaaacaaccagctggtggccggctacctgcagggccccaacgtgaacctggaggagaagatcgacgtggtgcccatcgagccccacgccctgttcctgggcatccacggcggcaagatgtgcctgagctgcgtgaagagcggcgacgagaccagactgcagctggaggccgtgaacatcaccgacctgagcgagaacagaaagcaggacaagagattcgccttcatcagaagcgacagcggccccaccaccagcttcgagagcgccgcctgccccggctggttcctgtgcaccgccatggaggccgaccagcccgtgagcctgaccaacatgcccgacgagggcgtgatggtgaccaagttctacttccaggaggacgagtag

SEQ ID NO: 11161 - DNA, 534 bp, Artificial Sequence
  Description of Artificial Sequence: Synthetic coding sequence
atggagatctgcagaggcctgagaagccacctgatcaccctgctgctgttcctgttccacagcgagaccatctgcagacccagcggcagaaagagcagcaagatgcaggccttcagaatctgggacgtgaaccagaagaccttctacctgagaaacaaccagctggtggccggctacctgcagggccccaacgtgaacctggaggagaagatcgacgtggtgcccatcgagccccacgccctgttcctgggcatccacggcggcaagatgtgcctgagctgcgtgaagagcggcgacgagaccagactgcagctggaggccgtgaacatcaccgacctgagcgagaacagaaagcaggacaagagattcgccttcatcagaagcgacagcggccccaccaccagcttcgagagcgccgcctgccccggctggttcctgtgcaccgccatggaggccgaccagcccgtgagcctgaccaacatgcccgacgagggcgtgatggtgaccaagttctacttccaggaggacgagtag

SEQ ID NO: 11162 - DNA, 432 bp, Artificial Sequence
  Description of Artificial Sequence: Synthetic coding sequence
atgcaggccttcagaatctgggacgtgaaccagaagaccttctacctgagaaacaaccagctggtggccggctacctgcagggccccaacgtgaacctggaggagaagatcgacgtggtgcccatcgagccccacgccctgttcctgggcatccacggcggcaagatgtgcctgagctgcgtgaagagcggcgacgagaccagactgcagctggaggccgtgaacatcaccgacctgagcgagaacagaaagcaggacaagagattcgccttcatcagaagcgacagcggccccaccaccagcttcgagagcgccgcctgccccggctggttcctgtgcaccgccatggaggccgaccagcccgtgagcctgaccaacatgcccgacgagggcgtgatggtgaccaagttctacttccaggaggacgagtag

SEQ ID NO: 11163 - DNA, 1470 bp, Artificial Sequence
  Description of Artificial Sequence: Synthetic coding sequence
atggagcccggcctggagcacgccctgagaagaacccccagctggagcagcctgggcggcagcgagcaccaggagatgagcttcctggagcaggagaacagcagcagctggcccagccccgccgtgaccagcagcagcgagagaatcagaggcaagagaagagccaaggccctgagatggaccagacagaagagcgtggaggagggcgagccccccggccagggcgagggccccagaagcagacccgccgccgagagcaccggcctggaggccaccttccccaagaccacccccctggcccaggccgaccccgccggcgtgggcaccccccccaccggctgggactgcctgcccagcgactgcaccgccagcgccgccggcagcagcaccgacgacgtggagctggccaccgagttccccgccaccgaggcctgggagtgcgagctggagggcctgctggaggagagacccgccctgtgcctgagcccccaggcccccttccccaagctgggctgggacgacgagctgagaaagcccggcgcccagatctacatgagattcatgcaggagcacacctgctacgacgccatggccaccagcagcaagctggtgatcttcgacaccatgctggagatcaagaaggccttcttcgccctggtggccaacggcgtgagagccgcccccctgtgggacagcaagaagcagagcttcgtgggcatgctgaccatcaccgacttcatcctggtgctgcacagatactacagaagccccctggtgcagatctacgagatcgagcagcacaagatcgagacctggagagagatctacctgcagggctgcttcaagcccctggtgagcatcagccccaacgacagcctgttcgaggccgtgtacaccctgatcaagaacagaatccacagactgcccgtgctggaccccgtgagcggcaacgtgctgcacatcctgacccacaagagactgctgaagttcctgcacatcttcggcagcctgctgcccagacccagcttcctgtacagaaccatccaggacctgggcatcggcaccttcagagacctggccgtggtgctggagaccgcccccatcctgaccgccctggacatcttcgtggacagaagagtgagcgccctgcccgtggtgaacgagtgcggccaggtggtgggcctgtacagcagattcgacgtgatccacctggccgcccagcagacctacaaccacctggacatgagcgtgggcgaggccctgagacagagaaccctgtgcctggagggcgtgctgagctgccagccccacgagagcctgggcgaggtgatcgacagaatcgccagagagcaggtgcacagactggtgctggtggacgagacccagcacctgctgggcgtggtgagcctgagcgacatcctgcaggccctggtgctgagccccgccggcatcgacgccctgggcgcctag

SEQ ID NO: 11164 - DNA, 1710 bp, Artificial Sequence
  Description of Artificial Sequence: Synthetic coding sequence
atgaaggtgctgctgagactgatctgcttcatcgccctgctgatcagcagcctggaggccgacaagtgcaaggagagagaggagaagatcatcctggtgagcagcgccaacgagatcgacgtgagaccctgccccctgaaccccaacgagcacaagggcaccatcacctggtacaaggacgacagcaagacccccgtgagcaccgagcaggccagcagaatccaccagcacaaggagaagctgtggttcgtgcccgccaaggtggaggacagcggccactactactgcgtggtgagaaacagcagctactgcctgagaatcaagatcagcgccaagttcgtggagaacgagcccaacctgtgctacaacgcccaggccatcttcaagcagaagctgcccgtggccggcgacggcggcctggtgtgcccctacatggagttcttcaagaacgagaacaacgagctgcccaagctgcagtggtacaaggactgcaagcccctgctgctggacaacatccacttcagcggcgtgaaggacagactgatcgtgatgaacgtggccgagaagcacagaggcaactacacctgccacgccagctacacctacctgggcaagcagtaccccatcaccagagtgatcgagttcatcaccctggaggagaacaagcccaccagacccgtgatcgtgagccccgccaacgagaccatggaggtggacctgggcagccagatccagctgatctgcaacgtgaccggccagctgagcgacatcgcctactggaagtggaacggcagcgtgatcgacgaggacgaccccgtgctgggcgaggactactacagcgtggagaaccccgccaacaagagaagaagcaccctgatcaccgtgctgaacatcagcgagatcgagagcagattctacaagcaccccttcacctgcttcgccaagaacacccacggcatcgacgccgcctacatccagctgatctaccccgtgaccaacttccagaagcacatgatcggcatctgcgtgaccctgaccgtgatcatcgtgtgcagcgtgttcatctacaagatcttcaagatcgacatcgtgctgtggtacagagacagctgctacgacttcctgcccatcaaggccagcgacggcaagacctacgacgcctacatcctgtaccccaagaccgtgggcgagggcagcaccagcgactgcgacatcttcgtgttcaaggtgctgcccgaggtgctggagaagcagtgcggctacaagctgttcatctacggcagagacgactacgtgggcgaggacatcgtggaggtgatcaacgagaacgtgaagaagagcagaagactgatcatcatcctggtgagagagaccagcggcttcagctggctgggcggcagcagcgaggagcagatcgccatgtacaacgccctggtgcaggacggcatcaaggtggtgctgctggagctggagaagatccaggactacgagaagatgcccgagagcatcaagttcatcaagcagaagcacggcgccatcagatggagcggcgacttcacccagggcccccagagcgccaagaccagattctggaagaacgtgagataccacatgcccgtgcagagaagaagccccagcagcaagcaccagctgctgagccccgccaccaaggagaagctgcagagagaggcccacgtgcccctgggctag

SEQ ID NO: 11165 - DNA, 549 bp, Artificial Sequence
  Description of Artificial Sequence: Synthetic coding sequence
atgaaggtgctgctgagactgatctgcttcatcgccctgctgatcagcagcctggaggccgacaagtgcaaggagagagaggagaagatcatcctggtgagcagcgccaacgagatcgacgtgagaccctgccccctgaaccccaacgagcacaagggcaccatcacctggtacaaggacgacagcaagacccccgtgagcaccgagcaggccagcagaatccaccagcacaaggagaagctgtggttcgtgcccgccaaggtggaggacagcggccactactactgcgtggtgagaaacagcagctactgcctgagaatcaagatcagcgccaagttcgtggagaacgagcccaacctgtgctacaacgcccaggccatcttcaagcagaagctgcccgtggccggcgacggcggcctggtgtgcccctacatggagttcttcaagaacgagaacaacgagctgcccaagctgcagtggtacaaggactgcaagcccctgctgctggacaacatccacttcagcggcgtgaaggacagactgatctag

SEQ ID NO: 11166 - DNA, 345 bp, Artificial Sequence
  Description of Artificial Sequence: Synthetic coding sequence
atgaaggtgctgctgagactgatctgcttcatcgccctgctgatcagcagcctggaggccgacaagtgcaaggagagagaggagaagatcatcctggtgagcagcgccaacgagatcgacgtgagaccctgccccctgaaccccaacgagcacaagggcaccatcacctggtacaaggacgacagcaagacccccgtgagcaccgagcaggccagcagaatccaccagcacaaggagaagctgtggttcgtgcccgccaaggtggaggacagcggccactactactgcgtggtgagaaacagcagctactgcctgagaatcaagatcagcgccaagttcgtgtag

SEQ ID NO: 11167 - DNA, 321 bp, Artificial Sequence
  Description of Artificial Sequence: Synthetic coding sequence
atgaaggtgctgctgagactgatctgcttcatcgccctgctgatcagcagcctggaggccgacaagtgcaaggagagagaggagaagatcatcctggtgagcagcgccaacgagatcgacgtgagaccctgccccctgaaccccaacgagcacaagggcaccatcacctggtacaaggacgacagcaagacccccgtgagcaccgagcaggccagcagaatccaccagcacaaggagaagctgtggttcgtgcccgccaaggtggaggacagcggccactactactgcgtggtgagaaacagcagctactgcctgagatag

SEQ ID NO: 11168 - DNA, 243 bp, Artificial Sequence
  Description of Artificial Sequence: Synthetic coding sequence
atgaaggtgctgctgagactgatctgcttcatcgccctgctgatcagcagcctggaggccgacaagtgcaaggagagagaggagaagatcatcctggtgagcagcgccaacgagatcgacgtgagaccctgccccctgaaccccaacgagcacaagggcaccatcacctggtacaaggacgacagcaagacccccgtgagcaccgagcaggccagcagaatccaccagcacaaggagaagtag

SEQ ID NO: 11169 - DNA, 810 bp, Artificial Sequence
  Description of Artificial Sequence: Synthetic coding sequence
atggccgaggtgcccgagctggccagcgagatgatggcctactacagcggcaacgaggacgacctgttcttcgaggccgacggccccaagcagatgaagtgcagcttccaggacctggacctgtgccccctggacggcggcatccagctgagaatcagcgaccaccactacagcaagggcttcagacaggccgccagcgtggtggtggccatggacaagctgagaaagatgctggtgccctgcccccagaccttccaggagaacgacctgagcaccttcttccccttcatcttcgaggaggagcccatcttcttcgacacctgggacaacgaggcctacgtgcacgacgcccccgtgagaagcctgaactgcaccctgagagacagccagcagaagagcctggtgatgagcggcccctacgagctgaaggccctgcacctgcagggccaggacatggagcagcaggtggtgttcagcatgagcttcgtgcagggcgaggagagcaacgacaagatccccgtggccctgggcctgaaggagaagaacctgtacctgagctgcgtgctgaaggacgacaagcccaccctgcagctggagagcgtggaccccaagaactaccccaagaagaagatggagaagagattcgtgttcaacaagatcgagatcaacaacaagctggagttcgagagcgcccagttccccaactggtacatcagcaccagccaggccgagaacatgcccgtgttcctgggcggcaccaagggcggccaggacatcaccgacttcaccatgcagttcgtgagcagctag

SEQ ID NO: 11170 - DNA, 336 bp, Artificial Sequence
  Description of Artificial Sequence: Synthetic coding sequence
atggccgaggtgcccgagctggccagcgagatgatggcctactacagcggcaacgaggacgacctgttcttcgaggccgacggccccaagcagatgaagtgcagcttccaggacctggacctgtgccccctggacggcggcatccagctgagaatcagcgaccaccactacagcaagggcttcagacaggccgccagcgtggtggtggccatggacaagctgagaaagatgctggtgccctgcccccagaccttccaggagaacgacctgagcaccttcttccccttcatcttcgaggaggagcccatcttcttcgacacctgggacaacgagtag

SEQ ID NO: 11171 - DNA, 432 bp, Artificial Sequence
  Description of Artificial Sequence: Synthetic coding sequence
atggccgaggtgcccgagctggccagcgagatgatggcctactacagcggcaacgaggacgacctgttcttcgaggccgacggccccaagcagatgaagtgcagcttccaggacctggacctgtgccccctggacggcggcatccagctgagaatcagcgaccaccactacagcaagggcttcagacaggccgccagcgtggtggtggccatggacaagctgagaaagatgctggtgccctgcccccagaccttccaggagaacgacctgagcaccttcttccccttcatcttcgaggaggagcccatcttcttcgacacctgggacaacgaggcctacgtgcacgacgcccccgtgagaagcctgaactgcaccctgagagacagccagcagaagagcctggtgatgagcggcccctacgagctgaagtag

SEQ ID NO: 11172 - DNA, 378 bp, Artificial Sequence
  Description of Artificial Sequence: Synthetic coding sequence
atggccgaggtgcccgagctggccagcgagatgatggcctactacagcggcaacgaggacgacctgttcttcgaggccgacggccccaagcagatgaagtgcagcttccaggacctggacctgtgccccctggacggcggcatccagctgagaatcagcgaccaccactacagcaagggcttcagacaggccgccagcgtggtggtggccatggacaagctgagaaagatgctggtgccctgcccccagaccttccaggagaacgacctgagcaccttcttccccttcatcttcgaggaggagcccatcttcttcgacacctgggacaacgaggcctacgtgcacgacgcccccgtgagaagcctgaactgcacctag

SEQ ID NO: 11173 - DNA, 762 bp, Artificial Sequence
  Description of Artificial Sequence: Synthetic coding sequence
atgtggccccccggcagcgccagccagcccccccccagccccgccgccgccaccggcctgcaccccgccgccagacccgtgagcctgcagtgcagactgagcatgtgccccgccagaagcctgctgctggtggccaccctggtgctgctggaccacctgagcctggccagaaacctgcccgtggccacccccgaccccggcatgttcccctgcctgcaccacagccagaacctgctgagagccgtgagcaacatgctgcagaaggccagacagaccctggagttctacccctgcaccagcgaggagatcgaccacgaggacatcaccaaggacaagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctag

SEQ ID NO: 11174 - DNA, 720 bp, Artificial Sequence
  Description of Artificial Sequence: Synthetic coding sequence
atgtggccccccggcagcgccagccagcccccccccagccccgccgccgccaccggcctgcaccccgccgccagacccgtgagcctgcagtgcagactgagcatgtgccccgccagaagcctgctgctggtggccaccctggtgctgctggaccacctgagcctggccagaaacctgcccgtggccacccccgaccccggcatgttcccctgcctgcaccacagccagaacctgctgagagccgtgagcaacatgctgcagaaggccagacagaccctggagttctacccctgcaccagcgaggagatcgaccacgaggacatcaccaaggacaagaccagcaccgtggaggcctgcctgcccctggagctgaccaagaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctag

SEQ ID NO: 11175 - DNA, 648 bp, Artificial Sequence
  Description of Artificial Sequence: Synthetic coding sequence
atgtggccccccggcagcgccagccagcccccccccagccccgccgccgccaccggcctgcaccccgccgccagacccgtgagcctgcagtgcagactgagcatgtgccccgccagaagcctgctgctggtggccaccctggtgctgctggaccacctgagcctggccagaaacctgcccgtggccacccccgaccccggcatgttcccctgcctgcaccacagccagaacctgctgagagccgtgagcaacatgctgcagaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctag

SEQ ID NO: 11176 - DNA, 489 bp, Artificial Sequence
  Description of Artificial Sequence: Synthetic coding sequence
atgagaatcagcaagccccacctgagaagcatcagcatccagtgctacctgtgcctgctgctgaacagccacttcctgaccgaggccggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctag

SEQ ID NO: 11177 - DNA, 489 bp, Artificial Sequence; identical to SEQ ID NO: 11176
  Description of Artificial Sequence: Synthetic coding sequence

SEQ ID NO: 11178 - DNA, 408 bp, Artificial Sequence
  Description of Artificial Sequence: Synthetic coding sequence
atggtgctgggcaccatcgacctgtgcagctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctag

SEQ ID NO: 11179 - DNA, 408 bp, Artificial Sequence; identical to SEQ ID NO: 11178
  Description of Artificial Sequence: Synthetic coding sequence

SEQ ID NO: 11180 - DNA, 408 bp, Artificial Sequence; identical to SEQ ID NO: 11178
  Description of Artificial Sequence: Synthetic coding sequence

SEQ ID NO: 11181 - DNA, 489 bp, Artificial Sequence; identical to SEQ ID NO: 11176
  Description of Artificial Sequence: Synthetic coding sequence

SEQ ID NO: 11182 - DNA, 582 bp, Artificial Sequence
  Description of Artificial Sequence: Synthetic coding sequence
atggccgccgagcccgtggaggacaactgcatcaacttcgtggccatgaagttcatcgacaacaccctgtacttcatcgccgaggacgacgagaacctggagagcgactacttcggcaagctggagagcaagctgagcgtgatcagaaacctgaacgaccaggtgctgttcatcgaccagggcaacagacccctgttcgaggacatgaccgacagcgactgcagagacaacgcccccagaaccatcttcatcatcagcatgtacaaggacagccagcccagaggcatggccgtgaccatcagcgtgaagtgcgagaagatcagcaccctgagctgcgagaacaagatcatcagcttcaaggagatgaacccccccgacaacatcaaggacaccaagagcgacatcatcttcttccagagaagcgtgcccggccacgacaacaagatgcagttcgagagcagcagctacgagggctacttcctggcctgcgagaaggagagagacctgttcaagctgatcctgaagaaggaggacgagctgggcgacagaagcatcatgttcaccgtgcagaacgaggactag

SEQ ID NO: 11183 - DNA, 570 bp, Artificial Sequence
  Description of Artificial Sequence: Synthetic coding sequence
atggccgccgagcccgtggaggacaactgcatcaacttcgtggccatgaagttcatcgacaacaccctgtacttcatcgagaacctggagagcgactacttcggcaagctggagagcaagctgagcgtgatcagaaacctgaacgaccaggtgctgttcatcgaccagggcaacagacccctgttcgaggacatgaccgacagcgactgcagagacaacgcccccagaaccatcttcatcatcagcatgtacaaggacagccagcccagaggcatggccgtgaccatcagcgtgaagtgcgagaagatcagcaccctgagctgcgagaacaagatcatcagcttcaaggagatgaacccccccgacaacatcaaggacaccaagagcgacatcatcttcttccagagaagcgtgcccggccacgacaacaagatgcagttcgagagcagcagctacgagggctacttcctggcctgcgagaaggagagagacctgttcaagctgatcctgaagaaggaggacgagctgggcgacagaagcatcatgttcaccgtgcagaacgaggactag

SEQ ID NO: 11184 - DNA, 582 bp, Artificial Sequence; identical to SEQ ID NO: 11182
  Description of Artificial Sequence: Synthetic coding sequence

SEQ ID NO: 11185 - DNA, 1782 bp, Artificial Sequence
  Description of Artificial Sequence: Synthetic coding sequence
atggagaccccccccctgccccccgcctgcaccaagcagggccaccagaagcccctggacagcaaggacgacaacaccgagaagcactgccccgtgaccgtgaacccctggcacatgaagaaggccttcaaggtgatgaacgagctgagaagccagaacctgctgtgcgacgtgaccatcgtggccgaggacatggagatcagcgcccacagagtggtgctggccgcctgcagcccctacttccacgccatgttcaccggcgagatgagcgagagcagagccaagagagtgagaatcaaggaggtggacggctggaccctgagaatgctgatcgactacgtgtacaccgccgagatccaggtgaccgaggagaacgtgcaggtgctgctgcccgccgccggcctgctgcagctgcaggacgtgaagaagacctgctgcgagttcctggagagccagctgcaccccgtgaactgcctgggcatcagagccttcgccgacatgcacgcctgcaccgacctgctgaacaaggccaacacctacgccgagcagcacttcgccgacgtggtgctgagcgaggagttcctgaacctgggcatcgagcaggtgtgcagcctgatcagcagcgacaagctgaccatcagcagcgaggagaaggtgttcgaggccgtgatcgcctgggtgaaccacgacaaggacgtgagacaggagttcatggccagactgatggagcacgtgagactgcccctgctgcccagagagtacctggtgcagagagtggaggaggaggccctggtgaagaacagcagcgcctgcaaggactacctgatcgaggccatgaagtaccacctgctgcccaccgagcagagaatcctgatgaagagcgtgagaaccagactgagaacccccatgaacctgcccaagctgatggtggtggtgggcggccaggcccccaaggccatcagaagcgtggagtgctacgacttcaaggaggagagatggcaccaggtggccgagctgcccagcagaagatgcagagccggcatggtgtacatggccggcctggtgttcgccgtgggcggcttcaacggcagcctgagagtgagaaccgtggacagctacgaccccgtgaaggaccagtggaccagcgtggccaacatgagagacagaagaagcaccctgggcgccgccgtgctgaacggcctgctgtacgccgtgggcggcttcgacggcagcaccggcctgagcagcgtggaggcctacaacatcaagagcaacgagtggttccacgtggcccccatgaacaccagaagaagcagcgtgggcgtgggcgtggtgggcggcctgctgtacgccgtgggcggctacgacggcgccagcagacagtgcctgagcaccgtggagtgctacaacgccaccaccaacgagtggacctacatcgccgagatgagcaccagaagaagcggcgccggcgtgggcgtgctgaacaacctgctgtacgccgtgggcggccacgacggccccctggtgagaaagagcgtggaggtgtacgaccccaccaccaacgcctggagacaggtggccgacatgaacatgtgcagaagaaacgccggcgtgtgcgccgtgaacggcctgctgtacgtggtgggcggcgacgacggcagctgcaacctggccagcgtggagtactacaaccccaccaccgacaagtggaccgtggtgagcagctgcatgagcaccggcagaagctacgccggcgtgaccgtgatcgacaagcccctgtag

SEQ ID NO: 11186 - DNA, 1131 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggagaagggcaagagcgaggagctgctgagcgccctgggctgccaggacttcccccccaccagcgactacgaggacctgctggtggagtacctggaggtggacgacagcgaggaccagcacctgatgagcgtgcacagcaaggagcaccccagccagggcgaccccctgatgctgggcgccagccactacaagaacctgaagagctacagacccagaaagatcagcagccagggcagactggccgtgttcaccaaggccaccctgaccaccgtgcagtag

SEQ ID NO: 11187 - DNA, 414 bp, Artificial Sequence
  Description of Artificial Sequence: Synthetic coding sequence
atgggcctgaccagccagctgctgccccccctgttcttcctgctggcctgcgccggcaacttcgtgcacggccacaagtgcgacatcaccctgcaggagatcatcaagaccctgaacagcctgaccgagcagaagaacaccaccgagaaggagaccttctgcagagccgccaccgtgctgagacagttctacagccaccacgagaaggacaccagatgcctgggcgccaccgcccagcagttccacagacacaagcagctgatcagattcctgaagagactggacagaaacctgtggggcctggccggcctgaacagctgccccgtgaaggaggccaaccagagcaccctggagaacttcctggagagactgaagaccatcatgagagagaagtacagcaagtgcagcagctag

SEQ ID NO: 11188 - DNA, 639 bp, Artificial Sequence
  Description of Artificial Sequence: Synthetic coding sequence
atgaacagcttcagcaccagcgccttcggccccgtggccttcagcctgggcctgctgctggtgctgcccgccgccttccccgcccccgtgccccccggcgaggacagcaaggacgtggccgccccccacagacagcccctgaccagcagcgagagaatcgacaagcagatcagatacatcctggacggcatcagcgccctgagaaaggagacctgcaacaagagcaacatgtgcgagagcagcaaggaggccctggccgagaacaacctgaacctgcccaagatggccgagaaggacggctgcttccagagcggcttcaacgaggagacctgcctggtgaagatcatcaccggcctgctggagttcgaggtgtacctggagtacctgcagaacagattcgagagcagcgaggagcaggccagagccgtgcagatgagcaccaaggtgctgatccagttcctgcagaagaaggccaagaacctggacgccatcaccacccccgaccccaccaccaacgccagcctgctgaccaagctgcaggcccagaaccagtggctgcaggacatgaccacccacctgatcctgagaagcttcaaggagttcctgcagagcagcctgagagccctgagacagatgtag

SEQ ID NO: 11189 - DNA, 369 bp, Artificial Sequence
  Description of Artificial Sequence: Synthetic coding sequence
atgtgcgagagcagcaaggaggccctggccgagaacaacctgaacctgcccaagatggccgagaaggacggctgcttccagagcggcttcaacgaggagacctgcctggtgaagatcatcaccggcctgctggagttcgaggtgtacctggagtacctgcagaacagattcgagagcagcgaggagcaggccagagccgtgcagatgagcaccaaggtgctgatccagttcctgcagaagaaggtgggcgtgagcagcttcccccagctgggcgtgggcgaggacagactgaaggacagcgtgctggacaacagcggcatgcagtgccacttccagaagagaagactgcacgtgaacaagagagtgtag

SEQ ID NO: 11190 - DNA, 639 bp, Artificial Sequence; identical to SEQ ID NO: 11188
  Description of Artificial Sequence: Synthetic coding sequence

SEQ ID NO: 11191 - DNA, 597 bp, Artificial Sequence
  Description of Artificial Sequence: Synthetic coding sequence
atgaacagcttcagcaccagcgccttcggccccgtggccttcagcctgggcctgctgctggtgctgcccgccgccttccccgcccccgtgccccccggcgaggacagcaaggacgtggccgccccccacagacagcccctgaccagcagcgagagaatcgacaagcagatcagatacatcctggacggcatcagcgccctgagaaaggagacctgcaacaagagcaacatgtgcgagagcagcaaggaggccctggccgagaacaacctgaacctgcccaagatggccgagaaggacggctgcttccagagcggcttcaacgaggagacctgcctggtgaagatcatcaccggcctgctggagttcgaggtgtacctggagtacctgcagaacagattcgagagcagcgaggagcaggccagagccgtgcagatgagcaccaaggtgctgatccagttcctgcagaagaaggtgggcgtgagcagcttcccccagctgggcgtgggcgaggacagactgaaggacagcgtgctggacaacagcggcatgcagtgccacttccagaagagaagactgcacgtgaacaagagagtgtag

SEQ ID NO: 11192 - DNA, 759 bp, Artificial Sequence
  Description of Artificial Sequence: Synthetic coding sequence
atgaacagcttcagcaccagcaagtgcagaaagagcctggccctggagctgcccgccgccgtggagccctgcgtgagagagggctgcgtggcccagggcggcctggccggcggccagcagcagagacaggcccccagctgcgccgtgagcagccccctgagaagcctgcccagcggcaccggcgccttcggccccgtggccttcagcctgggcctgctgctggtgctgcccgccgccttccccgcccccgtgccccccggcgaggacagcaaggacgtggccgccccccacagacagcccctgaccagcagcgagagaatcgacaagcagatcagatacatcctggacggcatcagcgccctgagaaaggagacctgcaacaagagcaacatgtgcgagagcagcaaggaggccctggccgagaacaacctgaacctgcccaagatggccgagaaggacggctgcttccagagcggcttcaacgaggagacctgcctggtgaagatcatcaccggcctgctggagttcgaggtgtacctggagtacctgcagaacagattcgagagcagcgaggagcaggccagagccgtgcagatgagcaccaaggtgctgatccagttcctgcagaagaaggtgggcgtgagcagcttcccccagctgggcgtgggcgaggacagactgaaggacagcgtgctggacaacagcggcatgcagtgccacttccagaagagaagactgcacgtgaacaagagagtgtag

SEQ ID NO: 11193 - DNA, 459 bp, Artificial Sequence
  Description of Artificial Sequence: Synthetic coding sequence
atgaacagcttcagcaccagcgccttcggccccgtggccttcagcctgggcctgctgctggtgctgcccgccgccttccccgcccccgtgccccccggcgaggacagcaaggacgtggccgccccccacagacagcccctgaccagcagcgagagaatcgacaagcagatcagatacatcctggacggcatcagcgccctgagaaaggagacctgcaacaagagcaacatgtgcgagagcagcaaggaggccctggccgagaacaacctgaacctgcccaagatggccgagaaggacggctgcttccagagcggcttcaacgaggagacctgcctggtgaagatcatcaccggcctgctggagttcgaggtgtacctggagtacctgcagaacagattcgagagcagcgaggagcaggccagagccgtgcagatgagcaccaaggtgctgatccagtag

SEQ ID NO: 11194 - DNA, 300 bp, Artificial Sequence
  Description of Artificial Sequence: Synthetic coding sequence
atgaccagcaagctggccgtggccctgctggccgccttcctgatcagcgccgccctgtgcgagggcgccgtgctgcccagaagcgccaaggagctgagatgccagtgcatcaagacctacagcaagcccttccaccccaagttcatcaaggagctgagagtgatcgagagcggcccccactgcgccaacaccgagatcatcgtgaagctgagcgacggcagagagctgtgcctggaccccaaggagaactgggtgcagagagtggtggagaagttcctgaagagagccgagaacagctag

SEQ ID NO: 11195 - DNA, 2139 bp, Artificial Sequence
  Description of Artificial Sequence: Synthetic coding sequence
atggccggcggccccggccccggcgagcccgccgcccccggcgcccagcacttcctgtacgaggtgcccccctgggtgatgtgcagattctacaaggtgatggacgccctggagcccgccgactggtgccagttcgccgccctgatcgtgagagaccagaccgagctgagactgtgcgagagaagcggccagagaaccgccagcgtgctgtggccctggatcaacagaaacgccagagtggccgacctggtgcacatcctgacccacctgcagctgctgagagccagagacatcatcaccgcctggcacccccccgcccccctgcccagccccggcaccaccgcccccagacccagcagcatccccgcccccgccgaggccgaggcctggagccccagaaagctgcccagcagcgccagcaccttcctgagccccgccttccccggcagccagacccacagcggccccgagctgggcctggtgcccagccccgccagcctgtggccccccccccccagccccgcccccagcagcaccaagcccggccccgagagcagcgtgagcctgctgcagggcgccagacccttccccttctgctggcccctgtgcgagatcagcagaggcacccacaacttcagcgaggagctgaagatcggcgagggcggcttcggctgcgtgtacagagccgtgatgagaaacaccgtgtacgccgtgaagagactgaaggagaacgccgacctggagtggaccgccgtgaagcagagcttcctgaccgaggtggagcagctgagcagattcagacaccccaacatcgtggacttcgccggctactgcgcccagaacggcttctactgcctggtgtacggcttcctgcccaacggcagcctggaggacagactgcactgccagacccaggcctgcccccccctgagctggccccagagactggacatcctgctgggcaccgccagagccatccagttcctgcaccaggacagccccagcctgatccacggcgacatcaagagcagcaacgtgctgctggacgagagactgacccccaagctgggcgacttcggcctggccagattcagcagattcgccggcagcagccccagccagagcagcatggtggccagaacccagaccgtgagaggcaccctggcctacctgcccgaggagtacatcaagaccggcagactggccgtggacaccgacaccttcagcttcggcgtggtggtgctggagaccctggccggccagagagccgtgaagacccacggcgccagaaccaagtacctgaaggacctggtggaggaggaggccgaggaggccggcgtggccctgagaagcacccagagcaccctgcaggccggcctggccgccgacgcctgggccgcccccatcgccatgcagatctacaagaagcacctggaccccagacccggcccctgcccccccgagctgggcctgggcctgggccagctggcctgctgctgcctgcacagaagagccaagagaagaccccccatgacccaggtgtacgagagactggagaagctgcaggccgtggtggccggcgtgcccggccacagcgaggccgccagctgcatcccccccagcccccaggagaacagctacgtgagcagcaccggcagagcccacagcggcgccgccccctggcagcccctggccgcccccagcggcgccagcgcccaggccgccgagcagctgcagagaggccccaaccagcccgtggagagcgacgagagcctgggcggcctgagcgccgccctgagaagctggcacctgacccccagctgccccctggaccccgcccccctgagagaggccggctgcccccagggcgacaccgccggcgagagcagctggggcagcggccccggcagcagacccaccgccgtggagggcctggccctgggcagcagcgccagcagcagcagcgagcccccccagatcatcatcaaccccgccagacagaagatggtgcagaagctggccctgtacgaggacggcgccctggacagcctgcagctgctgagcagcagcagcctgcccggcctgggcctggagcaggacagacagggccccgaggagagcgacgagttccagagctag

SEQ ID NO: 11196 - DNA, 2082 bp, Artificial Sequence
  Description of Artificial Sequence: Synthetic coding sequence
atggccggcggccccggccccggcgagcccgccgcccccggcgcccagcacttcctgtacgaggtgcccccctgggtgatgtgcagattctacaaggtgatggacgccctggagcccgccgactggtgccagttcggcggctggagaagagccgccggcggcagagaggccagaggcctgctggcccccacccccgacgcccccagacccgccgccgccctgatcgtgagagaccagaccgagctgagactgtgcgagagaagcggccagagaaccgccagcgtgctgtggccctggatcaacagaaacgccagagtggccgacctggtgcacatcctgacccacctgcagctgctgagagccagagacatcatcaccgcctggcacccccccgcccccctgcccagccccggcaccaccgcccccagacccagcagcatccccgcccccgccgaggccgaggcctggagccccagaaagctgcccagcagcgccagcaccttcctgagccccgccttccccggcagccagacccacagcggccccgagctgggcctggtgcccagccccgccagcctgtggccccccccccccagccccgcccccagcagcaccaagcccggccccgagagcagcgtgagcctgctgcagggcgccagacccttccccttctgctggcccctgtgcgagatcagcagaggcacccacaacttcagcgaggagctgaagatcggcgagggcggcttcggctgcgtgtacagagccgtgatgagaaacaccgtgtacgccgtgaagagactgaaggagaacgccgacctggagtggaccgccgtgaagcagagcttcctgaccgaggtggagcagctgagcagattcagacaccccaacatcgtggacttcgccggctactgcgcccagaacggcttctactgcctggtgtacggcttcctgcccaacggcagcctggaggacagactgcactgccagacccaggcctgcccccccctgagctggccccagagactggacatcctgctgggcaccgccagagccatccagttcctgcaccaggacagccccagcctgatccacggcgacatcaagagcagcaacgtgctgctggacgagagactgacccccaagctgggcgacttcggcctggccagattcagcagattcgccggcagcagccccagccagagcagcatggtggccagaacccagaccgtgagaggcaccctggcctacctgcccgaggagtacatcaagaccggcagactggccgtggacaccgacaccttcagcttcggcgtggtggtgctggagaccctggccggccagagagccgtgaagacccacggcgccagaaccaagtacctgaaggacctggtggaggaggaggccgaggaggccggcgtggccctgagaagcacccagagcaccctgcaggccggcctggccgccgacgcctgggccgcccccatcgccatgcagatctacaagaagcacctgggccagctggcctgctgctgcctgcacagaagagccaagagaagaccccccatgacccaggagaacagctacgtgagcagcaccggcagagcccacagcggcgccgccccctggcagcccctggccgcccccagcggcgccagcgcccaggccgccgagcagctgcagagaggccccaaccagcccgtggagagcgacgagagcctgggcggcctgagcgccgccctgagaagctggcacctgacccccagctgccccctggaccccgcccccctgagagaggccggctgcccccagggcgacaccgccggcgagagcagctggggcagcggccccggcagcagacccaccgccgtggagggcctggccctgggcagcagcgccagcagcagcagcgagcccccccagatcatcatcaaccccgccagacagaagatggtgcagaagctggccctgtacgaggacggcgccctggacagcctgcagctgctgagcagcagcagcctgcccggcctgggcctggagcaggacagacagggccccgaggagagcgacgagttccagagctag

SEQ ID NO: 11197 - DNA, 2049 bp, Artificial Sequence
  Description of Artificial Sequence: Synthetic coding sequence
atggccggcggccccggccccggcgagcccgccgcccccggcgcccagcacttcctgtacgaggtgcccccctgggtgatgtgcagattctacaaggtgatggacgccctggagcccgccgactggtgccagttcgccgccctgatcgtgagagaccagaccgagctgagactgtgcgagagaagcggccagagaaccgccagcgtgctgtggccctggatcaacagaaacgccagagtggccgacctggtgcacatcctgacccacctgcagctgctgagagccagagacatcatcaccgcctggcacccccccgcccccctgcccagccccggcaccaccgcccccagacccagcagcatccccgcccccgccgaggccgaggcctggagccccagaaagctgcccagcagcgccagcaccttcctgagccccgccttccccggcagccagacccacagcggccccgagctgggcctggtgcccagccccgccagcctgtggccccccccccccagccccgcccccagcagcaccaagcccggccccgagagcagcgtgagcctgctgcagggcgccagacccttccccttctgctggcccctgtgcgagatcagcagaggcacccacaacttcagcgaggagctgaagatcggcgagggcggcttcggctgcgtgtacagagccgtgatgagaaacaccgtgtacgccgtgaagagactgaaggagaacgccgacctggagtggaccgccgtgaagcagagcttcctgaccgaggtggagcagctgagcagattcagacaccccaacatcgtggacttcgccggctactgcgcccagaacggcttctactgcctggtgtacggcttcctgcccaacggcagcctggaggacagactgcactgccagacccaggcctgcccccccctgagctggccccagagactggacatcctgctgggcaccgccagagccatccagttcctgcaccaggacagccccagcctgatccacggcgacatcaagagcagcaacgtgctgctggacgagagactgacccccaagctgggcgacttcggcctggccagattcagcagattcgccggcagcagccccagccagagcagcatggtggccagaacccagaccgtgagaggcaccctggcctacctgcccgaggagtacatcaagaccggcagactggccgtggacaccgacaccttcagcttcggcgtggtggtgctggagaccctggccggccagagagccgtgaagacccacggcgccagaaccaagtacctgaaggacctggtggaggaggaggccgaggaggccggcgtggccctgagaagcacccagagcaccctgcaggccggcctggccgccgacgcctgggccgcccccatcgccatgcagatctacaagaagcacctggaccccagacccggcccctgcccccccgagctgggcctgggcctgggccagctggcctgctgctgcctgcacagaagagccaagagaagaccccccatgacccaggagaacagctacgtgagcagcaccggcagagcccacagcggcgccgccccctggcagcccctggccgcccccagcggcgccagcgcccaggccgccgagcagctgcagagaggccccaaccagcccgtggagagcgacgagagcctgggcggcctgagcgccgccctgagaagctggcacctgacccccagctgccccctggaccccgcccccctgagagaggccggctgcccccagggcgacaccgccggcgagagcagctggggcagcggccccggcagcagacccaccgccgtggagggcctggccctgggcagcagcgccagcagcagcagcgagcccccccagatcatcatcaaccccgccagacagaagatggtgcagaagctggccctgtacgaggacggcgccctggacagcctgcagctgctgagcagcagcagcctgcccggcctgggcctggagcaggacagacagggccccgaggagagcgacgagttccagagctag

SEQ ID NO: 11198 - DNA, 2127 bp, Artificial Sequence
  Description of Artificial Sequence: Synthetic coding sequence
atggccggcggccccggccccggcgagcccgccgcccccggcgcccagcacttcctgtacgaggtgcccccctgggtgatgtgcagattctacaaggtgatggacgccctggagcccgccgactggtgccagttcggcggctggagaagagccgccggcggcagagaggccagaggcctgctggcccccacccccgacgcccccagacccgccgccgccctgatcgtgagagaccagaccgagctgagactgtgcgagagaagcggccagagaaccgccagcgtgctgtggccctggatcaacagaaacgccagagtggccgacctggtgcacatcctgacccacctgcagctgctgagagccagagacatcatcaccgcctggcacccccccgcccccctgcccagccccggcaccaccgcccccagacccagcagcatccccgcccccgccgaggccgaggcctggagccccagaaagctgcccagcagcgccagcaccttcctgagccccgccttccccggcagccagacccacagcggccccgagctgggcctggtgcccagccccgccagcctgtggccccccccccccagccccgcccccagcagcaccaagcccggccccgagagcagcgtgagcctgctgcagggcgccagacccttccccttctgctggcccctgtgcgagatcagcagaggcacccacaacttcagcgaggagctgaagatcggcgagggcggcttcggctgcgtgtacagagccgtgatgagaaacaccgtgtacgccgtgaagagactgaaggagaacgccgacctggagtggaccgccgtgaagcagagcttcctgaccgaggtggagcagctgagcagattcagacaccccaacatcgtggacttcgccggctactgcgcccagaacggcttctactgcctggtgtacggcttcctgcccaacggcagcctggaggacagactgcactgccagacccaggcctgcccccccctgagctggccccagagactggacatcctgctgggcaccgccagagccatccagttcctgcaccaggacagccccagcctgatccacggcgacatcaagagcagcaacgtgctgctggacgagagactgacccccaagctgggcgacttcggcctggccagattcagcagattcgccggcagcagccccagccagagcagcatggtggccagaacccagaccgtgagaggcaccctggcctacctgcccgaggagtacatcaagaccggcagactggccgtggacaccgacaccttcagcttcggcgtggtggtgctggagaccctggccggccagagagccgtgaagacccacggcgccagaaccaagtacctgaaggacctggtggaggaggaggccgaggaggccggcgtggccctgagaagcacccagagcaccctgcaggccggcctggccgccgacgcctgggccgcccccatcgccatgcagatctacaagaagcacctggaccccagacccggcccctgcccccccgagctgggcctgggcctgggccagctggcctgctgctgcctgcacagaagagccaagagaagaccccccatgacccaggagaacagctacgtgagcagcaccggcagagcccacagcggcgccgccccctggcagcccctggccgcccccagcggcgccagcgcccaggccgccgagcagctgcagagaggccccaaccagcccgtggagagcgacgagagcctgggcggcctgagcgccgccctgagaagctggcacctgacccccagctgccccctggaccccgcccccctgagagaggccggctgcccccagggcgacaccgccggcgagagcagctggggcagcggccccggcagcagacccaccgccgtggagggcctggccctgggcagcagcgccagcagcagcagcgagcccccccagatcatcatcaaccccgccagacagaagatggtgcagaagctggccctgtacgaggacggcgccctggacagcctgcagctgctgagcagcagcagcctgcccggcctgggcctggagcaggacagacagggccccgaggagagcgacgagttccagagctag

SEQ ID NO: 11199 - DNA, 1902 bp, Artificial Sequence
  Description of Artificial Sequence: Synthetic coding sequence
atggccggcggccccggccccggcgagcccgccgcccccggcgcccagcacttcctgtacgaggtgcccccctgggtgatgtgcagattctacaaggtgatggacgccctggagcccgccgactggtgccagttcgccgccctgatcgtgagagaccagaccgagctgagactgtgcgagagaagcggccagagaaccgccagcgtgctgtggccctggatcaacagaaacgccagagtggccgacctggtgcacatcctgacccacctgcagctgctgagagccagagacatcatcaccgcctggcacccccccgcccccctgcccagccccggcaccaccgcccccagacccagcagcatccccgcccccgccgaggccgaggcctggagccccagaaagctgcccagcagcgccagcaccttcctgagccccgccttccccggcagccagacccacagcggccccgagctgggcctggtgcccagccccgccagcctgtggccccccccccccagccccgcccccagcagcaccaagcccggccccgagagcagcgtgagcctgctgcagggcgccagacccttccccttctgctggcccctgtgcgagatcagcagaggcacccacaacttcagcgaggagctgaagatcggcgagggcggcttcggctgcgtgtacagagccgtgatgagaaacaccgtgtacgccgtgaagagactgaaggagaacgccgacctggagtggaccgccgtgaagcagagcttcctgaccgaggtggagcagctgagcagattcagacaccccaacatcgtggacttcgccggctactgcgcccagaacggcttctactgcctggtgtacggcttcctgcccaacggcagcctggaggacagactgcactgccagacccaggcctgcccccccctgagctggccccagagactggacatcctgctgggcaccgccagagccatccagttcctgcaccaggacagccccagcctgatccacggcgacatcaagagcagcaacgtgctgctggacgagagactgacccccaagctgggcgacttcggcctggccagattcagcagattcgccggcagcagccccagccagagcagcatggtggccagaacccagaccgtgagaggcaccctggcctacctgcccgaggagtacatcaagaccggcagactggccgtggacaccgacaccttcagcttcggcgtggtggtgctggagaccctggccggccagagagccgtgaagacccacggcgccagaaccaagtacctggtgtacgagagactggagaagctgcaggccgtggtggccggcgtgcccggccacagcgaggccgccagctgcatcccccccagcccccaggagaacagctacgtgagcagcaccggcagagcccacagcggcgccgccccctggcagcccctggccgcccccagcggcgccagcgcccaggccgccgagcagctgcagagaggccccaaccagcccgtggagagcgacgagagcctgggcggcctgagcgccgccctgagaagctggcacctgacccccagctgccccctggaccccgcccccctgagagaggccggctgcccccagggcgacaccgccggcgagagcagctggggcagcggccccggcagcagacccaccgccgtggagggcctggccctgggcagcagcgccagcagcagcagcgagcccccccagatcatcatcaaccccgccagacagaagatggtgcagaagctggccctgtacgaggacggcgccctggacagcctgcagctgctgagcagcagcagcctgcccggcctgggcctggagcaggacagacagggccccgaggagagcgacgagttccagagctag

SEQ ID NO: 11200 - DNA, 1245 bp, Artificial Sequence
  Description of Artificial Sequence: Synthetic coding sequence
atgagcaagaagatcagcggcggcagcgtggtggagatgcagggcgacgagatgaccagaatcatctgggagctgatcaaggagaagctgatcttcccctacgtggagctggacctgcacagctacgacctgggcatcgagaacagagacgccaccaacgaccaggtgaccaaggacgccgccgaggccatcaagaagcacaacgtgggcgtgaagtgcgccaccatcacccccgacgagaagagagtggaggagttcaagctgaagcagatgtggaagagccccaacggcaccatcagaaacatcctgggcggcaccgtgttcagagaggccatcatctgcaagaacatccccagactggtgagcggctgggtgaagcccatcatcatcggcagacacgcctacggcgaccagtacagagccaccgacttcgtggtgcccggccccggcaaggtggagatcacctacacccccagcgacggcacccagaaggtgacctacctggtgcacaacttcgaggagggcggcggcgtggccatgggcatgtacaaccaggacaagagcatcgaggacttcgcccacagcagcttccagatggccctgagcaagggctggcccctgtacctgagcaccaagaacaccatcctgaagaagtacgacggcagattcaaggacatcttccaggagatctacgacaagcagtacaagagccagttcgaggcccagaagatctggtacgagcacagactgatcgacgacatggtggcccaggccatgaagagcgagggcggcttcatctgggcctgcaagaactacgacggcgacgtgcagagcgacagcgtggcccagggctacggcagcctgggcatgatgaccagcgtgctggtgtgccccgacggcaagaccgtggaggccgaggccgcccacggcaccgtgaccagacactacagaatgtaccagaagggccaggagaccagcaccaaccccatcgccagcatcttcgcctggaccagaggcctggcccacagagccaagctggacaacaacaaggagctggccttcttcgccaacgccctggaggaggtgagcatcgagaccatcgaggccggcttcatgaccaaggacctggccgcctgcatcaagggcctgcccaacgtgcagagaagcgactacctgaacaccttcgagttcatggacaagctgggcgagaacctgaagatcaagctggcccaggccaagctgtag

SEQ ID NO: 11201 - DNA, 474 bp, Artificial Sequence
  Description of Artificial Sequence: Synthetic coding sequence
atgagcaagaagatcagcggcggcagcgtggtggagatgcagggcgacgagatgaccagaatcatctgggagctgatcaaggagaagctgatcttcccctacgtggagctggacctgcacagctacgacctgggcatcgagaacagagacgccaccaacgaccaggtgaccaaggacgccgccgaggccatcaagaagcacaacgtgggcgtgaagtgcgccaccatcacccccgacgagaagagagtggaggagttcaagctgaagcagatgtggaagagccccaacggcaccatcagaaacatcctgggcggcaccgtgttcagagaggccatcatctgcaagaacatccccagactggtgagcggctgggtgaagcccatcatcatcggcagacacgcctacggcgaccagtacagagccaccgacttcgtggtgcccggccccggcaaggtggagatcacctacacctag

SEQ ID NO: 11202 - DNA, 1245 bp, Artificial Sequence; identical to SEQ ID NO: 11200
  Description of Artificial Sequence: Synthetic coding sequence

SEQ ID NO: 11203 - DNA, 225 bp, Artificial Sequence
  Description of Artificial Sequence: Synthetic coding sequence
atgagcaagaagatcagcggcggcagcgtggtggagatgcagggcgacgagatgaccagaatcatctgggagctgatcaaggagaagctgatcttcccctacgtggagctggacctgcacagctacgacctgggcatcgagaacagagacgccaccaacgaccaggtgaccaaggacgccgccgaggccatcaagaagcacaacgtgggcgtgaagtgcgcctag

SEQ ID NO: 11204 - DNA, 1245 bp, Artificial Sequence; identical to SEQ ID NO: 11200
  Description of Artificial Sequence: Synthetic coding sequence

SEQ ID NO: 11205 - DNA, 189 bp, Artificial Sequence
  Description of Artificial Sequence: Synthetic coding sequence
atgagcaagaagatcagcggcggcagcgtggtggagatgcagggcgacgagatgaccagaatcatctgggagctgatcaaggagaagctgatcttcccctacgtggagctggacctgcacagctacgacctgggcatcgagaacagagacgccaccaacgaccaggtgaccaaggacgccgccgagtag

SEQ ID NO: 11206 - DNA, 1359 bp, Artificial Sequence
  Description of Artificial Sequence: Synthetic coding sequence
atggccggctacctgagagtggtgagaagcctgtgcagagccagcggcagcagacccgcctgggcccccgccgccctgaccgcccccaccagccaggagcagcccagaagacactacgccgacaagagaatcaaggtggccaagcccgtggtggagatggacggcgacgagatgaccagaatcatctggcagttcatcaaggagaagctgatcctgccccacgtggacatccagctgaagtacttcgacctgggcctgcccaacagagaccagaccgacgaccaggtgaccatcgacagcgccctggccacccagaagtacagcgtggccgtgaagtgcgccaccatcacccccgacgaggccagagtggaggagttcaagctgaagaagatgtggaagagccccaacggcaccatcagaaacatcctgggcggcaccgtgttcagagagcccatcatctgcaagaacatccccagactggtgcccggctggaccaagcccatcaccatcggcagacacgcccacggcgaccagtacaaggccaccgacttcgtggccgacagagccggcaccttcaagatggtgttcacccccaaggacggcagcggcgtgaaggagtgggaggtgtacaacttccccgccggcggcgtgggcatgggcatgtacaacaccgacgagagcatcagcggcttcgcccacagctgcttccagtacgccatccagaagaagtggcccctgtacatgagcaccaagaacaccatcctgaaggcctacgacggcagattcaaggacatcttccaggagatcttcgacaagcactacaagaccgacttcgacaagaacaagatctggtacgagcacagactgatcgacgacatggtggcccaggtgctgaagagcagcggcggcttcgtgtgggcctgcaagaactacgacggcgacgtgcagagcgacatcctggcccagggcttcggcagcctgggcctgatgaccagcgtgctggtgtgccccgacggcaagaccatcgaggccgaggccgcccacggcaccgtgaccagacactacagagagcaccagaagggcagacccaccagcaccaaccccatcgccagcatcttcgcctggaccagaggcctggagcacagaggcaagctggacggcaaccaggacctgatcagattcgcccagatgctggagaaggtgtgcgtggagaccgtggagagcggcgccatgaccaaggacctggccggctgcatccacggcctgagcaacgtgaagctgaacgagcacttcctgaacaccaccgacttcctggacaccatcaagagcaacctggacagagccctgggcagacagtag

SEQ ID NO: 11207 - DNA, 969 bp, Artificial Sequence
  Description of Artificial Sequence: Synthetic coding sequence
atgtggaagagccccaacggcaccatcagaaacatcctgggcggcaccgtgttcagagagcccatcatctgcaagaacatccccagactggtgcccggctggaccaagcccatcaccatcggcagacacgcccacggcgaccagtacaaggccaccgacttcgtggccgacagagccggcaccttcaagatggtgttcacccccaaggacggcagcggcgtgaaggagtgggaggtgtacaacttccccgccggcggcgtgggcatgggcatgtacaacaccgacgagagcatcagcggcttcgcccacagctgcttccagtacgccatccagaagaagtggcccctgtacatgagcaccaagaacaccatcctgaaggcctacgacggcagattcaaggacatcttccaggagatcttcgacaagcactacaagaccgacttcgacaagaacaagatctggtacgagcacagactgatcgacgacatggtggcccaggtgctgaagagcagcggcggcttcgtgtgggcctgcaagaactacgacggcgacgtgcagagcgacatcctggcccagggcttcggcagcctgggcctgatgaccagcgtgctggtgtgccccgacggcaagaccatcgaggccgaggccgcccacggcaccgtgaccagacactacagagagcaccagaagggcagacccaccagcaccaaccccatcgccagcatcttcgcctggaccagaggcctggagcacagaggcaagctggacggcaaccaggacctgatcagattcgcccagatgctggagaaggtgtgcgtggagaccgtggagagcggcgccatgaccaaggacctggccggctgcatccacggcctgagcaacgtgaagctgaacgagcacttcctgaacaccaccgacttcctggacaccatcaagagcaacctggacagagccctgggcagacagtag

SEQ ID NO: 11208 - DNA, 1203 bp, Artificial Sequence
  Description of Artificial Sequence: Synthetic coding sequence
atggacggcgacgagatgaccagaatcatctggcagttcatcaaggagaagctgatcctgccccacgtggacatccagctgaagtacttcgacctgggcctgcccaacagagaccagaccgacgaccaggtgaccatcgacagcgccctggccacccagaagtacagcgtggccgtgaagtgcgccaccatcacccccgacgaggccagagtggaggagttcaagctgaagaagatgtggaagagccccaacggcaccatcagaaacatcctgggcggcaccgtgttcagagagcccatcatctgcaagaacatccccagactggtgcccggctggaccaagcccatcaccatcggcagacacgcccacggcgaccagtacaaggccaccgacttcgtggccgacagagccggcaccttcaagatggtgttcacccccaaggacggcagcggcgtgaaggagtgggaggtgtacaacttccccgccggcggcgtgggcatgggcatgtacaacaccgacgagagcatcagcggcttcgcccacagctgcttccagtacgccatccagaagaagtggcccctgtacatgagcaccaagaacaccatcctgaaggcctacgacggcagattcaaggacatcttccaggagatcttcgacaagcactacaagaccgacttcgacaagaacaagatctggtacgagcacagactgatcgacgacatggtggcccaggtgctgaagagcagcggcggcttcgtgtgggcctgcaagaactacgacggcgacgtgcagagcgacatcctggcccagggcttcggcagcctgggcctgatgaccagcgtgctggtgtgccccgacggcaagaccatcgaggccgaggccgcccacggcaccgtgaccagacactacagagagcaccagaagggcagacccaccagcaccaaccccatcgccagcatcttcgcctggaccagaggcctggagcacagaggcaagctggacggcaaccaggacctgatcagattcgcccagatgctggagaaggtgtgcgtggagaccgtggagagcggcgccatgaccaaggacctggccggctgcatccacggcctgagcaacgtgaagctgaacgagcacttcctgaacaccaccgacttcctggacaccatcaagagcaacctggacagagccctgggcagacagtag

SEQ ID NO: 11209 - DNA, 3657 bp, Artificial Sequence
  Description of Artificial Sequence: Synthetic coding sequence
atgagaagccccagaaccagaggcagaagcggcagacccctgagcctgctgctggccctgctgtgcgccctgagagccaaggtgtgcggcgccagcggccagttcgagctggagatcctgagcatgcagaacgtgaacggcgagctgcagaacggcaactgctgcggcggcgccagaaaccccggcgacagaaagtgcaccagagacgagtgcgacacctacttcaaggtgtgcctgaaggagtaccagagcagagtgaccgccggcggcccctgcagcttcggcagcggcagcacccccgtgatcggcggcaacaccttcaacctgaaggccagcagaggcaacgacagaaacagaatcgtgctgcccttcagcttcgcctggcccagaagctacaccctgctggtggaggcctgggacagcagcaacgacaccgtgcagcccgacagcatcatcgagaaggccagccacagcggcatgatcaaccccagcagacagtggcagaccctgaagcagaacaccggcgtggcccacttcgagtaccagatcagagtgacctgcgacgactactactacggcttcggctgcaacaagttctgcagacccagagacgacttcttcggccactacgcctgcgaccagaacggcaacaagacctgcatggagggctggatgggccccgagtgcaacagagccatctgcagacagggctgcagccccaagcacggcagctgcaagctgcccggcgactgcagatgccagtacggctggcagggcctgtactgcgacaagtgcatcccccaccccggctgcgtgcacggcatctgcaacgagccctggcagtgcctgtgcgagaccaactggggcggccagctgtgcgacaaggacctgaactactgcggcacccaccagccctgcctgaacggcggcacctgcagcaacaccggccccgacaagtaccagtgcagctgccccgagggctacagcggccccaactgcgagatcgccgagcacgcctgcctgagcgacccctgccacaacagaggcagctgcaaggagaccagcctgggcttcgagtgcgagtgcagccccggctggaccggccccacctgcagcaccaacatcgacgactgcagccccaacaactgcagccacggcggcacctgccaggacctggtgaacggcttcaagtgcgtgtgccccccccagtggaccggcaagacctgccagctggacgccaacgagtgcgaggccaagccctgcgtgaacgccaagagctgcaagaacctgatcgccagctactactgcgactgcctgcccggctggatgggccagaactgcgacatcaacatcaacgactgcctgggccagtgccagaacgacgccagctgcagagacctggtgaacggctacagatgcatctgcccccccggctacgccggcgaccactgcgagagagacatcgacgagtgcgccagcaacccctgcctgaacggcggccactgccagaacgagatcaacagattccagtgcctgtgccccaccggcttcagcggcaacctgtgccagctggacatcgactactgcgagcccaacccctgccagaacggcgcccagtgctacaacagagccagcgactacttctgcaagtgccccgaggactacgagggcaagaactgcagccacctgaaggaccactgcagaaccaccccctgcgaggtgatcgacagctgcaccgtggccatggccagcaacgacacccccgagggcgtgagatacatcagcagcaacgtgtgcggcccccacggcaagtgcaagagccagagcggcggcaagttcacctgcgactgcaacaagggcttcaccggcacctactgccacgagaacatcaacgactgcgagagcaacccctgcagaaacggcggcacctgcatcgacggcgtgaacagctacaagtgcatctgcagcgacggctgggagggcgcctactgcgagaccaacatcaacgactgcagccagaacccctgccacaacggcggcacctgcagagacctggtgaacgacttctactgcgactgcaagaacggctggaagggcaagacctgccacagcagagacagccagtgcgacgaggccacctgcaacaacggcggcacctgctacgacgagggcgacgccttcaagtgcatgtgccccggcggctgggagggcaccacctgcaacatcgccagaaacagcagctgcctgcccaacccctgccacaacggcggcacctgcgtggtgaacggcgagagcttcacctgcgtgtgcaaggagggctgggagggccccatctgcgcccagaacaccaacgactgcagcccccacccctgctacaacagcggcacctgcgtggacggcgacaactggtacagatgcgagtgcgcccccggcttcgccggccccgactgcagaatcaacatcaacgagtgccagagcagcccctgcgccttcggcgccacctgcgtggacgagatcaacggctacagatgcgtgtgcccccccggccacagcggcgccaagtgccaggaggtgagcggcagaccctgcatcaccatgggcagcgtgatccccgacggcgccaagtgggacgacgactgcaacacctgccagtgcctgaacggcagaatcgcctgcagcaaggtgtggtgcggccccagaccctgcctgctgcacaagggccacagcgagtgccccagcggccagagctgcatccccatcctggacgaccagtgcttcgtgcacccctgcaccggcgtgggcgagtgcagaagcagcagcctgcagcccgtgaagaccaagtgcaccagcgacagctactaccaggacaactgcgccaacatcaccttcaccttcaacaaggagatgatgagccccggcctgaccaccgagcacatctgcagcgagctgagaaacctgaacatcctgaagaacgtgagcgccgagtacagcatctacatcgcctgcgagcccagccccagcgccaacaacgagatccacgtggccatcagcgccgaggacatcagagacgacggcaaccccatcaaggagatcaccgacaagatcatcgacctggtgagcaagagagacggcaacagcagcctgatcgccgccgtggccgaggtgagagtgcagagaagacccctgaagaacagaaccgacttcctggtgcccctgctgagcagcgtgctgaccgtggcctggatctgctgcctggtgaccgccttctactggtgcctgagaaagagaagaaagcccggcagccacacccacagcgccagcgaggacaacaccaccaacaacgtgagagagcagctgaaccagatcaagaaccccatcgagaagcacggcgccaacaccgtgcccatcaaggactacgagaacaagaacagcaagatgagcaagatcagaacccacaacagcgaggtggaggaggacgacatggacaagcaccagcagaaggccagattcgccaagcagcccgcctacaccctggtggacagagaggagaagccccccaacggcacccccaccaagcaccccaactggaccaacaagcaggacaacagagacctggagagcgcccagagcctgaacagaatggagtacatcgtgtag

SEQ ID NO: 11210 - DNA, 3180 bp, Artificial Sequence
  Description of Artificial Sequence: Synthetic coding sequence
atgatcaaccccagcagacagtggcagaccctgaagcagaacaccggcgtggcccacttcgagtaccagatcagagtgacctgcgacgactactactacggcttcggctgcaacaagttctgcagacccagagacgacttcttcggccactacgcctgcgaccagaacggcaacaagacctgcatggagggctggatgggccccgagtgcaacagagccatctgcagacagggctgcagccccaagcacggcagctgcaagctgcccggcgactgcagatgccagtacggctggcagggcctgtactgcgacaagtgcatcccccaccccggctgcgtgcacggcatctgcaacgagccctggcagtgcctgtgcgagaccaactggggcggccagctgtgcgacaaggacctgaactactgcggcacccaccagccctgcctgaacggcggcacctgcagcaacaccggccccgacaagtaccagtgcagctgccccgagggctacagcggccccaactgcgagatcgccgagcacgcctgcctgagcgacccctgccacaacagaggcagctgcaaggagaccagcctgggcttcgagtgcgagtgcagccccggctggaccggccccacctgcagcaccaacatcgacgactgcagccccaacaactgcagccacggcggcacctgccaggacctggtgaacggcttcaagtgcgtgtgccccccccagtggaccggcaagacctgccagctggacgccaacgagtgcgaggccaagccctgcgtgaacgccaagagctgcaagaacctgatcgccagctactactgcgactgcctgcccggctggatgggccagaactgcgacatcaacatcaacgactgcctgggccagtgccagaacgacgccagctgcagagacctggtgaacggctacagatgcatctgcccccccggctacgccggcgaccactgcgagagagacatcgacgagtgcgccagcaacccctgcctgaacggcggccactgccagaacgagatcaacagattccagtgcctgtgccccaccggcttcagcggcaacctgtgccagctggacatcgactactgcgagcccaacccctgccagaacggcgcccagtgctacaacagagccagcgactacttctgcaagtgccccgaggactacgagggcaagaactgcagccacctgaaggaccactgcagaaccaccccctgcgaggtgatcgacagctgcaccgtggccatggccagcaacgacacccccgagggcgtgagatacatcagcagcaacgtgtgcggcccccacggcaagtgcaagagccagagcggcggcaagttcacctgcgactgcaacaagggcttcaccggcacctactgccacgagaacatcaacgactgcgagagcaacccctgcagaaacggcggcacctgcatcgacggcgtgaacagctacaagtgcatctgcagcgacggctgggagggcgcctactgcgagaccaacatcaacgactgcagccagaacccctgccacaacggcggcacctgcagagacctggtgaacgacttctactgcgactgcaagaacggctggaagggcaagacctgccacagcagagacagccagtgcgacgaggccacctgcaacaacggcggcacctgctacgacgagggcgacgccttcaagtgcatgtgccccggcggctgggagggcaccacctgcaacatcgccagaaacagcagctgcctgcccaacccctgccacaacggcggcacctgcgtggtgaacggcgagagcttcacctgcgtgtgcaaggagggctgggagggccccatctgcgcccagaacaccaacgactgcagcccccacccctgctacaacagcggcacctgcgtggacggcgacaactggtacagatgcgagtgcgcccccggcttcgccggccccgactgcagaatcaacatcaacgagtgccagagcagcccctgcgccttcggcgccacctgcgtggacgagatcaacggctacagatgcgtgtgcccccccggccacagcggcgccaagtgccaggaggtgagcggcagaccctgcatcaccatgggcagcgtgatccccgacggcgccaagtgggacgacgactgcaacacctgccagtgcctgaacggcagaatcgcctgcagcaaggtgtggtgcggccccagaccctgcctgctgcacaagggccacagcgagtgccccagcggccagagctgcatccccatcctggacgaccagtgcttcgtgcacccctgcaccggcgtgggcgagtgcagaagcagcagcctgcagcccgtgaagaccaagtgcaccagcgacagctactaccaggacaactgcgccaacatcaccttcaccttcaacaaggagatgatgagccccggcctgaccaccgagcacatctgcagcgagctgagaaacctgaacatcctgaagaacgtgagcgccgagtacagcatctacatcgcctgcgagcccagccccagcgccaacaacgagatccacgtggccatcagcgccgaggacatcagagacgacggcaaccccatcaaggagatcaccgacaagatcatcgacctggtgagcaagagagacggcaacagcagcctgatcgccgccgtggccgaggtgagagtgcagagaagacccctgaagaacagaaccgacttcctggtgcccctgctgagcagcgtgctgaccgtggcctggatctgctgcctggtgaccgccttctactggtgcctgagaaagagaagaaagcccggcagccacacccacagcgccagcgaggacaacaccaccaacaacgtgagagagcagctgaaccagatcaagaaccccatcgagaagcacggcgccaacaccgtgcccatcaaggactacgagaacaagaacagcaagatgagcaagatcagaacccacaacagcgaggtggaggaggacgacatggacaagcaccagcagaaggccagattcgccaagcagcccgcctacaccctggtggacagagaggagaagccccccaacggcacccccaccaagcaccccaactggaccaacaagcaggacaacagagacctggagagcgcccagagcctgaacagaatggagtacatcgtgtag

SEQ ID NO: 11211 - DNA, 3399 bp, Artificial Sequence
  Description of Artificial Sequence: Synthetic coding sequence
atgggcatggcctgcctgaccatgaccgagatggagggcaccagcaccagcagcatctaccagaacggcgacatcagcggcaacgccaacagcatgaagcagatcgaccccgtgctgcaggtgtacctgtaccacagcctgggcaagagcgaggccgactacctgaccttccccagcggcgagtacgtggccgaggagatctgcatcgccgccagcaaggcctgcggcatcacccccgtgtaccacaacatgttcgccctgatgagcgagaccgagagaatctggtacccccccaaccacgtgttccacatcgacgagagcaccagacacaacgtgctgtacagaatcagattctacttccccagatggtactgcagcggcagcaacagagcctacagacacggcatcagcagaggcgccgaggcccccctgctggacgacttcgtgatgagctacctgttcgcccagtggagacacgacttcgtgcacggctggatcaaggtgcccgtgacccacgagacccaggaggagtgcctgggcatggccgtgctggacatgatgagaatcgccaaggagaacgaccagacccccctggccatctacaacagcatcagctacaagaccttcctgcccaagtgcatcagagccaagatccaggactaccacatcctgaccagaaagagaatcagatacagattcagaagattcatccagcagttcagccagtgcaaggccaccgccagaaacctgaagctgaagtacctgatcaacctggagaccctgcagagcgccttctacaccgagaagttcgaggtgaaggagcccggcagcggccccagcggcgaggagatcttcgccaccatcatcatcaccggcaacggcggcatccagtggagcagaggcaagcacaaggagagcgagaccctgaccgagcaggacctgcagctgtactgcgacttccccaacatcatcgacgtgagcatcaagcaggccaaccaggagggcagcaacgagagcagagtggtgaccatccacaagcaggacggcaagaacctggagatcgagctgagcagcctgagagaggccctgagcttcgtgagcctgatcgacggctactacagactgaccgccgacgcccaccactacctgtgcaaggaggtggccccccccgccgtgctggagaacatccagagcaactgccacggccccatcagcatggacttcgccatcagcaagctgaagaaggccggcaaccagaccggcctgtacgtgctgagatgcagccccaaggacttcaacaagtacttcctgaccttcgccgtggagagagagaacgtgatcgagtacaagcactgcctgatcaccaagaacgagaacgaggagtacaacctgagcggcaccaagaagaacttcagcagcctgaaggacctgctgaactgctaccagatggagaccgtgagaagcgacaacatcatcttccagttcaccaagtgctgcccccccaagcccaaggacaagagcaacctgctggtgttcagaaccaacggcgtgagcgacgtgcccaccagccccaccctgcagagacccacccacatgaaccagatggtgttccacaagatcagaaacgaggacctgatcttcaacgagagcctgggccagggcaccttcaccaagatcttcaagggcgtgagaagagaggtgggcgactacggccagctgcacgagaccgaggtgctgctgaaggtgctggacaaggcccacagaaactacagcgagagcttcttcgaggccgccagcatgatgagcaagctgagccacaagcacctggtgctgaactacggcgtgtgcgtgtgcggcgacgagaacatcctggtgcaggagttcgtgaagttcggcagcctggacacctacctgaagaagaacaagaactgcatcaacatcctgtggaagctggaggtggccaagcagctggcctgggccatgcacttcctggaggagaacaccctgatccacggcaacgtgtgcgccaagaacatcctgctgatcagagaggaggacagaaagaccggcaacccccccttcatcaagctgagcgaccccggcatcagcatcaccgtgctgcccaaggacatcctgcaggagagaatcccctgggtgccccccgagtgcatcgagaaccccaagaacctgaacctggccaccgacaagtggagcttcggcaccaccctgtgggagatctgcagcggcggcgacaagcccctgagcgccctggacagccagagaaagctgcagttctacgaggacagacaccagctgcccgcccccaagtgggccgagctggccaacctgatcaacaactgcatggactacgagcccgacttcagacccagcttcagagccatcatcagagacctgaacagcctgttcacccccgactacgagctgctgaccgagaacgacatgctgcccaacatgagaatcggcgccctgggcttcagcggcgccttcgaggacagagaccccacccagttcgaggagagacacctgaagttcctgcagcagctgggcaagggcaacttcggcagcgtggagatgtgcagatacgaccccctgcaggacaacaccggcgaggtggtggccgtgaagaagctgcagcacagcaccgaggagcacctgagagacttcgagagagagatcgagatcctgaagagcctgcagcacgacaacatcgtgaagtacaagggcgtgtgctacagcgccggcagaagaaacctgaagctgatcatggagtacctgccctacggcagcctgagagactacctgcagaagcacaaggagagaatcgaccacatcaagctgctgcagtacaccagccagatctgcaagggcatggagtacctgggcaccaagagatacatccacagagacctggccaccagaaacatcctggtggagaacgagaacagagtgaagatcggcgacttcggcctgaccaaggtgctgccccaggacaaggagtactacaaggtgaaggagcccggcgagagccccatcttctggtacgcccccgagagcctgaccgagagcaagttcagcgtggccagcgacgtgtggagcttcggcgtggtgctgtacgagctgttcacctacatcgagaagagcaagagcccccccgccgagttcatgagaatgatcggcaacgacaagcagggccagatgatcgtgttccacctgatcgagctgctgaagaacaacggcagactgcccagacccgacggctgccccgacgagatctacatgatcatgaccgagtgctggaacaacaacgtgaaccagagacccagcttcagagacctggccctgagagtggaccagatcagagacaacatggccggctag

SEQ ID NO: 11212 - DNA, 3399 bp, Artificial Sequence; identical to SEQ ID NO: 11211
  Description of Artificial Sequence: Synthetic coding sequence

SEQ ID NO: 11213 - DNA, 2952 bp, Artificial Sequence
  Description of Artificial Sequence: Synthetic coding sequence
atgagctacctgttcgcccagtggagacacgacttcgtgcacggctggatcaaggtgcccgtgacccacgagacccaggaggagtgcctgggcatggccgtgctggacatgatgagaatcgccaaggagaacgaccagacccccctggccatctacaacagcatcagctacaagaccttcctgcccaagtgcatcagagccaagatccaggactaccacatcctgaccagaaagagaatcagatacagattcagaagattcatccagcagttcagccagtgcaaggccaccgccagaaacctgaagctgaagtacctgatcaacctggagaccctgcagagcgccttctacaccgagaagttcgaggtgaaggagcccggcagcggccccagcggcgaggagatcttcgccaccatcatcatcaccggcaacggcggcatccagtggagcagaggcaagcacaaggagagcgagaccctgaccgagcaggacctgcagctgtactgcgacttccccaacatcatcgacgtgagcatcaagcaggccaaccaggagggcagcaacgagagcagagtggtgaccatccacaagcaggacggcaagaacctggagatcgagctgagcagcctgagagaggccctgagcttcgtgagcctgatcgacggctactacagactgaccgccgacgcccaccactacctgtgcaaggaggtggccccccccgccgtgctggagaacatccagagcaactgccacggccccatcagcatggacttcgccatcagcaagctgaagaaggccggcaaccagaccggcctgtacgtgctgagatgcagccccaaggacttcaacaagtacttcctgaccttcgccgtggagagagagaacgtgatcgagtacaagcactgcctgatcaccaagaacgagaacgaggagtacaacctgagcggcaccaagaagaacttcagcagcctgaaggacctgctgaactgctaccagatggagaccgtgagaagcgacaacatcatcttccagttcaccaagtgctgcccccccaagcccaaggacaagagcaacctgctggtgttcagaaccaacggcgtgagcgacgtgcccaccagccccaccctgcagagacccacccacatgaaccagatggtgttccacaagatcagaaacgaggacctgatcttcaacgagagcctgggccagggcaccttcaccaagatcttcaagggcgtgagaagagaggtgggcgactacggccagctgcacgagaccgaggtgctgctgaaggtgctggacaaggcccacagaaactacagcgagagcttcttcgaggccgccagcatgatgagcaagctgagccacaagcacctggtgctgaactacggcgtgtgcgtgtgcggcgacgagaacatcctggtgcaggagttcgtgaagttcggcagcctggacacctacctgaagaagaacaagaactgcatcaacatcctgtggaagctggaggtggccaagcagctggcctgggccatgcacttcctggaggagaacaccctgatccacggcaacgtgtgcgccaagaacatcctgctgatcagagaggaggacagaaagaccggcaacccccccttcatcaagctgagcgaccccggcatcagcatcaccgtgctgcccaaggacatcctgcaggagagaatcccctgggtgccccccgagtgcatcgagaaccccaagaacctgaacctggccaccgacaagtggagcttcggcaccaccctgtgggagatctgcagcggcggcgacaagcccctgagcgccctggacagccagagaaagctgcagttctacgaggacagacaccagctgcccgcccccaagtgggccgagctggccaacctgatcaacaactgcatggactacgagcccgacttcagacccagcttcagagccatcatcagagacctgaacagcctgttcacccccgactacgagctgctgaccgagaacgacatgctgcccaacatgagaatcggcgccctgggcttcagcggcgccttcgaggacagagaccccacccagttcgaggagagacacctgaagttcctgcagcagctgggcaagggcaacttcggcagcgtggagatgtgcagatacgaccccctgcaggacaacaccggcgaggtggtggccgtgaagaagctgcagcacagcaccgaggagcacctgagagacttcgagagagagatcgagatcctgaagagcctgcagcacgacaacatcgtgaagtacaagggcgtgtgctacagcgccggcagaagaaacctgaagctgatcatggagtacctgccctacggcagcctgagagactacctgcagaagcacaaggagagaatcgaccacatcaagctgctgcagtacaccagccagatctgcaagggcatggagtacctgggcaccaagagatacatccacagagacctggccaccagaaacatcctggtggagaacgagaacagagtgaagatcggcgacttcggcctgaccaaggtgctgccccaggacaaggagtactacaaggtgaaggagcccggcgagagccccatcttctggtacgcccccgagagcctgaccgagagcaagttcagcgtggccagcgacgtgtggagcttcggcgtggtgctgtacgagctgttcacctacatcgagaagagcaagagcccccccgccgagttcatgagaatgatcggcaacgacaagcagggccagatgatcgtgttccacctgatcgagctgctgaagaacaacggcagactgcccagacccgacggctgccccgacgagatctacatgatcatgaccgagtgctggaacaacaacgtgaaccagagacccagcttcagagacctggccctgagagtggaccagatcagagacaacatggccggctag

SEQ ID NO: 11214 - DNA, 732 bp, Artificial Sequence
  Description of Artificial Sequence: Synthetic coding sequence
atgaccggcatcgccgccgccagcttcttcagcaacacctgcagattcggcggctgcggcctgcacttccccaccctggccgacctgatcgagcacatcgaggacaaccacatcgacaccgaccccagagtgctggagaagcaggagctgcagcagcccacctacgtggccctgagctacatcaacagattcatgaccgacgccgccagaagagagcaggagagcctgaagaagaagatccagcccaagctgagcctgaccctgagcagcagcgtgagcagaggcaacgtgagcaccccccccagacacagcagcggcagcctgaccccccccgtgaccccccccatcacccccagcagcagcttcagaagcagcacccccaccggcagcgagtacgacgaggaggaggtggactacgaggagagcgacagcgacgagagctggaccaccgagagcgccatcagcagcgaggccatcctgagcagcatgtgcatgaacggcggcgaggagaagcccttcgcctgccccgtgcccggctgcaagaagagatacaagaacgtgaacggcatcaagtaccacgccaagaacggccacagaacccagatcagagtgagaaagcccttcaagtgcagatgcggcaagagctacaagaccgcccagggcctgagacaccacaccatcaacttccacccccccgtgagcgccgagatcatcagaaagatgcagcagtag

SEQ ID NO: 11215 - DNA, 1044 bp, Artificial Sequence
  Description of Artificial Sequence: Synthetic coding sequence
atgtgcaccaagatggagcagcccttctaccacgacgacagctacaccgccaccggctacggcagagcccccggcggcctgagcctgcacgactacaagctgctgaagcccagcctggccgtgaacctggccgacccctacagaagcctgaaggcccccggcgccagaggccccggccccgagggcggcggcggcggcagctacttcagcggccagggcagcgacaccggcgccagcctgaagctggccagcagcgagctggagagactgatcgtgcccaacagcaacggcgtgatcaccaccacccccaccccccccggccagtacttctaccccagaggcggcggcagcggcggcggcgccggcggcgccggcggcggcgtgaccgaggagcaggagggcttcgccgacggcttcgtgaaggccctggacgacctgcacaagatgaaccacgtgaccccccccaacgtgagcctgggcgccaccggcggcccccccgccggccccggcggcgtgtacgccggccccgagcccccccccgtgtacaccaacctgagcagctacagccccgccagcgccagcagcggcggcgccggcgccgccgtgggcaccggcagcagctaccccaccaccaccatcagctacctgccccacgccccccccttcgccggcggccaccccgcccagctgggcctgggcagaggcgccagcaccttcaaggaggagccccagaccgtgcccgaggccagaagcagagacgccaccccccccgtgagccccatcaacatggaggaccaggagagaatcaaggtggagagaaagagactgagaaacagactggccgccaccaagtgcagaaagagaaagctggagagaatcgccagactggaggacaaggtgaagaccctgaaggccgagaacgccggcctgagcagcaccgccggcctgctgagagagcaggtggcccagctgaagcagaaggtgatgacccacgtgagcaacggctgccagctgctgctgggcgtgaagggccacgccttctag

SEQ ID NO: 11216 - DNA, 996 bp, Artificial Sequence
  Description of Artificial Sequence: Synthetic coding sequence
atgaccgccaagatggagaccaccttctacgacgacgccctgaacgccagcttcctgcccagcgagagcggcccctacggctacagcaaccccaagatcctgaagcagagcatgaccctgaacctggccgaccccgtgggcagcctgaagccccacctgagagccaagaacagcgacctgctgaccagccccgacgtgggcctgctgaagctggccagccccgagctggagagactgatcatccagagcagcaacggccacatcaccaccacccccacccccacccagttcctgtgccccaagaacgtgaccgacgagcaggagggcttcgccgagggcttcgtgagagccctggccgagctgcacagccagaacaccctgcccagcgtgaccagcgccgcccagcccgtgaacggcgccggcatggtggcccccgccgtggccagcgtggccggcggcagcggcagcggcggcttcagcgccagcctgcacagcgagccccccgtgtacgccaacctgagcaacttcaaccccggcgccctgagcagcggcggcggcgcccccagctacggcgccgccggcctggccttccccgcccagccccagcagcagcagcagcccccccaccacctgccccagcagatgcccgtgcagcaccccagactgcaggccctgaaggaggagccccagaccgtgcccgagatgcccggcgagaccccccccctgagccccatcgacatggagagccaggagagaatcaaggccgagagaaagagaatgagaaacagaatcgccgccagcaagtgcagaaagagaaagctggagagaatcgccagactggaggagaaggtgaagaccctgaaggcccagaacagcgagctggccagcaccgccaacatgctgagagagcaggtggcccagctgaagcagaaggtgatgaaccacgtgaacagcggctgccagctgatgctgacccagcagctgcagaccttctag

SEQ ID NO: 11217 - DNA, 831 bp, Artificial Sequence
  Description of Artificial Sequence: Synthetic coding sequence
atgagagccccccacctgcacctgagcgccgccagcggcgccagagccctggccaagctgctgcccctgctgatggcccagctgtgggccgccgaggccgccctgctgccccagaacgacaccagactggaccccgaggcctacggcagcccctgcgccagaggcagccagccctggcaggtgagcctgttcaacggcctgagcttccactgcgccggcgtgctggtggaccagagctgggtgctgaccgccgcccactgcggcaacaagcccctgtgggccagagtgggcgacgaccacctgctgctgctgcagggcgagcagctgagaagaaccaccagaagcgtggtgcaccccaagtaccaccagggcagcggccccatcctgcccagaagaaccgacgagcacgacctgatgctgctgaagctggccagacccgtggtgctgggccccagagtgagagccctgcagctgccctacagatgcgcccagcccggcgaccagtgccaggtggccggctggggcaccaccgccgccagaagagtgaagtacaacaagggcctgacctgcagcagcatcaccatcctgagccccaaggagtgcgaggtgttctaccccggcgtggtgaccaacaacatgatctgcgccggcctggacagaggccaggacccctgccagagcgacagcggcggccccctggtgtgcgacgagaccctgcagggcatcctgagctggggcgtgtacccctgcggcagcgcccagcaccccgccgtgtacacccagatctgcaagtacatgagctggatcaacaaggtgatcagaagcaactag

SEQ ID NO: 11218 - DNA, 831 bp, Artificial Sequence; identical to SEQ ID NO: 11217
  Description of Artificial Sequence: Synthetic coding sequence

SEQ ID NO: 11219 - DNA, 831 bp, Artificial Sequence; identical to SEQ ID NO: 11217
  Description of Artificial Sequence: Synthetic coding sequence

SEQ ID NO: 11220 - DNA, 657 bp, Artificial Sequence
  Description of Artificial Sequence: Synthetic coding sequence
atgtgggtgcccgtggtgttcctgaccctgagcgtgacctggatcggcgccgcccccctgatcctgagcagaatcgtgggcggctgggagtgcgagaagcacagccagccctggcaggtgctggtggccagcagaggcagagccgtgtgcggcggcgtgctggtgcacccccagtgggtgctgaccgccgcccactgcatcagaaagcccggcgacgacagcagccacgacctgatgctgctgagactgagcgagcccgccgagctgaccgacgccgtgaaggtgatggacctgcccacccaggagcccgccctgggcaccacctgctacgccagcggctggggcagcatcgagcccgaggagttcctgacccccaagaagctgcagtgcgtggacctgcacgtgatcagcaacgacgtgtgcgcccaggtgcacccccagaaggtgaccaagttcatgctgtgcgccggcagatggaccggcggcaagagcacctgcagcggcgacagcggcggccccctggtgtgcaacggcgtgctgcagggcatcaccagctggggcagcgagccctgcgccctgcccgagagacccagcctgtacaccaaggtggtgcactacagaaagtggatcaaggacaccatcgtggccaacccctag

SEQ ID NO: 11221 - DNA, 1590 bp, Artificial Sequence
  Description of Artificial Sequence: Synthetic coding sequence
atgagcaccaacgagaacgccaacacccccgccgccagactgcacagattcaagaacaagggcaaggacagcaccgagatgagaagaagaagaatcgaggtgaacgtggagctgagaaaggccaagaaggacgaccagatgctgaagagaagaaacgtgagcagcttccccgacgacgccaccagccccctgcaggagaacagaaacaaccagggcaccgtgaactggagcgtggacgacatcgtgaagggcatcaacagcagcaacgtggagaaccagctgcaggccacccaggccgccagaaagctgctgagcagagagaagcagccccccatcgacaacatcatcagagccggcctgatccccaagttcgtgagcttcctgggcagaaccgactgcagccccatccagttcgagagcgcctgggccctgaccaacatcgccagcggcaccagcgagcagaccaaggccgtggtggacggcggcgccatccccgccttcatcagcctgctggccagcccccacgcccacatcagcgagcaggccgtgtgggccctgggcaacatcgccggcgacggcagcgtgttcagagacctggtgatcaagtacggcgccgtggaccccctgctggccctgctggccgtgcccgacatgagcagcctggcctgcggctacctgagaaacctgacctggaccctgagcaacctgtgcagaaacaagaaccccgccccccccatcgacgccgtggagcagatcctgcccaccctggtgagactgctgcaccacgacgaccccgaggtgctggccgacacctgctgggccatcagctacctgaccgacggccccaacgagagaatcggcatggtggtgaagaccggcgtggtgccccagctggtgaagctgctgggcgccagcgagctgcccatcgtgacccccgccctgagagccatcggcaacatcgtgaccggcaccgacgagcagacccaggtggtgatcgacgccggcgccctggccgtgttccccagcctgctgaccaaccccaagaccaacatccagaaggaggccacctggaccatgagcaacatcaccgccggcagacaggaccagatccagcaggtggtgaaccacggcctggtgcccttcctggtgagcgtgctgagcaaggccgacttcaagacccagaaggaggccgtgtgggccgtgaccaactacaccagcggcggcaccgtggagcagatcgtgtacctggtgcactgcggcatcatcgagcccctgatgaacctgctgaccgccaaggacaccaagatcatcctggtgatcctggacgccatcagcaacatcttccaggccgccgagaagctgggcgagaccgagaagctgagcatcatgatcgaggagtgcggcggcctggacaagatcgaggccctgcagaaccacgagaacgagagcgtgtacaaggccagcctgagcctgatcgagaagtacttcagcgtggaggaggaggaggaccagaacgtggtgcccgagaccaccagcgagggctacaccttccaggtgcaggacggcgcccccggcaccttcaacttctag

SEQ ID NO: 11222 - DNA, 1590 bp, Artificial Sequence; identical to SEQ ID NO: 11221
  Description of Artificial Sequence: Synthetic coding sequence

SEQ ID NO: 11223 - DNA, 1968 bp, Artificial Sequence
  Description of Artificial Sequence: Synthetic coding sequence
atgcccctgaagtggaagaccagcagccccgccatctggaagttccccgtgcccgtgctgaagaccagcagaagcacccccctgagccccgcctacatcagcctggtggaggaggaggaccagcacatgaagctgagcctgggcggcagcgagatgggcctgagcagccacctgcagagcagcaaggccggccccaccagaatcttcaccagcaacacccacagcagcgtggtgctgcagggcttcgaccagctgagactggagggcctgctgtgcgacgtgaccctgatgcccggcgacaccgacgacgccttccccgtgcacagagtgatgatggccagcgccagcgactacttcaaggccatgttcaccggcggcatgaaggagcaggacctgatgtgcatcaagctgcacggcgtgagcaaggtgggcctgagaaagatcatcgacttcatctacaccgccaagctgagcctgaacatggacaacctgcaggacaccctggaggccgccagcttcctgcagatcctgcccgtgctggacttctgcaaggtgttcctgatcagcggcgtgaccctggacaactgcgtggaggtgggcagaatcgccaacacctacaacctgaccgaggtggacaagtacgtgaacagcttcgtgctgaagaacttccccgccctgctgagcaccggcgagttcctgaagctgcccttcgagagactggccttcgtgctgagcagcaacagcctgaagcactgcaccgagctggagctgttcaaggccacctgcagatggctgagactggaggagcccagaatggacttcgccgccaagctgatgaagaacatcagattccccctgatgaccccccaggagctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacaccacccacctggtgaccctgggcggcgtgctgagacagcagctggtggtgagcaaggagctgagaatgtacgacgagaaggcccacgagtggaagagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggctacctgtacgccgtgggcggcagaaacgccgccggcgagctgcccaccgtggagtgctacaaccccagaaccaacgagtggacctacgtggccaagatgagcgagccccactacggccacgccggcaccgtgtacggcggcgtgatgtacatcagcggcggcatcacccacgacaccttccagaaggagctgatgtgcttcgaccccgacaccgacaagtggatccagaaggcccccatgaccaccgtgagaggcctgcactgcatgtgcaccgtgggcgagagactgtacgtgatcggcggcaaccacttcagaggcaccagcgactacgacgacgtgctgagctgcgagtactacagccccatcctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgacaaggacgagtggcacaaggtgttcgacctgcccgagagcctgggcggcatcagagcctgcaccctgaccgtgttcccccccgaggagaccacccccagccccagcagagagagccccctgagcgccccctag

SEQ ID NO: 11224 - DNA, 1815 bp, Artificial Sequence
  Description of Artificial Sequence: Synthetic coding sequence
atgggcctgagcagccacctgcagagcagcaaggccggccccaccagaatcttcaccagcaacacccacagcagcgtggtgctgcagggcttcgaccagctgagactggagggcctgctgtgcgacgtgaccctgatgcccggcgacaccgacgacgccttccccgtgcacagagtgatgatggccagcgccagcgactacttcaaggccatgttcaccggcggcatgaaggagcaggacctgatgtgcatcaagctgcacggcgtgagcaaggtgggcctgagaaagatcatcgacttcatctacaccgccaagctgagcctgaacatggacaacctgcaggacaccctggaggccgccagcttcctgcagatcctgcccgtgctggacttctgcaaggtgttcctgatcagcggcgtgaccctggacaactgcgtggaggtgggcagaatcgccaacacctacaacctgaccgaggtggacaagtacgtgaacagcttcgtgctgaagaacttccccgccctgctgagcaccggcgagttcctgaagctgcccttcgagagactggccttcgtgctgagcagcaacagcctgaagcactgcaccgagctggagctgttcaaggccacctgcagatggctgagactggaggagcccagaatggacttcgccgccaagctgatgaagaacatcagattccccctgatgaccccccaggagctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacaccacccacctggtgaccctgggcggcgtgctgagacagcagctggtggtgagcaaggagctgagaatgtacgacgagaaggcccacgagtggaagagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggctacctgtacgccgtgggcggcagaaacgccgccggcgagctgcccaccgtggagtgctacaaccccagaaccaacgagtggacctacgtggccaagatgagcgagccccactacggccacgccggcaccgtgtacggcggcgtgatgtacatcagcggcggcatcacccacgacaccttccagaaggagctgatgtgcttcgaccccgacaccgacaagtggatccagaaggcccccatgaccaccgtgagaggcctgcactgcatgtgcaccgtgggcgagagactgtacgtgatcggcggcaaccacttcagaggcaccagcgactacgacgacgtgctgagctgcgagtactacagccccatcctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgacaaggacgagtggcacaaggtgttcgacctgcccgagagcctgggcggcatcagagcctgcaccctgaccgtgttcccccccgaggagaccacccccagccccagcagagagagccccctgagcgccccctag

SEQ ID NO: 11225 - DNA, 1815 bp, Artificial Sequence; identical to SEQ ID NO: 11224
  Description of Artificial Sequence: Synthetic coding sequence

SEQ ID NO: 11226 - DNA, 1815 bp, Artificial Sequence; identical to SEQ ID NO: 11224
  Description of Artificial Sequence: Synthetic coding sequence

SEQ ID NO: 11227 - DNA, 1815 bp, Artificial Sequence; identical to SEQ ID NO: 11224
  Description of Artificial Sequence: Synthetic coding sequence

SEQ ID NO: 11228 - DNA, 117 bp, Artificial Sequence
  Description of Artificial Sequence: Synthetic coding sequence
atgggcctgagcagccacctgcagagcagcaaggccggccccaccagaatcttcaccagcaacacccacagcagcgtggtgctgcagggcttcgaccagctgagactggagggctag

SEQ ID NO: 11229 - DNA, 1815 bp, Artificial Sequence; identical to SEQ ID NO: 11224
  Description of Artificial Sequence: Synthetic coding sequence

SEQ ID NO: 11230 - DNA, 1977 bp, Artificial Sequence
  Description of Artificial Sequence: Synthetic coding sequence
atgatgagagtgcagaccctgagagagaagtgggcctactggagaagaagacagctgagcctgaagcaggccgacttcaaggacatcttcaagaagagcaccagcggcagcctggtggaggaggaggaccagcacatgaagctgagcctgggcggcagcgagatgggcctgagcagccacctgcagagcagcaaggccggccccaccagaatcttcaccagcaacacccacagcagcgtggtgctgcagggcttcgaccagctgagactggagggcctgctgtgcgacgtgaccctgatgcccggcgacaccgacgacgccttccccgtgcacagagtgatgatggccagcgccagcgactacttcaaggccatgttcaccggcggcatgaaggagcaggacctgatgtgcatcaagctgcacggcgtgagcaaggtgggcctgagaaagatcatcgacttcatctacaccgccaagctgagcctgaacatggacaacctgcaggacaccctggaggccgccagcttcctgcagatcctgcccgtgctggacttctgcaaggtgttcctgatcagcggcgtgaccctggacaactgcgtggaggtgggcagaatcgccaacacctacaacctgaccgaggtggacaagtacgtgaacagcttcgtgctgaagaacttccccgccctgctgagcaccggcgagttcctgaagctgcccttcgagagactggccttcgtgctgagcagcaacagcctgaagcactgcaccgagctggagctgttcaaggccacctgcagatggctgagactggaggagcccagaatggacttcgccgccaagctgatgaagaacatcagattccccctgatgaccccccaggagctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacaccacccacctggtgaccctgggcggcgtgctgagacagcagctggtggtgagcaaggagctgagaatgtacgacgagaaggcccacgagtggaagagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggctacctgtacgccgtgggcggcagaaacgccgccggcgagctgcccaccgtggagtgctacaaccccagaaccaacgagtggacctacgtggccaagatgagcgagccccactacggccacgccggcaccgtgtacggcggcgtgatgtacatcagcggcggcatcacccacgacaccttccagaaggagctgatgtgcttcgaccccgacaccgacaagtggatccagaaggcccccatgaccaccgtgagaggcctgcactgcatgtgcaccgtgggcgagagactgtacgtgatcggcggcaaccacttcagaggcaccagcgactacgacgacgtgctgagctgcgagtactacagccccatcctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgacaaggacgagtggcacaaggtgttcgacctgcccgagagcctgggcggcatcagagcctgcaccctgaccgtgttcccccccgaggagaccacccccagccccagcagagagagccccctgagcgccccctag

SEQ ID NO: 11231 - DNA, 1920 bp, Artificial Sequence
  Description of Artificial Sequence: Synthetic coding sequence
atggaccacctgcacagaggcgagctggtggccgccatcctgagaaacagaagcctggtggaggaggaggaccagcacatgaagctgagcctgggcggcagcgagatgggcctgagcagccacctgcagagcagcaaggccggccccaccagaatcttcaccagcaacacccacagcagcgtggtgctgcagggcttcgaccagctgagactggagggcctgctgtgcgacgtgaccctgatgcccggcgacaccgacgacgccttccccgtgcacagagtgatgatggccagcgccagcgactacttcaaggccatgttcaccggcggcatgaaggagcaggacctgatgtgcatcaagctgcacggcgtgagcaaggtgggcctgagaaagatcatcgacttcatctacaccgccaagctgagcctgaacatggacaacctgcaggacaccctggaggccgccagcttcctgcagatcctgcccgtgctggacttctgcaaggtgttcctgatcagcggcgtgaccctggacaactgcgtggaggtgggcagaatcgccaacacctacaacctgaccgaggtggacaagtacgtgaacagcttcgtgctgaagaacttccccgccctgctgagcaccggcgagttcctgaagctgcccttcgagagactggccttcgtgctgagcagcaacagcctgaagcactgcaccgagctggagctgttcaaggccacctgcagatggctgagactggaggagcccagaatggacttcgccgccaagctgatgaagaacatcagattccccctgatgaccccccaggagctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacaccacccacctggtgaccctgggcggcgtgctgagacagcagctggtggtgagcaaggagctgagaatgtacgacgagaaggcccacgagtggaagagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggctacctgtacgccgtgggcggcagaaacgccgccggcgagctgcccaccgtggagtgctacaaccccagaaccaacgagtggacctacgtggccaagatgagcgagccccactacggccacgccggcaccgtgtacggcggcgtgatgtacatcagcggcggcatcacccacgacaccttccagaaggagctgatgtgcttcgaccccgacaccgacaagtggatccagaaggcccccatgaccaccgtgagaggcctgcactgcatgtgcaccgtgggcgagagactgtacgtgatcggcggcaaccacttcagaggcaccagcgactacgacgacgtgctgagctgcgagtactacagccccatcctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgacaaggacgagtggcacaaggtgttcgacctgcccgagagcctgggcggcatcagagcctgcaccctgaccgtgttcccccccgaggagaccacccccagccccagcagagagagccccctgagcgccccctag

SEQ ID NO: 11232 - DNA, 1920 bp, Artificial Sequence; identical to SEQ ID NO: 11231
  Description of Artificial Sequence: Synthetic coding sequence

SEQ ID NO: 11233 - DNA, 1842 bp, Artificial Sequence
  Description of Artificial Sequence: Synthetic coding sequence
atgaagctgagcctgggcggcagcgagatgggcctgagcagccacctgcagagcagcaaggccggccccaccagaatcttcaccagcaacacccacagcagcgtggtgctgcagggcttcgaccagctgagactggagggcctgctgtgcgacgtgaccctgatgcccggcgacaccgacgacgccttccccgtgcacagagtgatgatggccagcgccagcgactacttcaaggccatgttcaccggcggcatgaaggagcaggacctgatgtgcatcaagctgcacggcgtgagcaaggtgggcctgagaaagatcatcgacttcatctacaccgccaagctgagcctgaacatggacaacctgcaggacaccctggaggccgccagcttcctgcagatcctgcccgtgctggacttctgcaaggtgttcctgatcagcggcgtgaccctggacaactgcgtggaggtgggcagaatcgccaacacctacaacctgaccgaggtggacaagtacgtgaacagcttcgtgctgaagaacttccccgccctgctgagcaccggcgagttcctgaagctgcccttcgagagactggccttcgtgctgagcagcaacagcctgaagcactgcaccgagctggagctgttcaaggccacctgcagatggctgagactggaggagcccagaatggacttcgccgccaagctgatgaagaacatcagattccccctgatgaccccccaggagctgatcaactacgtgcagaccgtggacttcatgagaaccgacaacacctgcgtgaacctgctgctggaggccagcaactaccagatgatgccctacatgcagcccgtgatgcagagcgacagaaccgccatcagaagcgacaccacccacctggtgaccctgggcggcgtgctgagacagcagctggtggtgagcaaggagctgagaatgtacgacgagaaggcccacgagtggaagagcctggcccccatggacgcccccagataccagcacggcatcgccgtgatcggcaacttcctgtacgtggtgggcggccagagcaactacgacaccaagggcaagaccgccgtggacaccgtgttcagattcgaccccagatacaacaagtggatgcaggtggccagcctgaacgagaagagaaccttcttccacctgagcgccctgaagggctacctgtacgccgtgggcggcagaaacgccgccggcgagctgcccaccgtggagtgctacaaccccagaaccaacgagtggacctacgtggccaagatgagcgagccccactacggccacgccggcaccgtgtacggcggcgtgatgtacatcagcggcggcatcacccacgacaccttccagaaggagctgatgtgcttcgaccccgacaccgacaagtggatccagaaggcccccatgaccaccgtgagaggcctgcactgcatgtgcaccgtgggcgagagactgtacgtgatcggcggcaaccacttcagaggcaccagcgactacgacgacgtgctgagctgcgagtactacagccccatcctggaccagtggacccccatcgccgccatgctgagaggccagagcgacgtgggcgtggccgtgttcgagaacaagatctacgtggtgggcggctacagctggaacaacagatgcatggtggagatcgtgcagaagtacgaccccgacaaggacgagtggcacaaggtgttcgacctgcccgagagcctgggcggcatcagagcctgcaccctgaccgtgttcccccccgaggagaccacccccagccccagcagagagagccccctgagcgccccctag

SEQ ID NO: 11234 - DNA, 1419 bp, Artificial Sequence
  Description of Artificial Sequence: Synthetic coding sequence
atgaccacctgcagcagacagttcaccagcagcagcagcatgaagggcagctgcggcatcggcggcggcatcggcggcggcagcagcagaatcagcagcgtgctggccggcggcagctgcagagcccccagcacctacggcggcggcctgagcgtgagcagcagcagattcagcagcggcggcgcctgcggcctgggcggcggctacggcggcggcttcagcagcagcagcagcagcttcggcagcggcttcggcggcggctacggcggcggcctgggcgccggcctgggcggcggcttcggcggcggcttcgccggcggcgacggcctgctggtgggcagcgagaaggtgaccatgcagaacctgaacgacagactggccagctacctggacaaggtgagagccctggaggaggccaacgccgacctggaggtgaagatcagagactggtaccagagacagagacccgccgagatcaaggactacagcccctacttcaagaccatcgaggacctgagaaacaagatcctgaccgccaccgtggacaacgccaacgtgctgctgcagatcgacaacgccagactggccgccgacgacttcagaaccaagtacgagaccgagctgaacctgagaatgagcgtggaggccgacatcaacggcctgagaagagtgctggacgagctgaccctggccagagccgacctggagatgcagatcgagagcctgaaggaggagctggcctacctgaagaagaaccacgaggaggagatgaacgccctgagaggccaggtgggcggcgacgtgaacgtggagatggacgccgcccccggcgtggacctgagcagaatcctgaacgagatgagagaccagtacgagaagatggccgagaagaacagaaaggacgccgaggagtggttcttcaccaagaccgaggagctgaacagagaggtggccaccaacagcgagctggtgcagagcggcaagagcgagatcagcgagctgagaagaaccatgcagaacctggagatcgagctgcagagccagctgagcatgaaggccagcctggagaacagcctggaggagaccaagggcagatactgcatgcagctggcccagatccaggagatgatcggcagcgtggaggagcagctggcccagctgagatgcgagatggagcagcagaaccaggagtacaagatcctgctggacgtgaagaccagactggagcaggagatcgccacctacagaagactgctggagggcgaggacgcccacctgagcagcagccagttcagcagcggcagccagagcagcagagacgtgaccagcagcagcagacagatcagaaccaaggtgatggacgtgcacgacggcaaggtggtgagcacccacgagcaggtgctgagaaccaagaactag

SEQ ID NO: 11235 - DNA, 1293 bp, Artificial Sequence
  Description of Artificial Sequence: Synthetic coding sequence
atgagcttcaccaccagaagcaccttcagcaccaactacagaagcctgggcagcgtgcaggcccccagctacggcgccagacccgtgagcagcgccgccagcgtgtacgccggcgccggcggcagcggcagcagaatcagcgtgagcagaagcaccagcttcagaggcggcatgggcagcggcggcctggccaccggcatcgccggcggcctggccggcatgggcggcatccagaacgagaaggagaccatgcagagcctgaacgacagactggccagctacctggacagagtgagaagcctggagaccgagaacagaagactggagagcaagatcagagagcacctggagaagaagggcccccaggtgagagactggagccactacttcaagatcatcgaggacctgagagcccagatcttcgccaacaccgtggacaacgccagaatcgtgctgcagatcgacaacgccagactggccgccgacgacttcagagtgaagtacgagaccgagctggccatgagacagagcgtggagaacgacatccacggcctgagaaaggtgatcgacgacaccaacatcaccagactgcagctggagaccgagatcgaggccctgaaggaggagctgctgttcatgaagaagaaccacgaggaggaggtgaagggcctgcaggcccagatcgccagcagcggcctgaccgtggaggtggacgcccccaagagccaggacctggccaagatcatggccgacatcagagcccagtacgacgagctggccagaaagaacagagaggagctggacaagtactggagccagcagatcgaggagagcaccaccgtggtgaccacccagagcgccgaggtgggcgccgccgagaccaccctgaccgagctgagaagaaccgtgcagagcctggagatcgacctggacagcatgagaaacctgaaggccagcctggagaacagcctgagagaggtggaggccagatacgccctgcagatggagcagctgaacggcatcctgctgcacctggagagcgagctggcccagaccagagccgagggccagagacaggcccaggagtacgaggccctgctgaacatcaaggtgaagctggaggccgagatcgccacctacagaagactgctggaggacggcgaggacttcaacctgggcgacgccctggacagcagcaacagcatgcagaccatccagaagaccaccaccagaagaatcgtggacggcaaggtggtgagcgagaccaacgacaccaaggtgctgagacactag

SEQ ID NO: 11236 - DNA, 1293 bp, Artificial Sequence; identical to SEQ ID NO: 11235
  Description of Artificial Sequence: Synthetic coding sequence

SEQ ID NO: 11237 - DNA, 1203 bp, Artificial Sequence
  Description of Artificial Sequence: Synthetic coding sequence
atgaccagctacagctacagacagagcagcgccaccagcagcttcggcggcctgggcggcggcagcgtgagattcggccccggcgtggccttcagagcccccagcatccacggcggcagcggcggcagaggcgtgagcgtgagcagcgccagattcgtgagcagcagcagcagcggcgcctacggcggcggctacggcggcgtgctgaccgccagcgacggcctgctggccggcaacgagaagctgaccatgcagaacctgaacgacagactggccagctacctggacaaggtgagagccctggaggccgccaacggcgagctggaggtgaagatcagagactggtaccagaagcagggccccggccccagcagagactacagccactactacaccaccatccaggacctgagagacaagatcctgggcgccaccatcgagaacagcagaatcgtgctgcagatcgacaacgccagactggccgccgacgacttcagaaccaagttcgagaccgagcaggccctgagaatgagcgtggaggccgacatcaacggcctgagaagagtgctggacgagctgaccctggccagaaccgacctggagatgcagatcgagggcctgaaggaggagctggcctacctgaagaagaaccacgaggaggagatcagcaccctgagaggccaggtgggcggccaggtgagcgtggaggtggacagcgcccccggcaccgacctggccaagatcctgagcgacatgagaagccagtacgaggtgatggccgagcagaacagaaaggacgccgaggcctggttcaccagcagaaccgaggagctgaacagagaggtggccggccacaccgagcagctgcagatgagcagaagcgaggtgaccgacctgagaagaaccctgcagggcctggagatcgagctgcagagccagctgagcatgaaggccgccctggaggacaccctggccgagaccgaggccagattcggcgcccagctggcccacatccaggccctgatcagcggcatcgaggcccagctgggcgacgtgagagccgacagcgagagacagaaccaggagtaccagagactgatggacatcaagagcagactggagcaggagatcgccacctacagaagcctgctggagggccaggaggaccactacaacaacctgagcgccagcaaggtgctgtag

SEQ ID NO: 11238 - DNA, 591 bp, Artificial Sequence
  Description of Artificial Sequence: Synthetic coding sequence
atgaccagctacagctacagacagagcagcgccaccagcagcttcggcggcctgggcggcggcagcgtgagattcggccccggcgtggccttcagagcccccagcatccacggcggcagcggcggcagaggcgtgagcgtgagcagcgccagattcgtgagcagcagcagcagcggcgcctacggcggcggctacggcggcgtgctgaccgccagcgacggcctgctggccggcaacgagaagctgaccatgcagaacctgaacgacagactggccagctacctggacaaggtgagagccctggaggccgccaacggcgagctggagatcctgggcgccaccatcgagaacagcagaatcgtgctgcagatcgacaacgccagactggccgccgacgacttcagaaccaagttcgagaccgagcaggccctgagaatgagcgtggaggccgacatcaacggcctgagaagagtgctggacgagctgaccctggccagaaccgacctggagatgcagatcgagggcctgaaggaggagctggcctacctgaagaagaaccacgaggaggagatcagcaccctgagaggctag

SEQ ID NO: 11239 - DNA, 1773 bp, Artificial Sequence
  Description of Artificial Sequence: Synthetic coding sequence
atgagcagacagagcagcgtgagcttcagaagcggcggcagcagaagcttcagcaccgccagcgccatcacccccagcgtgagcagaaccagcttcaccagcgtgagcagaagcggcggcggcggcggcggcggcttcggcagagtgagcctggccggcgcctgcggcgtgggcggctacggcagcagaagcctgtacaacctgggcggcagcaagagaatcagcatcagcaccagcggcggcagcttcagaaacagattcggcgccggcgccggcggcggctacggcttcggcggcggcgccggcagcggcttcggcttcggcggcggcgccggcggcggcttcggcctgggcggcggcgccggcttcggcggcggcttcggcggccccggcttccccgtgtgcccccccggcggcatccaggaggtgaccgtgaaccagagcctgctgacccccctgaacctgcagatcgaccccagcatccagagagtgagaaccgaggagagagagcagatcaagaccctgaacaacaagttcgccagcttcatcgacaaggtgagattcctggagcagcagaacaaggtgctggacaccaagtggaccctgctgcaggagcagggcaccaagaccgtgagacagaacctggagcccctgttcgagcagtacatcaacaacctgagaagacagctggacagcatcgtgggcgagagaggcagactggacagcgagctgagaaacatgcaggacctggtggaggacttcaagaacaagtacgaggacgagatcaacaagagaaccaccgccgagaacgagttcgtgatgctgaagaaggacgtggacgccgcctacatgaacaaggtggagctggaggccaaggtggacgccctgatggacgagatcaacttcatgaagatgttcttcgacgccgagctgagccagatgcagacccacgtgagcgacaccagcgtggtgctgagcatggacaacaacagaaacctggacctggacagcatcatcgccgaggtgaaggcccagtacgaggagatcgccaacagaagcagaaccgaggccgagagctggtaccagaccaagtacgaggagctgcagcagaccgccggcagacacggcgacgacctgagaaacaccaagcacgagatcagcgagatgaacagaatgatccagagactgagagccgagatcgacaacgtgaagaagcagtgcgccaacctgcagaacgccatcgccgacgccgagcagagaggcgagctggccctgaaggacgccagaaacaagctggccgagctggaggaggccctgcagaaggccaagcaggacatggccagactgctgagagagtaccaggagctgatgaacaccaagctggccctggacgtggagatcgccacctacagaaagctgctggagggcgaggagtgcagactgagcggcgagggcgtgggccccgtgaacatcagcgtggtgaccagcagcgtgagcagcggctacggcagcggcagcggctacggcggcggcctgggcggcggcctgggcggcggcctgggcggcggcctggccggcggcagcagcggcagctactacagcagcagcagcggcggcgtgggcctgggcggcggcctgagcgtgggcggcagcggcttcagcgccagcagcggcagaggcctgggcgtgggcttcggcagcggcggcggcagcagcagcagcgtgaagttcgtgagcaccaccagcagcagcagaaagagcttcaagagctag

SEQ ID NO: 11240 - DNA, 1668 bp, Artificial Sequence
  Description of Artificial Sequence: Synthetic coding sequence
atgagcagacagagcagcgtgagcttcagaagcggcggcagcagaagcttcagcaccgccagcgccatcacccccagcgtgagcagaaccagcttcaccagcgtgagcagaagcggcggcggcggcggcggcggcttcggcagagtgagcctggccggcgcctgcggcgtgggcggctacggcttcggcggcggcgccggcagcggcttcggcttcggcggcggcgccggcggcggcttcggcctgggcggcggcgccggcttcggcggcggcttcggcggccccggcttccccgtgtgcccccccggcggcatccaggaggtgaccgtgaaccagagcctgctgacccccctgaacctgcagatcgaccccagcatccagagagtgagaaccgaggagagagagcagatcaagaccctgaacaacaagttcgccagcttcatcgacaaggtgagattcctggagcagcagaacaaggtgctggacaccaagtggaccctgctgcaggagcagggcaccaagaccgtgagacagaacctggagcccctgttcgagcagtacatcaacaacctgagaagacagctggacagcatcgtgggcgagagaggcagactggacagcgagctgagaaacatgcaggacctggtggaggacttcaagaacaagtacgaggacgagatcaacaagagaaccaccgccgagaacgagttcgtgatgctgaagaaggacgtggacgccgcctacatgaacaaggtggagctggaggccaaggtggacgccctgatggacgagatcaacttcatgaagatgttcttcgacgccgagctgagccagatgcagacccacgtgagcgacaccagcgtggtgctgagcatggacaacaacagaaacctggacctggacagcatcatcgccgaggtgaaggcccagtacgaggagatcgccaacagaagcagaaccgaggccgagagctggtaccagaccaagtacgaggagctgcagcagaccgccggcagacacggcgacgacctgagaaacaccaagcacgagatcagcgagatgaacagaatgatccagagactgagagccgagatcgacaacgtgaagaagcagtgcgccaacctgcagaacgccatcgccgacgccgagcagagaggcgagctggccctgaaggacgccagaaacaagctggccgagctggaggaggccctgcagaaggccaagcaggacatggccagactgctgagagagtaccaggagctgatgaacaccaagctggccctggacgtggagatcgccacctacagaaagctgctggagggcgaggagtgcagactgagcggcgagggcgtgggccccgtgaacatcagcgtggtgaccagcagcgtgagcagcggctacggcagcggcagcggctacggcggcggcctgggcggcggcctgggcggcggcctgggcggcggcctggccggcggcagcagcggcagctactacagcagcagcagcggcggcgtgggcctgggcggcggcctgagcgtgggcggcagcggcttcagcgccagcagcggcagaggcctgggcgtgggcttcggcagcggcggcggcagcagcagcagcgtgaagttcgtgagcaccaccagcagcagcagaaagagcttcaagagctag

SEQ ID NO: 11241 - DNA, 399 bp, Artificial Sequence
  Description of Artificial Sequence: Synthetic coding sequence
atgagcagacagagcagcgtgagcttcagaagcggcggcagcagaagcttcagcaccgccagcgccatcacccccagcgtgagcagaaccagcttcaccagcgtgagcagaagcggcggcggcggcggcggcggcttcggcagagtgagcctggccggcgcctgcggcgtgggcggctacggcagcagaagcctgtacaacctgggcggcagcaagagaatcagcatcagcaccagcggcggcagcttcagaaacagattcggcgccggcgccggcggcggctacggcttcggcggcggcgccggcagcggcttcggcttcggcggcggcgccggcggcggcttcggcctgggcggcggcgccggcttcggcggcggcttcggcggccccggcttctag

SEQ ID NO: 11242 - DNA, 1410 bp, Artificial Sequence
  Description of Artificial Sequence: Synthetic coding sequence
atgagcatccacttcagcagccccgtgttcaccagcagaagcgccgccttcagcggcagaggcgcccaggtgagactgagcagcgccagacccggcggcctgggcagcagcagcctgtacggcctgggcgccagcagacccagagtggccgtgagaagcgcctacggcggccccgtgggcgccggcatcagagaggtgaccatcaaccagagcctgctggcccccctgagactggacgccgaccccagcctgcagagagtgagacaggaggagagcgagcagatcaagaccctgaacaacaagttcgccagcttcatcgacaaggtgagattcctggagcagcagaacaagctgctggagaccaagtggaccctgctgcaggagcagaagagcgccaagagcagcagactgcccgacatcttcgaggcccagatcgccggcctgagaggccagctggaggccctgcaggtggacggcggcagactggaggccgagctgagaagcatgcaggacgtggtggaggacttcaagaacaagtacgaggacgagatcaaccacagaaccgccgccgagaacgagttcgtggtgctgaagaaggacgtggacgccgcctacatgagcaaggtggagctggaggccaaggtggacgccctgaacgacgagatcaacttcctgagaaccctgaacgagaccgagctgaccgagctgcagagccagatcagcgacaccagcgtggtgctgagcatggacaacagcagaagcctggacctggacggcatcatcgccgaggtgaaggcccagtacgaggagatggccaagtgcagcagagccgaggccgaggcctggtaccagaccaagttcgagaccctgcaggcccaggccggcaagcacggcgacgacctgagaaacaccagaaacgagatcagcgagatgaacagagccatccagagactgcaggccgagatcgacaacatcaagaaccagagagccaagctggaggccgccatcgccgaggccgaggagagaggcgagctggccctgaaggacgccagagccaagcaggaggagctggaggccgccctgcagagaggcaagcaggacatggccagacagctgagagagtaccaggagctgatgagcgtgaagctggccctggacatcgagatcgccacctacagaaagctgctggagggcgaggagagcagactggccggcgacggcgtgggcgccgtgaacatcagcgtgatgaacagcaccggcggcagcagcagcggcggcggcatcggcctgaccctgggcggcaccatgggcagcaacgccctgagcttcagcagcagcgccggccccggcctgctgaaggcctacagcatcagaaccgccagcgccagcagaagaagcgccagagactag

SEQ ID NO: 11243 - DNA, 1338 bp, Artificial Sequence
  Description of Artificial Sequence: Synthetic coding sequence
atgagcatccacttcagcagccccgtgttcaccagcagaagcgccgccttcagcggcagaggcgcccaggtgagactgagcagcgccagacccggcggcctgggcagcagcagcctgtacggcctgggcgccagcagacccagagtggcccccctgagactggacgccgaccccagcctgcagagagtgagacaggaggagagcgagcagatcaagaccctgaacaacaagttcgccagcttcatcgacaaggtgagattcctggagcagcagaacaagctgctggagaccaagtggaccctgctgcaggagcagaagagcgccaagagcagcagactgcccgacatcttcgaggcccagatcgccggcctgagaggccagctggaggccctgcaggtggacggcggcagactggaggccgagctgagaagcatgcaggacgtggtggaggacttcaagaacagatacgaggacgagatcaaccacagaaccgccgccgagaacgagttcgtggtgctgaagaaggacgtggacgccgcctacatgagcaaggtggagctggaggccaaggtggacgccctgaacgacgagatcaacttcctgagaaccctgaacgagaccgagctgaccgagctgcagagccagatcagcgacaccagcgtggtgctgagcatggacaacagcagaagcctggacctggacggcatcatcgccgaggtgaaggcccagtacgaggagatggccaagtgcagcagagccgaggccgaggcctggtaccagaccaagttcgagaccctgcaggcccaggccggcaagcacggcgacgacctgagaaacaccagaaacgagatcagcgagatgaacagagccatccagagactgcaggccgagatcgacaacatcaagaaccagagagccaagctggaggccgccatcgccgaggccgaggagagaggcgagctggccctgaaggacgccagagccaagcaggaggagctggaggccgccctgcagagaggcaagcaggacatggccagacagctgagagagtaccaggagctgatgagcgtgaagctggccctggacatcgagatcgccacctacagaaagctgctggagggcgaggagagcagactggccggcgacggcgtgggcgccgtgaacatcagcgtgatgaacagcaccggcggcagcagcagcggcggcggcatcggcctgaccctgggcggcaccatgggcagcaacgccctgagcttcagcagcagcgccggccccggcctgctgaaggcctacagcatcagaaccgccagcgccagcagaagaagcgccagagactag

SEQ ID NO: 11244 - DNA, 1212 bp, Artificial Sequence
  Description of Artificial Sequence: Synthetic coding sequence
atgagcatccacttcagcagccccgtgttcaccagcagaagcgccgccttcagcggcagaggcgcccaggtgagactgagcagcgccagacccggcggcctgggcagcagcagcctgtacggcctgggcgccagcagacccagagtggccgtgagaagcgcctacggcggccccgtgggcgccggcatcagagaggtgaccatcaaccagagcctgctggcccccctgagactggacgccgaccccagcctgcagagagtgagacaggaggagagcgagcagatcaagaccctgaacaacaagttcgccagcttcatcgacaaggtgagattcctggagcagcagaacaagctgctggagaccaagtggaccctgctgcaggagcagaagagcgccaagagcagcagactgcccgacatcttcgaggcccagatcgccggcctgagaggccagctggaggccctgcaggtggacggcggcagactggaggccgagctgagaagcatgcaggacgtggtggaggacttcaagaacaagtacgaggacgagatcaaccacagaaccgccgccgagaacgagttcgtggtgctgaagaaggacgtggacgccgcctacatgagcaaggtggagctggaggccaaggtggacgccctgaacgacgagatcaacttcctgagaaccctgaacgagaccgagatccacgtgctgcagagccacatcagcgacaccagcgtggtggtgaagctggacaacagccaggacctgaacatggactgcatcatcgccgagatcaaggcccagtacgacgacatcgtgacctgcagctgggccaaggccgagagctggtaccacggctgcctggagatgaaggccaccgtgatctggcacggcgagaccgtgggctgcaccaaggaggagatcaaggagctgacccacatgatccagagactgatggccaaggtggagaacgccaagtgccagaacagcaagctggaggtggaggtgacccagagcgagcagcagggcgaggtggccctgagcgacaacagatgcaagctggtggagctggagggcaccatgcagaaggccagacagtaccaggaggtgatgaacagcaagctgggcctgaacgtgaaggccgccagcagctgccacctgctggacggcgaggagcagagactgtgcgacggcatcagcgccgtgaacatctag

SEQ ID NO: 11245 - DNA, 1452 bp, Artificial Sequence
  Description of Artificial Sequence: Synthetic coding sequence
atgagcatcagagtgacccagaagagctacaaggtgagcaccagcggccccagagccttcagcagcagaagctacaccagcggccccggcagcagaatcagcagcagcagcttcagcagagtgggcagcagcaacttcagaggcggcctgggcggcggctacggcggcgccagcggcatgggcggcatcaccgccgtgaccgtgaaccagagcctgctgagccccctggtgctggaggtggaccccaacatccaggccgtgagaacccaggagaaggagcagatcaagaccctgaacaacaagttcgccagcttcatcgacaaggtgagattcctggagcagcagaacaagatgctggagaccaagtggagcctgctgcagcagcagaagaccgccagaagcaacatggacaacatgttcgagagctacatcaacaacctgagaagacagctggagaccctgggccaggagaagctgaagctggaggccgagctgggcaacatgcagggcctggtggaggacttcaagaacaagtacgaggacgagatcaacaagagaaccgagatggagaacgagttcgtgctgatcaagaaggacgtggacgaggcctacatgaacaaggtggagctggagagcagactggagggcctgaccgacgagatcaacttcctgagacagctgtacgaggaggagatcagagagctgcagagccagatcagcgacaccagcgtggtgctgagcatggacaacagcagaagcctggacatggacagcatcatcgccgaggtgaaggcccagtacgaggacatcgccaacagaagcagagccgaggccgagagcatgtaccagatcaagtacgaggagctgcagagcctggccggcaagcacggcgacgacctgagaagaaccaagaccgagatcagcgagatgaacagaaacatcagcagactgcaggccgagatcgagggcctgaagggccagagagccagcctggaggccgccatcgccgacgccgagcagagaggcgagctggccatcaaggacgccaacgccaagctgagcgagctggaggccgccctgcagagagccaagcaggacatggccagacagctgagagagtaccaggagctgatgaacgtgaagctggccctggacatcgagatcgccacctacagaaagctgctggagggcgaggagagcagactggagagcggcatgcagaacatgagcatccacaccaagaccaccagcggctacgccggcggcctgagcagcgcctacggcggcctgaccagccccggcctgagctacagcctgggcagcagcttcggcagcggcgccggcagcagcagcttcagcagaaccagcagcagcagagccgtggtggtgaagaagatcgagaccagagacggcaagctggtgagcgagagcagcgacgtgctgcccaagtag

SEQ ID NO: 11246 - DNA, 822 bp, Artificial Sequence
  Description of Artificial Sequence: Synthetic coding sequence
atgagcatcagagtgacccagaagagctacaaggtgagcaccagcggccccagagccttcagcagcagaagctacaccagcggccccggcagcagaatcagcagcagcagcttcagcagagtgggcagcagcaacttcagaggcggcctgggcggcggctacggcggcgccagcggcatgggcggcatcaccgccgtgaccgtgaaccagagcctgctgagccccctggtgctggaggtggaccccaacatccaggccgtgagaacccaggagaaggagcagatcaagaccctgaacaacaagttcgccagcttcatcgacaaggtgagattcctggagcagcagaacaagatgctggagaccaagtggagcctgctgcagcagcagaagaccgccagaagcaacatggacaacatgttcgagagctacatcaacaacctgagaagacagctggagaccctgggccaggagaagctgaagctggaggccgagctgggcaacatgcagggcctggtggaggacttcaagaacaagtacgaggacgagatcaacaagagaaccgagatggagaacgagttcgtgctgatcaagaaggacgtggacgaggcctacatgaacaaggtggagctggagagcagactggagggcctgaccgacgagatcaacttcctgagacagctgtacgaggaggagatcagagagctgcagagccagatcagcgacaccagcgtggtgctgagcatggacaacagcagaagcctggacatggacagcatcatcgccgaggtgaaggcccagtacgaggacatcgccaacagatag

SEQ ID NO: 11247 - DNA, 1452 bp, Artificial Sequence; identical to SEQ ID NO: 11245
  Description of Artificial Sequence: Synthetic coding sequence

SEQ ID NO: 11248 - DNA, 534 bp, Artificial Sequence
  Description of Artificial Sequence: Synthetic coding sequence
atgagcatcagagtgacccagaagagctacaaggtgagcaccagcggccccagagccttcagcagcagaagctacaccagcggccccggcagcagaatcagcagcagcagcttcagcagagtgggcagcagcaacttcagaggcggcctgggcggcggctacggcggcgccagcggcatgggcggcatcaccgccgtgaccgtgaaccagagcctgctgagccccctggtgctggaggtggaccccaacatccaggccgtgagaacccaggagaaggagcagatcaagaccctgaacaacaagttcgccagcttcatcgacaaggtgagattcctggagcagcagaacaagatgctggagaccaagtggagcctgctgcagcagcagaagaccgccagaagcaacatggacaacatgttcgagagctacatcaacaacctgagaagacagctggagaccctgggccaggagaagctgaagctggaggccgagctgggcaacatgcagggcctggtggaggacttcaagaactag

SEQ ID NO: 11249 - DNA, 1536 bp, Artificial Sequence
  Description of Artificial Sequence: Synthetic coding sequence
atgaacggcgtgagctggagccaggacctgcaggagggcatcagcgcctggttcggcccccccgccagcacccccgccagcaccatgagcatcagagtgacccagaagagctacaaggtgagcaccagcggccccagagccttcagcagcagaagctacaccagcggccccggcagcagaatcagcagcagcagcttcagcagagtgggcagcagcaacttcagaggcggcctgggcggcggctacggcggcgccagcggcatgggcggcatcaccgccgtgaccgtgaaccagagcctgctgagccccctggtgctggaggtggaccccaacatccaggccgtgagaacccaggagaaggagcagatcaagaccctgaacaacaagttcgccagcttcatcgacaaggtgagattcctggagcagcagaacaagatgctggagaccaagtggagcctgctgcagcagcagaagaccgccagaagcaacatggacaacatgttcgagagctacatcaacaacctgagaagacagctggagaccctgggccaggagaagctgaagctggaggccgagctgggcaacatgcagggcctggtggaggacttcaagaacaagtacgaggacgagatcaacaagagaaccgagatggagaacgagttcgtgctgatcaagaaggacgtggacgaggcctacatgaacaaggtggagctggagagcagactggagggcctgaccgacgagatcaacttcctgagacagctgtacgaggaggagatcagagagctgcagagccagatcagcgacaccagcgtggtgctgagcatggacaacagcagaagcctggacatggacagcatcatcgccgaggtgaaggcccagtacgaggacatcgccaacagaagcagagccgaggccgagagcatgtaccagatcaagtacgaggagctgcagagcctggccggcaagcacggcgacgacctgagaagaaccaagaccgagatcagcgagatgaacagaaacatcagcagactgcaggccgagatcgagggcctgaagggccagagagccagcctggaggccgccatcgccgacgccgagcagagaggcgagctggccatcaaggacgccaacgccaagctgagcgagctggaggccgccctgcagagagccaagcaggacatggccagacagctgagagagtaccaggagctgatgaacgtgaagctggccctggacatcgagatcgccacctacagaaagctgctggagggcgaggagagcagactggagagcggcatgcagaacatgagcatccacaccaagaccaccagcggctacgccggcggcctgagcagcgcctacggcggcctgaccagccccggcctgagctacagcctgggcagcagcttcggcagcggcgccggcagcagcagcttcagcagaaccagcagcagcagagccgtggtggtgaagaagatcgagaccagagacggcaagctggtgagcgagagcagcgacgtgctgcccaagtag

SEQ ID NO: 11250 - DNA, 1452 bp, Artificial Sequence; identical to SEQ ID NO: 11245
  Description of Artificial Sequence: Synthetic coding sequence

SEQ ID NO: 11251 - DNA, 4071 bp, Artificial Sequence
  Description of Artificial Sequence: Synthetic coding sequence
atgcagagcaaggtgctgctggccgtggccctgtggctgtgcgtggagaccagagccgccagcgtgggcctgcccagcgtgagcctggacctgcccagactgagcatccagaaggacatcctgaccatcaaggccaacaccaccctgcagatcacctgcagaggccagagagacctggactggctgtggcccaacaaccagagcggcagcgagcagagagtggaggtgaccgagtgcagcgacggcctgttctgcaagaccctgaccatccccaaggtgatcggcaacgacaccggcgcctacaagtgcttctacagagagaccgacctggccagcgtgatctacgtgtacgtgcaggactacagaagccccttcatcgccagcgtgagcgaccagcacggcgtggtgtacatcaccgagaacaagaacaagaccgtggtgatcccctgcctgggcagcatcagcaacctgaacgtgagcctgtgcgccagataccccgagaagagattcgtgcccgacggcaacagaatcagctgggacagcaagaagggcttcaccatccccagctacatgatcagctacgccggcatggtgttctgcgaggccaagatcaacgacgagagctaccagagcatcatgtacatcgtggtggtggtgggctacagaatctacgacgtggtgctgagccccagccacggcatcgagctgagcgtgggcgagaagctggtgctgaactgcaccgccagaaccgagctgaacgtgggcatcgacttcaactgggagtaccccagcagcaagcaccagcacaagaagctggtgaacagagacctgaagacccagagcggcagcgagatgaagaagttcctgagcaccctgaccatcgacggcgtgaccagaagcgaccagggcctgtacacctgcgccgccagcagcggcctgatgaccaagaagaacagcaccttcgtgagagtgcacgagaagcccttcgtggccttcggcagcggcatggagagcctggtggaggccaccgtgggcgagagagtgagaatccccgccaagtacctgggctaccccccccccgagatcaagtggtacaagaacggcatccccctggagagcaaccacaccatcaaggccggccacgtgctgaccatcatggaggtgagcgagagagacaccggcaactacaccgtgatcctgaccaaccccatcagcaaggagaagcagagccacgtggtgagcctggtggtgtacgtgcccccccagatcggcgagaagagcctgatcagccccgtggacagctaccagtacggcaccacccagaccctgacctgcaccgtgtacgccatcccccccccccaccacatccactggtactggcagctggaggaggagtgcgccaacgagcccagccaggccgtgagcgtgaccaacccctacccctgcgaggagtggagaagcgtggaggacttccagggcggcaacaagatcgaggtgaacaagaaccagttcgccctgatcgagggcaagaacaagaccgtgagcaccctggtgatccaggccgccaacgtgagcgccctgtacaagtgcgaggccgtgaacaaggtgggcagaggcgagagagtgatcagcttccacgtgaccagaggccccgagatcaccctgcagcccgacatgcagcccaccgagcaggagagcgtgagcctgtggtgcaccgccgacagaagcaccttcgagaacctgacctggtacaagctgggcccccagcccctgcccatccacgtgggcgagctgcccacccccgtgtgcaagaacctggacaccctgtggaagctgaacgccaccatgttcagcaacagcaccaacgacatcctgatcatggagctgaagaacgccagcctgcaggaccagggcgactacgtgtgcctggcccaggacagaaagaccaagaagagacactgcgtggtgagacagctgaccgtgctggagagagtggcccccaccatcaccggcaacctggagaaccagaccaccagcatcggcgagagcatcgaggtgagctgcaccgccagcggcaacccccccccccagatcatgtggttcaaggacaacgagaccctggtggaggacagcggcatcgtgctgaaggacggcaacagaaacctgaccatcagaagagtgagaaaggaggacgagggcctgtacacctgccaggcctgcagcgtgctgggctgcgccaaggtggaggccttcttcatcatcgagggcgcccaggagaagaccaacctggagatcatcatcctggtgggcaccgccgtgatcgccatgttcttctggctgctgctggtgatcatcctgagaaccgtgaagagagccaacggcggcgagctgaagaccggctacctgagcatcgtgatggaccccgacgagctgcccctggacgagcactgcgagagactgccctacgacgccagcaagtgggagttccccagagacagactgaagctgggcaagcccctgggcagaggcgccttcggccaggtgatcgaggccgacgccttcggcatcgacaagaccgccacctgcagaaccgtggccgtgaagatgctgaaggagggcgccacccacagcgagcacagagccctgatgagcgagctgaagatcctgatccacatcggccaccacctgaacgtggtgaacctgctgggcgcctgcaccaagcccggcggccccctgatggtgatcgtggagttctgcaagttcggcaacctgagcacctacctgagaagcaagagaaacgagttcgtgccctacaagaccaagggcgccagattcagacagggcaaggactacgtgggcgccatccccgtggacctgaagagaagactggacagcatcaccagcagccagagcagcgccagcagcggcttcgtggaggagaagagcctgagcgacgtggaggaggaggaggcccccgaggacctgtacaaggacttcctgaccctggagcacctgatctgctacagcttccaggtggccaagggcatggagttcctggccagcagaaagtgcatccacagagacctggccgccagaaacatcctgctgagcgagaagaacgtggtgaagatctgcgacttcggcctggccagagacatctacaaggaccccgactacgtgagaaagggcgacgccagactgcccctgaagtggatggcccccgagaccatcttcgacagagtgtacaccatccagagcgacgtgtggagcttcggcgtgctgctgtgggagatcttcagcctgggcgccagcccctaccccggcgtgaagatcgacgaggagttctgcagaagactgaaggagggcaccagaatgagagcccccgactacaccacccccgagatgtaccagaccatgctggactgctggcacggcgagcccagccagagacccaccttcagcgagctggtggagcacctgggcaacctgctgcaggccaacgcccagcaggacggcaaggactacatcgtgctgcccatcagcgagaccctgagcatggaggaggacagcggcctgagcctgcccaccagccccgtgagctgcatggaggaggaggaggtgtgcgaccccaagttccactacgacaacaccgccggcatcagccagtacctgcagaacagcaagagaaagagcagacccgtgagcgtgaagaccttcgaggacatccccctggaggagcccgaggtgaaggtgatccccgacgacaaccagaccgacagcggcatggtgctggccagcgaggagctgaagaccctggaggacagaaccaagctgagccccagcttcggcggcatggtgcccagcaagagcagagagagcgtggccagcgagggcagcaaccagaccagcggctaccagagcggctaccacagcgacgacaccgacaccaccgtgtacagcagcgaggaggccgagctgctgaagctgatcgagatcggcgtgcagaccggcagcaccgcccagatcctgcagcccgacagcggcaccaccctgagcagcccccccgtgtag

SEQ ID NO: 11252 - DNA, 6630 bp, Artificial Sequence
  Description of Artificial Sequence: Synthetic coding sequence
atgtggaacgacatcgagctgctgaccaacgacgacaccggcagcggctacctgagcgtgggcagcagaaaggagcacggcaccgccctgtaccaggtggacctgctggtgaagatcagcagcgagaaggccagcctgaaccccaagatccaggcctgcagcctgagcgacggcttcatcatcgtggccgaccagagcgtgatcctgctggacagcatctgcagaagcctgcagctgcacctggtgttcgacaccgaggtggacgtggtgggcctgtgccaggagggcaagttcctgctggtgggcgagagaagcggcaacctgcacctgatccacgtgaccagcaagcagaccctgctgaccaacgccttcgtgcagaaggccaacgacgagaacagaagaacctaccagaacctggtgatcgagaaggacggcagcaacgagggcacctactacatgctgctgctgacctacagcggcttcttctgcatcaccaacctgcagctgctgaagatccagcaggccatcgagaacgtggacttcagcaccgccaagaagctgcagggccagatcaagagcagcttcatcagcaccgagaactaccacaccctgggctgcctgagcctggtggccggcgacctggccagcgaggtgcccgtgatcatcggcggcaccggcaactgcgccttcagcaagtgggagcccgacagcagcaagaagggcatgaccgtgaagaacctgatcgacgccgagatcatcaagggcgccaagaagttccagctgatcgacaacctgctgttcgtgctggacaccgacaacgtgctgagcctgtgggacatctacaccctgacccccgtgtggaactggcccagcctgcacgtggaggagttcctgctgaccaccgaggccgacagccccagcagcgtgacctggcagggcatcaccaacctgaagctgatcgccctgaccgccagcgccaacaagaagatgaagaacctgatggtgtacagcctgcccaccatggagatcctgtacagcctggaggtgagcagcgtgagcagcctggtgcagaccggcatcagcaccgacaccatctacctgctggagggcgtgtgcaagaacgaccccaagctgagcgaggacagcgtgagcgtgctggtgctgagatgcctgaccgaggccctgcccgagaacagactgagcagactgctgcacaagcacagattcgccgaggccgagagcttcgccatccagttcggcctggacgtggagctggtgtacaaggtgaagagcaaccacatcctggagaagctggccctgagcagcgtggacgccagcgagcagaccgagtggcagcagctggtggacgacgccaaggagaacctgcacaagatccaggacgacgagttcgtggtgaactactgcctgaaggcccagtggatcacctacgagaccacccaggagatgctgaactacgccaagaccagactgctgaagaaggaggacaagaccgccctgatctacagcgacggcctgaaggaggtgctgagagcccacgccaagctgaccaccttctacggcgccttcggccccgagaagttcagcggcagcagctggatcgagttcctgaacaacgaggacgacctgaaggacatcttcctgcagctgaaggagggcaacctggtgtgcgcccagtacctgtggctgagacacagagccaacttcgagagcagattcgacgtgaagatgctggagagcctgctgaacagcatgagcgccagcgtgagcctgcagaagctgtgcccctggttcaagaacgacgtgatccccttcgtgagaagaaccgtgcccgagggccagatcatcctggccaagtggctggagcaggccgccagaaacctggagctgaccgacaaggccaactggcccgagaacggcctgcagctggccgagatcttcttcaccgccgagaagaccgacgagctgggcctggccagcagctggcactggatcagcctgaaggactaccagaacaccgaggaggtgtgccagctgagaaccctggtgaacaacctgagagagctgatcaccctgcacagaaagtacaactgcaagctggccctgagcgacttcgagaaggagaacaccaccaccatcgtgttcagaatgttcgacaaggtgctggcccccgagctgatccccagcatcctggagaagttcatcagagtgtacatgagagagcacgacctgcaggaggaggagctgctgctgctgtacatcgaggacctgctgaacagatgcagcagcaagagcaccagcctgttcgagaccgcctgggaggccaaggccatggccgtgatcgcctgcctgagcgacaccgacctgatcttcgacgccgtgctgaagatcatgtacgccgccgtggtgccctggagcgccgccgtggagcagctggtgaagcagcacctggagatggaccaccccaaggtgaagctgctgcaggagagctacaagctgatggagatgaagaagctgctgagaggctacggcatcagagaggtgaacctgctgaacaaggagatcatgagagtggtgagatacatcctgaagcaggacgtgcccagcagcctggaggacgccctgaaggtggcccaggccttcatgctgagcgacgacgagatctacagcctgagaatcatcgacctgatcgacagagagcagggcgaggactgcctgctgctgctgaagagcctgccccccgccgaggccgagaagaccgccgagagagtgatcatctgggccagactggccctgcaggaggagcccgaccacagcaaggagggcaaggcctggagaatgagcgtggccaagaccagcgtggacatcctgaagatcctgtgcgacatccagaaggacaacctgcagaagaaggacgagtgcgaggagatgctgaagctgttcaaggaggtggccagcctgcaggagaacttcgaggtgttcctgagcttcgaggactacagcaacagcagcctggtggccgacctgagagagcagcacatcaaggcccacgaggtggcccaggccaagcacaagcccggcagcacccccgagcccatcgccgccgaggtgagaagccccagcatggagagcaagctgcacagacaggccctggccctgcagatgagcaagcaggagctggaggccgagctgaccctgagagccctgaaggacggcaacatcaagaccgccctgaagaagtgcagcgacctgttcaagtaccactgcaacgccgacaccggcaagctgctgttcctgacctgccagaagctgtgccagatgctggccgacaacgtgcccgtgaccgtgcccgtgggcctgaacctgcccagcatgatccacgacctggccagccaggccgccaccatctgcagccccgacttcctgctggacgccctggagctgtgcaagcacaccctgatggccgtggagctgagcagacagtgccagatggacgactgcggcatcctgatgaaggccagcttcggcacccacaaggacccctacgaggagtggagctacagcgacttcttcagcgaggacggcatcgtgctggagagccagatggtgctgcccgtgatctacgagctgatcagcagcctggtgcccctggccgagagcaagagataccccctggagagcaccagcctgccctactgcagcctgaacgagggcgacggcctggtgctgcccgtgatcaacagcatcagcgccctgctgcagaacctgcaggagagcagccagtgggagctggccctgagattcgtggtgggcagcttcggcacctgcctgcagcacagcgtgagcaacttcatgaacgccaccctgagcgagaagctgttcggcgagaccaccctggtgaagagcagacacgtggtgatggagctgaaggagaaggccgtgatcttcatcagagagaacgccaccaccctgctgcacaaggtgttcaactgcagactggtggacctggacctggccctgggctactgcaccctgctgccccagaaggacgtgttcgagaacctgtggaagctgatcgacaaggcctggcagaactacgacaagatcctggccatcagcctggtgggcagcgagctggccagcctgtaccaggagatcgagatgggcctgaagttcagagagctgagcaccgacgcccagtggggcatcagactgggcaagctgggcatcagcttccagcccgtgttcagacagcacttcctgaccaagaaggacctgatcaaggccctggtggagaacatcgacatggacaccagcctgatcctggagtactgcagcaccttccagctggactgcgacgccgtgctgcagctgttcatcgagaccctgctgcacaacaccaacgccggccagggccagggcgacgccagcatggacagcgccaagagaagacaccccaagctgctggccaaggccctggagatggtgcccctgctgaccagcaccaaggacctggtgatcagcctgagcggcatcctgcacaagctggacccctacgactacgagatgatcgaggtggtgctgaaggtgatcgagagagccgacgagaagatcaccaacatcaacatcaaccaggccctgagcatcctgaagcacctgaagagctacagaagaatcagcccccccgtggacctggagtaccagtacatgctggagcacgtgatcaccctgcccagcgccgcccagaccagactgcccttccacctgatcttcttcggcaccgcccagaacttctggaagatcctgagcaccgagctgagcgaggagagcttccccaccctgctgctgatcagcaagctgatgaagttcagcctggacaccctgtacgtgagcaccgccaagcacgtgttcgagaagaagctgaagcccaagctgctgaagctgacccaggccaagagcagcaccctgatcaacaaggagatcaccaagatcacccagaccatcgagagctgcctgctgagcatcgtgaaccccgagtgggccgtggccatcgccatcagcctggcccaggacatccccgagggcagcttcaagatcagcgccctgaagttctgcctgtacctggccgagagatggctgcagaacatccccagccaggacgagaagagagagaaggccgaggccctgctgaagaagctgcacatccagtacagaagaagcggcaccgaggccgtgctgatcgcccacaagctgaacaccgaggagtacctgagagtgatcggcaagcccgcccacctgatcgtgagcctgtacgagcaccccagcatcaaccagagaatccagaacagcagcggcaccgactaccccgacatccacgccgccgccaaggagatcgccgaggtgaacgagatcaacctggagaaggtgtgggacatgctgctggagaagtggctgtgccccagcaccaagcccggcgagaagcccagcgagctgttcgagctgcaggaggacgaggccctgagaagagtgcagtacctgctgctgagcagacccatcgactacagcagcagaatgctgttcgtgttcgccaccagcaccaccaccaccctgggcatgcaccagctgaccttcgcccacagaaccagagccctgcagtgcctgttctacctggccgacaaggagaccatcgagagcctgttcaagaagcccatcgaggaggtgaagagctacctgagatgcatcaccttcctggccagcttcgagaccctgaacatccccatcacctacgagctgttctgcagcagccccaaggagggcatgatcaagggcctgtggaagaaccacagccacgagagcatggccgtgagactggtgaccgagctgtgcctggagtacaagatctacgacctgcagctgtggaacggcctgctgcagaagctgctgggcttcaacatgatcccctacctgagaaaggtgctgaaggccatcagcagcatccacagcctgtggcaggtgccctacttcagcaaggcctggcagagagtgatccagatccccctgctgagcgccagctgccccctgagccccgaccagctgagcgactgcagcgagagcctgatcgccgtgctggagtgccccgtgagcggcgacctggacctgatcggcgtggccagacagtacatccagctggagctgcccgccttcgccctggcctgcctgatgctgatgccccacagcgagaagagacaccagcagatcaagaacttcctgggcagctgcgacccccaggtgatcctgaagcagctggaggagcacatgaacaccggccagctggccggcttcagccaccagatcagaagcctgatcctgaacaacatcatcaacaagaaggagttcggcatcctggccaagaccaagtacttccagatgctgaagatgcacgccatgaacaccaacaacatcaccgagctggtgaactacctggccaacgacctgagcctggacgaggccagcgtgctgatcaccgagtacagcaagcactgcggcaagcccgtgccccccgacaccgccccctgcgagatcctgaagatgttcctgagcggcctgagctag

SEQ ID NO: 11253 - DNA, 1332 bp, Artificial Sequence
  Description of Artificial Sequence: Synthetic coding sequence
atgctggagcacgtgatcaccctgcccagcgccgcccagaccagactgcccttccacctgatcttcttcggcaccgcccagaacttctggaagatcctgagcaccgagctgagcgaggagagcttccccaccctgctgctgatcagcaagctgatgaagttcagcctggacaccctgtacgtgagcaccgccaagcacgtgttcgagaagaagctgaagcccaagctgctgaagctgacccaggccaagagcagcaccctgatcaacaaggagatcaccaagatcacccagaccatcgagagctgcctgctgagcatcgtgaaccccgagtgggccgtggccatcgccatcagcctggcccaggacatccccgagggcagcttcaagatcagcgccctgaagttctgcctgtacctggccgagagatggctgcagaacatccccagccaggacgagaagagagagaaggccgaggccctgctgaagaagctgcacatccagtacagaagaagcggcaccgaggccgtgctgatcgcccacaagctgaacaccgaggagtacctgagagtgatcggcaagcccgcccacctgatcgtgagcctgtacgagcaccccagcatcaaccagagaatccagaacagcagcggcaccgactaccccgacatccacgccgccgccaaggagatcgccgaggtgaacgagatcaacctggagaaggtgtgggacatgctgctggagaagtggctgtgccccagcaccaagcccggcgagaagcccagcgagctgttcgagctgcaggaggacgaggccctgagaagagtgcagtacctgctgctgagcagacccatcgactacagcagcagaatgctgttcgtgttcgccaccagcaccaccaccaccctgggcatgcaccagctgaccttcgcccacagaaccagagccctgcagtgcctgttctacctggccgacaaggagaccatcgagagcctgttcaagaagcccatcgaggaggtgaagagctacctgagatgcatcaccttcctggccagcttcgagaccctgaacatccccatcacctacgagctgttctgcagcagccccaaggagggcatgatcaagggcctgtggaagaaccacagccacgagagcatggccgtgagactggtgaccgagctgtgcctggagtacaagatctacgacctgcagctgtggaacggcctgctgcagaagctgctgggcttcaacatgatcccctacctgagaaaggtgctgaaggccatcagcagcatccacagcctgtggcagagatggagaagctgctacgtggcctag

SEQ ID NO: 11254 - DNA, 417 bp, Artificial Sequence
  Description of Artificial Sequence: Synthetic coding sequence
atgaacagcctggtgagctggcagctgctgctgttcctgtgcgccacccacttcggcgagcccctggagaaggtggccagcgtgggcaacagcagacccaccggccagcagctggagagcctgggcctgctggcccccggcgagcagagcctgccctgcaccgagagaaagcccgccgccaccgccagactgagcagaagaggcaccagcctgagccccccccccgagagcagcggcagcccccagcagcccggcctgagcgccccccacagcagacagatccccgccccccagggcgccgtgctggtgcagagagagaaggacctgcccaactacaactggaacagcttcggcctgagattcggcaagagagaggccgcccccggcaaccacggcagaagcgccggcagaggctag

SEQ ID NO: 11255 - DNA, 771 bp, Artificial Sequence
  Description of Artificial Sequence: Synthetic coding sequence
atggcccacagaccccccagccccgccctggccagcgtgctgctggccctgctgctgagcggcgccgccagagccgccgagatcgtgggcggccacgaggcccagccccacagcagaccctacatggccagcctgcagatgagaggcaaccccggcagccacttctgcggcggcaccctgatccaccccagcttcgtgctgaccgccgcccactgcctgagagacatcccccagagactggtgaacgtggtgctgggcgcccacaacgtgagaacccaggagcccacccagcagcacttcagcgtggcccaggtgttcctgaacaactacgacgccgagaacaagctgaacgacgtgctgctgatccagctgagcagccccgccaacctgagcgccagcgtggccaccgtgcagctgccccagcaggaccagcccgtgccccacggcacccagtgcctggccatgggctggggcagagtgggcgcccacgacccccccgcccaggtgctgcaggagctgaacgtgaccgtggtgaccttcttctgcagaccccacaacatctgcaccttcgtgcccagaagaaaggccggcatctgcttcggcgacagcggcggccccctgatctgcgacggcatcatccagggcatcgacagcttcgtgatctggggctgcgccaccagactgttccccgacttcttcaccagagtggccctgtacgtggactggatcagaagcaccctgagaagagtggaggccaagggcagaccctag

SEQ ID NO: 11256 - DNA, 2937 bp, Artificial Sequence
  Description of Artificial Sequence: Synthetic coding sequence
atggcccacaccaccaaggtgaacggcagcgccagcggcaaggccggcgacatcctgagcggcgaccaggacaaggagcagaaggacccctacttcgtggagaccccctacggctaccagctggacctggacttcctgaagtacgtggacgacatccagaagggcaacaccatcaagagactgaacatccagaagagaagaaagcccagcgtgccctgccccgagcccagaaccaccagcggccagcagggcatctggaccagcaccgagagcctgagcagcagcaacagcgacgacaacaagcagtgccccaacttcctgatcgccagaagccaggtgaccagcacccccatcagcaagccccccccccccctggagaccagcctgcccttcctgaccatccccgagaacagacagctgcccccccccagcccccagctgcccaagcacaacctgcacgtgaccaagaccctgatggagaccagaagaagactggagcaggagagagccaccatgcagatgacccccggcgagttcagaagacccagactggccagcttcggcggcatgggcaccaccagcagcctgcccagcttcgtgggcagcggcaaccacaaccccgccaagcaccagctgcagaacggctaccagggcaacggcgactacggcagctacgcccccgccgcccccaccaccagcagcatgggcagcagcatcagacacagccccctgagcagcggcatcagcacccccgtgaccaacgtgagccccatgcacctgcagcacatcagagagcagatggccatcgccctgaagagactgaaggagctggaggagcaggtgagaaccatccccgtgctgcaggtgaagatcagcgtgctgcaggaggagaagagacagctggtgagccagctgaagaaccagagagccgccagccagatcaacgtgtgcggcgtgagaaagagaagctacagcgccggcaacgccagccagctggagcagctgagcagagccagaagaagcggcggcgagctgtacatcgactacgaggaggaggagatggagaccgtggagcagagcacccagagaatcaaggagttcagacagctgaccgccgacatgcaggccctggagcagaagatccaggacagcagctgcgaggccagcagcgagctgagagagaacggcgagtgcagaagcgtggccgtgggcgccgaggagaacatgaacgacatcgtggtgtaccacagaggcagcagaagctgcaaggacgccgccgtgggcaccctggtggagatgagaaactgcggcgtgagcgtgaccgaggccatgctgggcgtgatgaccgaggccgacaaggagatcgagctgcagcagcagaccatcgagagcctgaaggagaagatctacagactggaggtgcagctgagagagaccacccacgacagagagatgaccaagctgaagcaggagctgcaggccgccggcagcagaaagaaggtggacaaggccaccatggcccagcccctggtgttcagcaaggtggtggaggccgtggtgcagaccagagaccagatggtgggcagccacatggacctggtggacacctgcgtgggcaccagcgtggagaccaacagcgtgggcatcagctgccagcccgagtgcaagaacaaggtggtgggccccgagctgcccatgaactggtggatcgtgaaggagagagtggagatgcacgacagatgcgccggcagaagcgtggagatgtgcgacaagagcgtgagcgtggaggtgagcgtgtgcgagaccggcagcaacaccgaggagagcgtgaacgacctgaccctgctgaagaccaacctgaacctgaaggaggtgagaagcatcggctgcggcgactgcagcgtggacgtgaccgtgtgcagccccaaggagtgcgccagcagaggcgtgaacaccgaggccgtgagccaggtggaggccgccgtgatggccgtgcccagaaccgccgaccaggacaccagcaccgacctggagcaggtgcaccagttcaccaacaccgagaccgccaccctgatcgagagctgcaccaacacctgcctgagcaccctggacaagcagaccagcacccagaccgtggagaccagaaccgtggccgtgggcgagggcagagtgaaggacatcaacagcagcaccaagaccagaagcatcggcgtgggcaccctgctgagcggccacagcggcttcgacagacccagcgccgtgaagaccaaggagagcggcgtgggccagatcaacatcaacgacaactacctggtgggcctgaagatgagaaccatcgcctgcggccccccccagctgaccgtgggcctgaccgccagcagaagaagcgtgggcgtgggcgacgaccccgtgggcgagagcctggagaacccccagccccaggcccccctgggcatgatgaccggcctggaccactacatcgagagaatccagaagctgctggccgagcagcagaccctgctggccgagaactacagcgagctggccgaggccttcggcgagccccacagccagatgggcagcctgaacagccagctgatcagcaccctgagcagcatcaacagcgtgatgaagagcgccagcaccgaggagctgagaaaccccgacttccagaagaccagcctgggcaagatcaccggcaactacctgggctacacctgcaagtgcggcggcctgcagagcggcagccccctgagcagccagaccagccagcccgagcaggaggtgggcaccagcgagggcaagcccatcagcagcctggacgccttccccacccaggagggcaccctgagccccgtgaacctgaccgacgaccagatcgccgccggcctgtacggcaacttcagccacagccagagcctggccagcggcttctag

SEQ ID NO: 11257 - DNA, 831 bp, Artificial Sequence
  Description of Artificial Sequence: Synthetic coding sequence
atgctgagcgcctgcaacctgctgaagaacaccatcaacgaccccaaggccctgaccagcaaggacatgagattctgcctgaacaccctgcagcacgagtggttcagagtgagcagccagaagagcgccatccccgccatggtgggcgactacatcgccgccttcgaggccatcagccccgacgtgctgagatacgtgatcaacctggccgacggcaacggcaacaccgccctgcactacagcgtgagccacagcaacttcgagatcgtgaagctgctgctggacgccgacgtgtgcaacgtggaccaccagaacaaggccggctacacccccatcatgctggccgccctggccgccgtggaggccgagaaggacatgagaatcgtggaggagctgttcggctgcggcgacgtgaacgccaaggccagccaggccggccagaccgccctgatgctggccgtgagccacggcagaatcgacatggtgaagggcctgctggcctgcggcgccgacgtgaacatccaggacgacgagggcagcaccgccctgatgtgcgccagcgagcacggccacgtggagatcgtgaagctgctgctggcccagcccggctgcaacggccacctggaggacaacgacggcagcaccgccctgagcatcgccctggaggccggccacaaggacatcgccgtgctgctgtacgcccacgtgaacttcgccaaggcccagagccccgtgagcgtggtgcacctggccttcgtgaacagactgaagagcaccagactggtggaccccctgccccccggcatcgacggcagacagatcctgtgctag

SEQ ID NO: 11258 - DNA, 993 bp, Artificial Sequence
  Description of Artificial Sequence: Synthetic coding sequence
atggccgagggccaccacgccgtgaacatcgagggcctgaagagcgccagagtggaggacgagatgcaggtgcaggagtgcgagcccgagaaggtggagatcagagagagatacgagctgagcgagaagatgctgagcgcctgcaacctgctgaagaacaccatcaacgaccccaaggccctgaccagcaaggacatgggccaggtgcagtggctgacccccatgatccccaccctgagagaggccgacgccggcggcagccacgagagattctgcctgaacaccctgcagcacgagtggttcagagtgagcagccagaagagcgccatccccgccatggtgggcgactacatcgccgccttcgaggccatcagccccgacgtgctgagatacgtgatcaacctggccgacggcaacggcaacaccgccctgcactacagcgtgagccacagcaacttcgagatcgtgaagctgctgctggacgccgacgtgtgcaacgtggaccaccagaacaaggccggctacacccccatcatgctggccgccctggccgccgtggaggccgagaaggacatgagaatcgtggaggagctgttcggctgcggcgacgtgaacgccaaggccagccaggccggccagaccgccctgatgctggccgtgagccacggcagaatcgacatggtgaagggcctgctggcctgcggcgccgacgtgaacatccaggacgacgagggcagcaccgccctgatgtgcgccagcgagcacggccacgtggagatcgtgaagctgctgctggcccagcccggctgcaacggccacctggaggacaacgacggcagcaccgccctgagcatcgccctggaggccggccacaaggacatcgccgtgctgctgtacgcccacgtgaacttcgccaaggcccagagccccggcacccccagactgggcagaaagaccagccccggccccacccacagaggcagcttcgactag

SEQ ID NO: 11259 - DNA, 3585 bp, Artificial Sequence
  Description of Artificial Sequence: Synthetic coding sequence
atggagaccagaagaagactggagcaggagagagccaccatgcagatgacccccggcgagttcagaagacccagactggccagcttcggcggcatgggcaccaccagcagcctgcccagcttcgtgggcagcggcaaccacaaccccgccaagcaccagctgcagaacggctaccagggcaacggcgactacggcagctacgcccccgccgcccccaccaccagcagcatgggcagcagcatcagacacagccccctgagcagcggcatcagcacccccgtgaccaacgtgagccccatgcacctgcagcacatcagagagcagatggccatcgccctgaagagactgaaggagctggaggagcaggtgagaaccatccccgtgctgcaggtgaagatcagcgtgctgcaggaggagaagagacagctggtgagccagctgaagaaccagagagccgccagccagatcaacgtgtgcggcgtgagaaagagaagctacagcgccggcaacgccagccagctggagcagctgagcagagccagaagaagcggcggcgagctgtacatcgactacgaggaggaggagatggagaccgtggagcagagcacccagagaatcaaggagttcagacagctgaccgccgacatgcaggccctggagcagaagatccaggacagcagctgcgaggccagcagcgagctgagagagaacggcgagtgcagaagcgtggccgtgggcgccgaggagaacatgaacgacatcgtggtgtaccacagaggcagcagaagctgcaaggacgccgccgtgggcaccctggtggagatgagaaactgcggcgtgagcgtgaccgaggccatgctgggcgtgatgaccgaggccgacaaggagatcgagctgcagcagcagaccatcgagagcctgaaggagaagatctacagactggaggtgcagctgagagagaccacccacgacagagagatgaccaagctgaagcaggagctgcaggccgccggcagcagaaagaaggtggacaaggccaccatggcccagcccctggtgttcagcaaggtggtggaggccgtggtgcagaccagagaccagatggtgggcagccacatggacctggtggacacctgcgtgggcaccagcgtggagaccaacagcgtgggcatcagctgccagcccgagtgcaagaacaaggtggtgggccccgagctgcccatgaactggtggatcgtgaaggagagagtggagatgcacgacagatgcgccggcagaagcgtggagatgtgcgacaagagcgtgagcgtggaggtgagcgtgtgcgagaccggcagcaacaccgaggagagcgtgaacgacctgaccctgctgaagaccaacctgaacctgaaggaggtgagaagcatcggctgcggcgactgcagcgtggacgtgaccgtgtgcagccccaaggagtgcgccagcagaggcgtgaacaccgaggccgtgagccaggtggaggccgccgtgatggccgtgcccagaaccgccgaccaggacaccagcaccgacctggagcaggtgcaccagttcaccaacaccgagaccgccaccctgatcgagagctgcaccaacacctgcctgagcaccctggacaagcagaccagcacccagaccgtggagaccagaaccgtggccgtgggcgagggcagagtgaaggacatcaacagcagcaccaagaccagaagcatcggcgtgggcaccctgctgagcggccacagcggcttcgacagacccagcgccgtgaagaccaaggagagcggcgtgggccagatcaacatcaacgacaactacctggtgggcctgaagatgagaaccatcgcctgcggccccccccagctgaccgtgggcctgaccgccagcagaagaagcgtgggcgtgggcgacgaccccgtgggcgagagcctggagaacccccagccccaggcccccctgggcatgatgaccggcctggaccactacatcgagagaatccagaagctgctggccgagcagcagaccctgctggccgagaactacagcgagctggccgaggccttcggcgagccccacagccagatgggcagcctgaacagccagctgatcagcaccctgagcagcatcaacagcgtgatgaagagcgccagcaccgaggagctgagaaaccccgacttccagaagaccagcctgggcaagatcaccggcaactacctgggctacacctgcaagtgcggcggcctgcagagcggcagccccctgagcagccagaccagccagcccgagcaggaggtgggcaccagcgagggcaagcccatcagcagcctggacgccttccccacccaggagggcaccctgagccccgtgaacctgaccgacgaccagatcgccgccggcctgtacgcctgcaccaacaacgagagcaccctgaagagcatcatgaagaagaaggacggcaacaaggacagcaacggcgccaagaagaacctgcagttcgtgggcatcaacggcggctacgagaccaccagcagcgacgacagcagcagcgacgagagcagcagcagcgagagcgacgacgagtgcgacgtgatcgagtaccccctggaggaggaggaggaggaggaggacgaggacaccagaggcatggccgagggccaccacgccgtgaacatcgagggcctgaagagcgccagagtggaggacgagatgcaggtgcaggagtgcgagcccgagaaggtggagatcagagagagatacgagctgagcgagaagatgctgagcgcctgcaacctgctgaagaacaccatcaacgaccccaaggccctgaccagcaaggacatgagattctgcctgaacaccctgcagcacgagtggttcagagtgagcagccagaagagcgccatccccgccatggtgggcgactacatcgccgccttcgaggccatcagccccgacgtgctgagatacgtgatcaacctggccgacggcaacggcaacaccgccctgcactacagcgtgagccacagcaacttcgagatcgtgaagctgctgctggacgccgacgtgtgcaacgtggaccaccagaacaaggccggctacacccccatcatgctggccgccctggccgccgtggaggccgagaaggacatgagaatcgtggaggagctgttcggctgcggcgacgtgaacgccaaggccagccaggccggccagaccgccctgatgctggccgtgagccacggcagaatcgacatggtgaagggcctgctggcctgcggcgccgacgtgaacatccaggacgacgagggcagcaccgccctgatgtgcgccagcgagcacggccacgtggagatcgtgaagctgctgctggcccagcccggctgcaacggccacctggaggacaacgacggcagcaccgccctgagcatcgccctggaggccggccacaaggacatcgccgtgctgctgtacgcccacgtgaacttcgccaaggcccagagccccggcacccccagactgggcagaaagaccagccccggccccacccacagaggcagcttcgactag

SEQ ID NO: 11260 - DNA, 4059 bp, Artificial Sequence
  Description of Artificial Sequence: Synthetic coding sequence
atggcccacaccaccaaggtgaacggcagcgccagcggcaaggccggcgacatcctgagcggcgaccaggacaaggagcagaaggacccctacttcgtggagaccccctacggctaccagctggacctggacttcctgaagtacgtggacgacatccagaagggcaacaccatcaagagactgaacatccagaagagaagaaagcccagcgtgccctgccccgagcccagaaccaccagcggccagcagggcatctggaccagcaccgagagcctgagcagcagcaacagcgacgacaacaagcagtgccccaacttcctgatcgccagaagccaggtgaccagcacccccatcagcaagccccccccccccctggagaccagcctgcccttcctgaccatccccgagaacagacagctgcccccccccagcccccagctgcccaagcacaacctgcacgtgaccaagaccctgatggagaccagaagaagactggagcaggagagagccaccatgcagatgacccccggcgagttcagaagacccagactggccagcttcggcggcatgggcaccaccagcagcctgcccagcttcgtgggcagcggcaaccacaaccccgccaagcaccagctgcagaacggctaccagggcaacggcgactacggcagctacgcccccgccgcccccaccaccagcagcatgggcagcagcatcagacacagccccctgagcagcggcatcagcacccccgtgaccaacgtgagccccatgcacctgcagcacatcagagagcagatggccatcgccctgaagagactgaaggagctggaggagcaggtgagaaccatccccgtgctgcaggtgaagatcagcgtgctgcaggaggagaagagacagctggtgagccagctgaagaaccagagagccgccagccagatcaacgtgtgcggcgtgagaaagagaagctacagcgccggcaacgccagccagctggagcagctgagcagagccagaagaagcggcggcgagctgtacatcgactacgaggaggaggagatggagaccgtggagcagagcacccagagaatcaaggagttcagacagctgaccgccgacatgcaggccctggagcagaagatccaggacagcagctgcgaggccagcagcgagctgagagagaacggcgagtgcagaagcgtggccgtgggcgccgaggagaacatgaacgacatcgtggtgtaccacagaggcagcagaagctgcaaggacgccgccgtgggcaccctggtggagatgagaaactgcggcgtgagcgtgaccgaggccatgctgggcgtgatgaccgaggccgacaaggagatcgagctgcagcagcagaccatcgagagcctgaaggagaagatctacagactggaggtgcagctgagagagaccacccacgacagagagatgaccaagctgaagcaggagctgcaggccgccggcagcagaaagaaggtggacaaggccaccatggcccagcccctggtgttcagcaaggtggtggaggccgtggtgcagaccagagaccagatggtgggcagccacatggacctggtggacacctgcgtgggcaccagcgtggagaccaacagcgtgggcatcagctgccagcccgagtgcaagaacaaggtggtgggccccgagctgcccatgaactggtggatcgtgaaggagagagtggagatgcacgacagatgcgccggcagaagcgtggagatgtgcgacaagagcgtgagcgtggaggtgagcgtgtgcgagaccggcagcaacaccgaggagagcgtgaacgacctgaccctgctgaagaccaacctgaacctgaaggaggtgagaagcatcggctgcggcgactgcagcgtggacgtgaccgtgtgcagccccaaggagtgcgccagcagaggcgtgaacaccgaggccgtgagccaggtggaggccgccgtgatggccgtgcccagaaccgccgaccaggacaccagcaccgacctggagcaggtgcaccagttcaccaacaccgagaccgccaccctgatcgagagctgcaccaacacctgcctgagcaccctggacaagcagaccagcacccagaccgtggagaccagaaccgtggccgtgggcgagggcagagtgaaggacatcaacagcagcaccaagaccagaagcatcggcgtgggcaccctgctgagcggccacagcggcttcgacagacccagcgccgtgaagaccaaggagagcggcgtgggccagatcaacatcaacgacaactacctggtgggcctgaagatgagaaccatcgcctgcggccccccccagctgaccgtgggcctgaccgccagcagaagaagcgtgggcgtgggcgacgaccccgtgggcgagagcctggagaacccccagccccaggcccccctgggcatgatgaccggcctggaccactacatcgagagaatccagaagctgctggccgagcagcagaccctgctggccgagaactacagcgagctggccgaggccttcggcgagccccacagccagatgggcagcctgaacagccagctgatcagcaccctgagcagcatcaacagcgtgatgaagagcgccagcaccgaggagctgagaaaccccgacttccagaagaccagcctgggcaagatcaccggcaactacctgggctacacctgcaagtgcggcggcctgcagagcggcagccccctgagcagccagaccagccagcccgagcaggaggtgggcaccagcgagggcaagcccatcagcagcctggacgccttccccacccaggagggcaccctgagccccgtgaacctgaccgacgaccagatcgccgccggcctgtacgcctgcaccaacaacgagagcaccctgaagagcatcatgaagaagaaggacggcaacaaggacagcaacggcgccaagaagaacctgcagttcgtgggcatcaacggcggctacgagaccaccagcagcgacgacagcagcagcgacgagagcagcagcagcgagagcgacgacgagtgcgacgtgatcgagtaccccctggaggaggaggaggaggaggaggacgaggacaccagaggcatggccgagggccaccacgccgtgaacatcgagggcctgaagagcgccagagtggaggacgagatgcaggtgcaggagtgcgagcccgagaaggtggagatcagagagagatacgagctgagcgagaagatgctgagcgcctgcaacctgctgaagaacaccatcaacgaccccaaggccctgaccagcaaggacatgagattctgcctgaacaccctgcagcacgagtggttcagagtgagcagccagaagagcgccatccccgccatggtgggcgactacatcgccgccttcgaggccatcagccccgacgtgctgagatacgtgatcaacctggccgacggcaacggcaacaccgccctgcactacagcgtgagccacagcaacttcgagatcgtgaagctgctgctggacgccgacgtgtgcaacgtggaccaccagaacaaggccggctacacccccatcatgctggccgccctggccgccgtggaggccgagaaggacatgagaatcgtggaggagctgttcggctgcggcgacgtgaacgccaaggccagccaggccggccagaccgccctgatgctggccgtgagccacggcagaatcgacatggtgaagggcctgctggcctgcggcgccgacgtgaacatccaggacgacgagggcagcaccgccctgatgtgcgccagcgagcacggccacgtggagatcgtgaagctgctgctggcccagcccggctgcaacggccacctggaggacaacgacggcagcaccgccctgagcatcgccctggaggccggccacaaggacatcgccgtgctgctgtacgcccacgtgaacttcgccaaggcccagagccccggcacccccagactgggcagaaagaccagccccggccccacccacagaggcagcttcgactag

SEQ ID NO: 11261 - DNA, 4059 bp, Artificial Sequence; identical to SEQ ID NO: 11260
  Description of Artificial Sequence: Synthetic coding sequence

SEQ ID NO: 11262 - DNA, 1197 bp, Artificial Sequence
  Description of Artificial Sequence: Synthetic coding sequence
atgaagaagaaggacggcaacaaggacagcaacggcgccaagaagaacctgcagttcgtgggcatcaacggcggctacgagaccaccagcagcgacgacagcagcagcgacgagagcagcagcagcgagagcgacgacgagtgcgacgtgatcgagtaccccctggaggaggaggaggaggaggaggacgaggacaccagaggcatggccgagggccaccacgccgtgaacatcgagggcctgaagagcgccagagtggaggacgagatgcaggtgcaggagtgcgagcccgagaaggtggagatcagagagagatacgagctgagcgagaagatgctgagcgcctgcaacctgctgaagaacaccatcaacgaccccaaggccctgaccagcaaggacatgggccaggtgcagtggctgacccccatgatccccaccctgagagaggccgacgccggcggcagccacgagagattctgcctgaacaccctgcagcacgagtggttcagagtgagcagccagaagagcgccatccccgccatggtgggcgactacatcgccgccttcgaggccatcagccccgacgtgctgagatacgtgatcaacctggccgacggcaacggcaacaccgccctgcactacagcgtgagccacagcaacttcgagatcgtgaagctgctgctggacgccgacgtgtgcaacgtggaccaccagaacaaggccggctacacccccatcatgctggccgccctggccgccgtggaggccgagaaggacatgagaatcgtggaggagctgttcggctgcggcgacgtgaacgccaaggccagccaggccggccagaccgccctgatgctggccgtgagccacggcagaatcgacatggtgaagggcctgctggcctgcggcgccgacgtgaacatccaggacgacgagggcagcaccgccctgatgtgcgccagcgagcacggccacgtggagatcgtgaagctgctgctggcccagcccggctgcaacggccacctggaggacaacgacggcagcaccgccctgagcatcgccctggaggccggccacaaggacatcgccgtgctgctgtacgcccacgtgaacttcgccaaggcccagagccccggcacccccagactgggcagaaagaccagccccggccccacccacagaggcagcttcgactag

SEQ ID NO: 11263 - DNA, 2211 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtggctggacgagagacacgcccagagccacttcatccccgccctgttcagacccagccccctggagagaatcaagaccaacgtgatcaaccccgcctacgccaccgagagcggccagaccgagaacagcctgcacatgggctacagcgccctggagatcaagagcaagatgctggccctggagaaggccgacacctgcatctacaaccccctgttcggcagcgacctgcagtacaccaacagagtggacaaggtggtgatcaacccctacttcggcctgggcgcccccgactacagcaagatccagatccccaagcaggagaagtggcagagaagcatgagcagcgtgaccgaggacaaggagagacagtgggtggacgacttccccctgcacagaagcgcctgcgagggcgacagcgagctgctgagcagactgctgagcgagagattcagcgtgaaccagctggacagcgaccactgggcccccatccactacgcctgctggtacggcaaggtggaggccaccagaatcctgctggagaagggcaagtgcaaccccaacctgctgaacggccagctgagcagccccctgcacttcgccgccggcggcggccacgccgagatcgtgcagatcctgctgaaccaccccgagaccgacagacacatcaccgaccagcagggcagaagccccctgaacatctgcgaggagaacaagcagaacaactgggaggaggccgccaagctgctgaaggaggccatcaacaagccctacgagaaggtgagaatctacagaatggacggcagctacagaagcgtggagctgaagcacggcaacaacaccaccgtgcagcagatcatggagggcatgagactgagccaggagacccagcagtacttcaccatctggatctgcagcgagaacctgagcctgcagctgaagccctaccacaagcccctgcagcacgtgagagactggcccgagatcctggccgagctgaccaacctggacccccagagagagaccccccagctgttcctgagaagagacgtgagactgcccctggaggtggagaagcagatcgaggaccccctggccatcctgatcctgttcgacgaggccagatacaacctgctgaagggcttctacaccgcccccgacgccaagctgatcaccctggccagcctgctgctgcagatcgtgtacggcaactacgagagcaagaagcacaagcagggcttcctgaacgaggagaacctgaagagcatcgtgcccgtgaccaagctgaagagcaaggccccccactggaccaacagaatcctgcacgagtacaagaacctgagcaccagcgagggcgtgagcaaggagatgcaccacctgcagagaatgttcctgcagaactgctgggagatccccacctacggcgccgccttcttcaccggccagatcttcaccaaggccagccccagcaaccacaaggtgatccccgtgtacgtgggcgtgaacatcaagggcctgcacctgctgaacatggagaccaaggccctgctgatcagcctgaagtacggctgcttcatgtggcagctgggcgacaccgacacctgcttccagatccacagcatggagaacaagatgagcttcatcgtgcacaccaagcaggccggcctggtggtgaagctgctgatgaagctgaacggccagctgatgcccaccgagagaaacagctag

SEQ ID NO: 11264 - DNA, 2067 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtggctggacgagagacacgcccagagccacttcatccccgccctgttcagacccagccccctggagagaatcaagaccaacgtgatcaaccccgcctacgccaccgagagcggccagaccgagaacagcctgcacatgggctacagcgccctggagatcaagagcaagatgctggccctggagaaggccgacacctgcatctacaaccccctgttcggcagcgacctgcagtacaccaacagagtggacaaggtggtgatcaacccctacttcggcctgggcgcccccgactacagcaagatccagatccccaagcaggagaagtggcagagaagcatgagcagcgtgaccgaggacaagtacggcaaggtggaggccaccagaatcctgctggagaagggcaagtgcaaccccaacctgctgaacggccagctgagcagccccctgcacttcgccgccggcggcggccacgccgagatcgtgcagatcctgctgaaccaccccgagaccgacagacacatcaccgaccagcagggcagaagccccctgaacatctgcgaggagaacaagcagaacaactgggaggaggccgccaagctgctgaaggaggccatcaacaagccctacgagaaggtgagaatctacagaatggacggcagctacagaagcgtggagctgaagcacggcaacaacaccaccgtgcagcagatcatggagggcatgagactgagccaggagacccagcagtacttcaccatctggatctgcagcgagaacctgagcctgcagctgaagccctaccacaagcccctgcagcacgtgagagactggcccgagatcctggccgagctgaccaacctggacccccagagagagaccccccagctgttcctgagaagagacgtgagactgcccctggaggtggagaagcagatcgaggaccccctggccatcctgatcctgttcgacgaggccagatacaacctgctgaagggcttctacaccgcccccgacgccaagctgatcaccctggccagcctgctgctgcagatcgtgtacggcaactacgagagcaagaagcacaagcagggcttcctgaacgaggagaacctgaagagcatcgtgcccgtgaccaagctgaagagcaaggccccccactggaccaacagaatcctgcacgagtacaagaacctgagcaccagcgagggcgtgagcaaggagatgcaccacctgcagagaatgttcctgcagaactgctgggagatccccacctacggcgccgccttcttcaccggccagatcttcaccaaggccagccccagcaaccacaaggtgatccccgtgtacgtgggcgtgaacatcaagggcctgcacctgctgaacatggagaccaaggccctgctgatcagcctgaagtacggctgcttcatgtggcagctgggcgacaccgacacctgcttccagatccacagcatggagaacaagatgagcttcatcgtgcacaccaagcaggccggcctggtggtgaagctgctgatgaagctgaacggccagctgatgcccaccgagagaaacagctag

SEQ ID NO: 11265 - DNA, 2211 bp, Artificial Sequence; identical to SEQ ID NO: 11263
  Description of Artificial Sequence: Synthetic coding sequence

SEQ ID NO: 11266 - DNA, 2211 bp, Artificial Sequence; identical to SEQ ID NO: 11263
  Description of Artificial Sequence: Synthetic coding sequence

SEQ ID NO: 11267 - DNA, 2211 bp, Artificial Sequence; identical to SEQ ID NO: 11263
  Description of Artificial Sequence: Synthetic coding sequence

SEQ ID NO: 11268 - DNA, 210 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctgtag

SEQ ID NO: 11269 - DNA, 1698 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtggctggacgagagacacgcccagagccacttcatccccgccctgttcagacccagccccctggagagaatcaagaccaacgtgatcaaccccgcctacgccaccgagagcggccagaccgagaacagcctgcacatgggctacagcgccctggagatcaagagcaagatgctggccctggagaaggccgacacctgcatctacaaccccctgttcggcagcgacctgcagtacaccaacagagtggacaaggtggtgatcaacccctacttcggcctgggcgcccccgactacagcaagatccagatccccaagcaggagaagtggcagagaagcatgagcagcgtgaccgaggacaaggagagacagtgggtggacgacttccccctgcacagaagcgcctgcgagggcgacagcgagctgctgagcagactgctgagcgagagattcagcgtgaaccagctggacagcgaccactgggcccccatccactacgcctgctggtacggcaaggtggaggccaccagaatcctgctggagaagggcaagtgcaaccccaacctgctgaacggccagctgagcagccccctgcacttcgccgccggcggcggccacgccgagatcgtgcagatcctgctgaaccaccccgagaccgacagacacatcaccgaccagcagggcagaagccccctgaacatctgcgaggagaacaagcagaacaactgggaggaggccgccaagctgctgaaggaggccatcaacaagccctacgagaaggtgagaatctacagaatggacggcagctacagaagcgtggagctgaagcacggcaacaacaccaccgtgcagcagatcatggagggcatgagactgagccaggagacccagcagtacttcaccatctggatctgcagcgagaacctgagcctgcagctgaagccctaccacaagcccctgcagcacgtgagagactggcccgagatcctggccgagctgaccaacctggacccccagagagagaccccccagctgttcctgagaagagacgtgagactgcccctggaggtggagaagcagatcgaggaccccctggccatcctgatcctgttcgacgaggccagatacaacctgctgaagggcttctacaccgcccccgacgccaagctgatcaccctggccagcctgctgctgcagagcctgtggaagctgtag

SEQ ID NO: 11270 - DNA, 78 bp, Artificial Sequence
  Description of Artificial Sequence: Synthetic coding sequence
atgggcaaccccgagaacatcgaggacgcctacgtggccgtgatcagacccaagaacaccgccagcctgaacagctag

SEQ ID NO: 11271 - DNA, 39 bp, Artificial Sequence
  Description of Artificial Sequence: Synthetic coding sequence
atgggcaaccccgagaacatcgaggacgcctacgtgtag

SEQ ID NO: 11272 - DNA, 117 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcactag

SEQ ID NO: 11273 - DNA, 297 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttcccctag

SEQ ID NO: 11274 - DNA, 555 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtggctggacgagagacacgcccagagccacttcatccccgccctgttcagacccagccccctggagtag

SEQ ID NO: 11275 - DNA, 339 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatctag

SEQ ID NO: 11276 - DNA, 105 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagtag

SEQ ID NO: 11277 - DNA, 177 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgtag

SEQ ID NO: 11278 - DNA, 489 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtag

SEQ ID NO: 11279 - DNA, 732 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtggctggacgagagacacgcccagagccacttcatccccgccctgttcagacccagccccctggagagaatcaagaccaacgtgatcaaccccgcctacgccaccgagagcggccagaccgagaacagcctgcacatgggctacagcgccctggagatcaagagcaagatgctggccctggagaaggccgacacctgcatctacaaccccctgttcggcagcgacctgcagtacaccaacagatag

SEQ ID NO: 11280 - DNA, 198 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacctag

SEQ ID NO: 11281 - DNA, 1089 bp, Artificial Sequence
  Description of Artificial Sequence: Synthetic coding sequence
atggccaccgccgagaccgccctgcccagcatcagcaccctgaccgccctgggccccttccccgacacccaggacgacttcctgaagtggtggagaagcgaggaggcccaggacatgggccccggcccccccgaccccaccgagccccccctgcacgtgaagagcgaggaccagcccggcgaggaggaggacgacgagagaggcgccgacgccacctgggacctggacctgctgctgaccaacttcagcggccccgagcccggcggcgccccccagacctgcgccctggcccccagcgaggccagcggcgcccagtacccccccccccccgagaccctgggcgcctacgccggcggccccggcctggtggccggcctgctgggcagcgaggaccacagcggctgggtgagacccgccctgagagccagagcccccgacgccttcgtgggccccgccctggcccccgcccccgcccccgagcccaaggccctggccctgcagcccgtgtaccccggccccggcgccggcagcagcggcggctacttccccagaaccggcctgagcgtgcccgccgccagcggcgccccctacggcctgctgagcggctaccccgccatgtaccccgccccccagtaccagggccacttccagctgttcagaggcctgcagggccccgcccccggccccgccaccagccccagcttcctgagctgcctgggccccggcaccgtgggcaccggcctgggcggcaccgccgaggaccccggcgtgatcgccgagaccgcccccagcaagagaggcagaagaagctgggccagaaagagacaggccgcccacacctgcgcccaccccggctgcggcaagagctacaccaagagcagccacctgaaggcccacctgagaacccacaccggcgagaagccctacgcctgcacctgggagggctgcggctggagattcgccagaagcgacgagctgaccagacactacagaaagcacaccggccagagacccttcagatgccagctgtgccccagagccttcagcagaagcgaccacctggccctgcacatgaagagacacctgtag

SEQ ID NO: 11282 - DNA, 999 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccgtggacatcctgacctacgtggcctggaagatcagcggcttccccaagaacagagtgatcggcagcggctgcaacctggacagcgccagattcagatacctgatgggcgagagactgggcgtgcaccccctgagctgccacggctgggtgctgggcgagcacggcgacagcagcgtgcccgtgtggagcggcatgaacgtggccggcgtgagcctgaagaccctgcaccccgacctgggcaccgacaaggacaaggagcagtggaaggaggtgcacaagcaggtggtggagagcgcctacgaggtgatcaagctgaagggctacaccagctgggccatcggcctgagcgtggccgacctggccgagagcatcatgaagaacctgagaagagtgcaccccgtgagcaccatgatcaagggcctgtacggcatcaaggacgacgtgttcctgagcgtgccctgcatcctgggccagaacggcatcagcgacctggtgaaggtgaccctgaccagcgaggaggaggccagactgaagaagagcgccgacaccctgtggggcatccagaaggagctgcagttctag

SEQ ID NO: 11283 - DNA, 825 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccgtggacatcctgacctacgtggcctggaagatcagcggcttccccaagaacagagtgatcggcagcggctgcaacctggacagcgccagattcagatacctgatgggcgagagactgggcgtgcaccccctgagctgccacggctgggtgctgggcgagcacggcgacagcagcgtgcccgtgtggagcggcatgaacgtggccggcgtgagcctgaagaccctgcaccccgacctgggcaccgacaaggacaaggagcagtggaaggagtgcagatacaccctgggcgaccccaagggcgccgccatcctgaagagcagcgacgtgatcagcttccactgcctgggctacaacagaatcctgggcggcggctgcgcctgctgccccttctacctgatctgcgactag

SEQ ID NO: 11284 - DNA, 999 bp, Artificial Sequence; identical to SEQ ID NO: 11282
  Description of Artificial Sequence: Synthetic coding sequence

SEQ ID NO: 11285 - DNA, 825 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggtggacatcctgacctacgtggcctggaagatcagcggcttccccaagaacagagtgatcggcagcggctgcaacctggacagcgccagattcagatacctgatgggcgagagactgggcgtgcaccccctgagctgccacggctgggtgctgggcgagcacggcgacagcagcgtgcccgtgtggagcggcatgaacgtggccggcgtgagcctgaagaccctgcaccccgacctgggcaccgacaaggacaaggagcagtggaaggaggtgcacaagcaggtggtggagagcgcctacgaggtgatcaagctgaagggctacaccagctgggccatcggcctgagcgtggccgacctggccgagagcatcatgaagaacctgagaagagtgcaccccgtgagcaccatgatcaagggcctgtacggcatcaaggacgacgtgttcctgagcgtgccctgcatcctgggccagaacggcatcagcgacctggtgaaggtgaccctgaccagcgaggaggaggccagactgaagaagagcgccgacaccctgtggggcatccagaaggagctgcagttctag

SEQ ID NO: 11286 - DNA, 918 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccgtggacatcctgacctacgtggcctggaagatcagcggcttccccaagaacagagtgatcggcagcggctgcaacctggacagcgccagattcagatacctgatgggcgagagactgggcgtgcaccccctgagctgccacggctgggtgctgggcgagcacggcgacagcagcgtgcccgtgtggagcggcatgaacgtggccggcgtgagcctgaagaccctgcaccccgacctgggcaccgacaaggacaaggagcagtggaaggaggtgcacaagcaggtggtggagagcgcctacgaggtgatcaagctgaagggctacaccagctgggccatcggcctgagcgtggccgacctggccgagagcatcatgaagaacctgagaagagtgcaccccgtgagcaccatgatcaagggcctgtacggcatcaaggacgacgtgttcctgagcgtgccctgcatcctgggccagaacggcatcagcgacctggtgaaggtgaccctgaccagcgaggaggaggccagactgaagaagagcgccgacaccctgtggggcatccagaaggagctgcagttctag

SEQ ID NO: 11287 - DNA, 435 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccggcgaggccttcgactag

SEQ ID NO: 11288 - DNA, 345 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgtag

SEQ ID NO: 11289 - DNA, 219 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgtag

SEQ ID NO: 11290 - DNA, 1086 bp, Artificial Sequence
  Description of Artificial Sequence: Synthetic coding sequence
atgggcgagcccagcggcggctacacctacacccagaccagcatcttcctgttccacgccaagatccccttcggcagcaagagcaacatggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccgtggacatcctgacctacgtggcctggaagatcagcggcttccccaagaacagagtgatcggcagcggctgcaacctggacagcgccagattcagatacctgatgggcgagagactgggcgtgcaccccctgagctgccacggctgggtgctgggcgagcacggcgacagcagcgtgcccgtgtggagcggcatgaacgtggccggcgtgagcctgaagaccctgcaccccgacctgggcaccgacaaggacaaggagcagtggaaggaggtgcacaagcaggtggtggagagcgcctacgaggtgatcaagctgaagggctacaccagctgggccatcggcctgagcgtggccgacctggccgagagcatcatgaagaacctgagaagagtgcaccccgtgagcaccatgatcaagggcctgtacggcatcaaggacgacgtgttcctgagcgtgccctgcatcctgggccagaacggcatcagcgacctggtgaaggtgaccctgaccagcgaggaggaggccagactgaagaagagcgccgacaccctgtggggcatccagaaggagctgcagttctag

SEQ ID NO: 11291 - DNA, 999 bp, Artificial Sequence; identical to SEQ ID NO: 11282
  Description of Artificial Sequence: Synthetic coding sequence

SEQ ID NO: 11292 - DNA, 474 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccgtggacatcctgacctacgtggcctggaagatcagcggcttccccaagaacagatag

SEQ ID NO: 11293 - DNA, 804 bp, Artificial Sequence
  Description of Artificial Sequence: Synthetic coding sequence
atgggcagcgcctgcatcaaggtgaccaagtacttcctgttcctgttcaacctgatcttcttcatcctgggcgccgtgatcctgggcttcggcgtgtggatcctggccgacaagagcagcttcatcagcgtgctgcagaccagcagcagcagcctgagaatgggcgcctacgtgttcatcggcgtgggcgccgtgaccatgctgatgggcttcctgggctgcatcggcgccgtgaacgaggtgagatgcctgctgggcctgtacttcgccttcctgctgctgatcctgatcgcccaggtgaccgccggcgccctgttctacttcaacatgggcaagctgaagcaggagatgggcggcatcgtgaccgagctgatcagagactacaacagcagcagagaggacagcctgcaggacgcctgggactacgtgcaggcccaggtgaagtgctgcggctgggtgagcttctacaactggaccgacaacgccgagctgatgaacagacccgaggtgacctacccctgcagctgcgaggtgaagggcgaggaggacaacagcctgagcgtgagaaagggcttctgcgaggcccccggcaacagaacccagagcggcaaccaccccgaggactggcccgtgtaccaggagggctgcatggagaaggtgcaggcctggctgcaggagaacctgggcatcatcctgggcgtgggcgtgggcgtggccatcatcgagctgctgggcatggtgctgagcatctgcctgtgcagacacgtgcacagcgaggactacagcaaggtgcccaagtactag

SEQ ID NO: 11294 - DNA, 3393 bp, Artificial Sequence
  Description of Artificial Sequence: Synthetic coding sequence
atgaagagaagcgagaagcccgagggctacagacagatgagacccaagaccttccccgccagcaactacaccgtgagcagcagacagatgctgcaggagatcagagagagcctgagaaacctgagcaagcccagcgacgccgccaaggccgagcacaacatgagcaagatgagcaccgaggaccccagacaggtgagaaacccccccaagttcggcacccaccacaaggccctgcaggagatcagaaacagcctgctgcccttcgccaacgagaccaacagcagcagaagcaccagcgaggtgaacccccagatgctgcaggacctgcaggccgccggcttcgacgaggacatggtgatccaggccctgcagaagaccaacaacagaagcatcgaggccgccatcgagttcatcagcaagatgagctaccaggaccccagaagagagcagatggccgccgccgccgccagacccatcaacgccagcatgaagcccggcaacgtgcagcagagcgtgaacagaaagcagagctggaagggcagcaaggagagcctggtgccccagagacacggcccccccctgggcgagagcgtggcctaccacagcgagagccccaacagccagaccgacgtgggcagacccctgagcggcagcggcatcagcgccttcgtgcaggcccaccccagcaacggccagagagtgaacccccccccccccccccaggtgagaagcgtgacccccccccccccccccagaggccagacccccccccccagaggcaccaccccccccccccccagctgggagcccaacagccagaccaagagatacagcggcaacatggagtacgtgatcagcagaatcagccccgtgccccccggcgcctggcaggagggctacccccccccccccctgaacaccagccccatgaacccccccaaccagggccagagaggcatcagcagcgtgcccgtgggcagacagcccatcatcatgcagagcagcagcaagttcaacttccccagcggcagacccggcatgcagaacggcaccggccagaccgacttcatgatccaccagaacgtggtgcccgccggcaccgtgaacagacagcccccccccccctaccccctgaccgccgccaacggccagagccccagcgccctgcagaccggcggcagcgccgcccccagcagctacaccaacggcagcatcccccagagcatgatggtgcccaacagaaacagccacaacatggagctgtacaacatcagcgtgcccggcctgcagaccaactggccccagagcagcagcgcccccgcccagagcagccccagcagcggccacgagatccccacctggcagcccaacatccccgtgagaagcaacagcttcaacaaccccctgggcaacagagccagccacagcgccaacagccagcccagcgccaccaccgtgaccgccatcacccccgcccccatccagcagcccgtgaagagcatgagagtgctgaagcccgagctgcagaccgccctggcccccacccaccccagctggatcccccagcccatccagaccgtgcagcccagccccttccccgagggcaccgccagcaacgtgaccgtgatgccccccgtggccgaggcccccaactaccagggccccccccccccctaccccaagcacctgctgcaccagaaccccagcgtgcccccctacgagagcatcagcaagcccagcaaggaggaccagcccagcctgcccaaggaggacgagagcgagaagagctacgagaacgtggacagcggcgacaaggagaagaagcagatcaccaccagccccatcaccgtgagaaagaacaagaaggacgaggagagaagagagagcagaatccagagctacagcccccaggccttcaagttcttcatggagcagcacgtggagaacgtgctgaagagccaccagcagagactgcacagaaagaagcagctggagaacgagatgatgagagtgggcctgagccaggacgcccaggaccagatgagaaagatgctgtgccagaaggagagcaactacatcagactgaagagagccaagatggacaagagcatgttcgtgaagatcaagaccctgggcatcggcgccttcggcgaggtgtgcctggccagaaaggtggacaccaaggccctgtacgccaccaagaccctgagaaagaaggacgtgctgctgagaaaccaggtggcccacgtgaaggccgagagagacatcctggccgaggccgacaacgagtgggtggtgagactgtactacagcttccaggacaaggacaacctgtacttcgtgatggactacatccccggcggcgacatgatgagcctgctgatcagaatgggcatcttccccgagagcctggccagattctacatcgccgagctgacctgcgccgtggagagcgtgcacaagatgggcttcatccacagagacatcaagcccgacaacatcctgatcgacagagacggccacatcaagctgaccgacttcggcctgtgcaccggcttcagatggacccacgacagcaagtactaccagagcggcgaccaccccagacaggacagcatggacttcagcaacgagtggggcgaccccagcagctgcagatgcggcgacagactgaagcccctggagagaagagccgccagacagcaccagagatgcctggcccacagcctggtgggcacccccaactacatcgcccccgaggtgctgctgagaaccggctacacccagctgtgcgactggtggagcgtgggcgtgatcctgttcgagatgctggtgggccagccccccttcctggcccagacccccctggagacccagatgaaggtgatcaactggcagaccagcctgcacatccccccccaggccaagctgagccccgaggccagcgacctgatcatcaagctgtgcagaggccccgaggacagactgggcaagaacggcgccgacgagatcaaggcccaccccttcttcaagaccatcgacttcagcagcgacctgagacagcagagcgccagctacatccccaagatcacccaccccaccgacaccagcaacttcgaccccgtggaccccgacaagctgtggagcgacgacaacgaggaggagaacgtgaacgacaccctgaacggctggtacaagaacggcaagcaccccgagcacgccttctacgagttcaccttcagaagattcttcgacgacaacggctacccctacaactaccccaagcccatcgagtacgagtacatcaacagccagggcagcgagcagcagagcgacgaggacgaccagaacaccggcagcgagatcaagaacagagacctggtgtacgtgtag

SEQ ID NO: 11295 - DNA, 2073 bp, Artificial Sequence
  Description of Artificial Sequence: Synthetic coding sequence
atgaagagaagcgagaagcccgagggctacagacagatgagacccaagaccttccccgccagcaactacaccgtgagcagcagacagatgctgcaggagatcagagagagcctgagaaacctgagcaagcccagcgacgccgccaaggccgagcacaacatgagcaagatgagcaccgaggaccccagacaggtgagaaacccccccaagttcggcacccaccacaaggccctgcaggagatcagaaacagcctgctgcccttcgccaacgagaccaacagcagcagaagcaccagcgaggtgaacccccagatgctgcaggacctgcaggccgccggcttcgacgaggacatggtgatccaggccctgcagaagaccaacaacagaagcatcgaggccgccatcgagttcatcagcaagatgagctaccaggaccccagaagagagcagatggccgccgccgccgccagacccatcaacgccagcatgaagcccggcaacgtgcagcagagcgtgaacagaaagcagagctggaagggcagcaaggagagcctggtgccccagagacacggcccccccctgggcgagagcgtggcctaccacagcgagagccccaacagccagaccgacgtgggcagacccctgagcggcagcggcatcagcgccttcgtgcaggcccaccccagcaacggccagagagtgaacccccccccccccccccaggtgagaagcgtgacccccccccccccccccagaggccagacccccccccccagaggcaccaccccccccccccccagctgggagcccaacagccagaccaagagatacagcggcaacatggagtacgtgatcagcagaatcagccccgtgccccccggcgcctggcaggagggctacccccccccccccctgaacaccagccccatgaacccccccaaccagggccagagaggcatcagcagcgtgcccgtgggcagacagcccatcatcatgcagagcagcagcaagttcaacttccccagcggcagacccggcatgcagaacggcaccggccagaccgacttcatgatccaccagaacgtggtgcccgccggcaccgtgaacagacagcccccccccccctaccccctgaccgccgccaacggccagagccccagcgccctgcagaccggcggcagcgccgcccccagcagctacaccaacggcagcatcccccagagcatgatggtgcccaacagaaacagccacaacatggagctgtacaacatcagcgtgcccggcctgcagaccaactggccccagagcagcagcgcccccgcccagagcagccccagcagcggccacgagatccccacctggcagcccaacatccccgtgagaagcaacagcttcaacaaccccctgggcaacagagccagccacagcgccaacagccagcccagcgccaccaccgtgaccgccatcacccccgcccccatccagcagcccgtgaagagcatgagagtgctgaagcccgagctgcagaccgccctggcccccacccaccccagctggatcccccagcccatccagaccgtgcagcccagccccttccccgagggcaccgccagcaacgtgaccgtgatgccccccgtggccgaggcccccaactaccagggccccccccccccctaccccaagcacctgctgcaccagaaccccagcgtgcccccctacgagagcatcagcaagcccagcaaggaggaccagcccagcctgcccaaggaggacgagagcgagaagagctacgagaacgtggacagcggcgacaaggagaagaagcagatcaccaccagccccatcaccgtgagaaagaacaagaaggacgaggagagaagagagagcagaatccagagctacagcccccaggccttcaagttcttcatggagcagcacgtggagaacgtgctgaagagccaccagcagagactgcacagaaagaagcagctggagaacgagatgatgagagtgaagcccttcaagatgagcatcttcatcctgaaccacctgttcgcctggtgcctgttctag

SEQ ID NO: 11296 - DNA, 3393 bp, Artificial Sequence; identical to SEQ ID NO: 11294
  Description of Artificial Sequence: Synthetic coding sequence

SEQ ID NO: 11297 - DNA, 3267 bp, Artificial Sequence
  Description of Artificial Sequence: Synthetic coding sequence
atgagacccaagaccttccccgccaccacctacagcggcaacagcagacagagactgcaggagatcagagagggcctgaagcagcccagcaagagcagcgtgcagggcctgcccgccggccccaacagcgacaccagcctggacgccaaggtgctgggcagcaaggacgccaccagacagcagcagcagatgagagccacccccaagttcggcccctaccagaaggccctgagagagatcagatacagcctgctgcccttcgccaacgagagcggcaccagcgccgccgccgaggtgaacagacagatgctgcaggagctggtgaacgccggctgcgaccaggagatggccggcagagccctgaagcagaccggcagcagaagcatcgaggccgccctggagtacatcagcaagatgggctacctggaccccagaaacgagcagatcgtgagagtgatcaagcagaccagccccggcaagggcctgatgcccacccccgtgaccagaagacccagcttcgagggcaccggcgacagcttcgccagctaccaccagctgagcggcaccccctacgagggccccagcttcggcgccgacggccccaccgccctggaggagatgcccagaccctacgtggactacctgttccccggcgtgggcccccacggccccggccaccagcaccagcacccccccaagggctacggcgccagcgtggaggccgccggcgcccacttccccctgcagggcgcccactacggcagaccccacctgctggtgcccggcgagcccctgggctacggcgtgcagagaagccccagcttccagagcaagaccccccccgagaccggcggctacgccagcctgcccaccaagggccagggcggcccccccggcgccggcctggccttccccccccccgccgccggcctgtacgtgccccacccccaccacaagcaggccggccccgccgcccaccagctgcacgtgctgggcagcagaagccaggtgttcgccagcgacagccccccccagagcctgctgacccccagcagaaacagcctgaacgtggacctgtacgagctgggcagcaccagcgtgcagcagtggcccgccgccaccctggccagaagagacagcctgcagaagcccggcctggaggccccccccagagcccacgtggccttcagacccgactgccccgtgcccagcagaaccaacagcttcaacagccaccagcccagacccggcccccccggcaaggccgagcccagcctgcccgcccccaacaccgtgaccgccgtgaccgccgcccacatcctgcaccccgtgaagagcgtgagagtgctgagacccgagccccagaccgccgtgggccccagccaccccgcctgggtgcccgcccccgcccccgcccccgcccccgcccccgcccccgccgccgagggcctggacgccaaggaggagcacgccctggccctgggcggcgccggcgccttccccctggacgtggagtacggcggccccgacagaagatgccccccccccccctaccccaagcacctgctgctgagaagcaagagcgagcagtacgacctggacagcctgtgcgccggcatggagcagagcctgagagccggccccaacgagcccgagggcggcgacaagagcagaaagagcgccaagggcgacaagggcggcaaggacaagaagcagatccagaccagccccgtgcccgtgagaaagaacagcagagacgaggagaagagagagagcagaatcaagagctacagcccctacgccttcaagttcttcatggagcagcacgtggagaacgtgatcaagacctaccagcagaaggtgaacagaagactgcagctggagcaggagatggccaaggccggcctgtgcgaggccgagcaggagcagatgagaaagatcctgtaccagaaggagagcaactacaacagactgaagagagccaagatggacaagagcatgttcgtgaagatcaagaccctgggcatcggcgccttcggcgaggtgtgcctggcctgcaaggtggacacccacgccctgtacgccatgaagaccctgagaaagaaggacgtgctgaacagaaaccaggtggcccacgtgaaggccgagagagacatcctggccgaggccgacaacgagtgggtggtgaagctgtactacagcttccaggacaaggacagcctgtacttcgtgatggactacatccccggcggcgacatgatgagcctgctgatcagaatggaggtgttccccgagcacctggccagattctacatcgccgagctgaccctggccatcgagagcgtgcacaagatgggcttcatccacagagacatcaagcccgacaacatcctgatcgacctggacggccacatcaagctgaccgacttcggcctgtgcaccggcttcagatggacccacaacagcaagtactaccagaagggcagccacgtgagacaggacagcatggagcccagcgacctgtgggacgacgtgagcaactgcagatgcggcgacagactgaagaccctggagcagagagccagaaagcagcaccagagatgcctggcccacagcctggtgggcacccccaactacatcgcccccgaggtgctgctgagaaagggctacacccagctgtgcgactggtggagcgtgggcgtgatcctgttcgagatgctggtgggccagccccccttcctggcccccacccccaccgagacccagctgaaggtgatcaactgggagaacaccctgcacatccccgcccaggtgaagctgagccccgaggccagagacctgatcaccaagctgtgctgcagcgccgaccacagactgggcagaaacggcgccgacgacctgaaggcccaccccttcttcagcgccatcgacttcagcagcgacatcagaaagcagcccgccccctacgtgcccaccatcagccaccccatggacaccagcaacttcgaccccgtggacgaggagagcccctggaacgacgccagcgagggcagcaccaaggcctgggacaccctgaccagccccaacaacaagcaccccgagcacgccttctacgagttcaccttcagaagattcttcgacgacaacggctaccccttcagatgccccaagcccagcggcgccgaggccagccaggccgagagcagcgacctggagagcagcgacctggtggaccagaccgagggctgccagcccgtgtacgtgtag

SEQ ID NO: 11298 - DNA, 3267 bp, Artificial Sequence; identical to SEQ ID NO: 11297
  Description of Artificial Sequence: Synthetic coding sequence

SEQ ID NO: 11299 - DNA, 972 bp, Artificial Sequence
  Description of Artificial Sequence: Synthetic coding sequence
atggcctacgtgcccgcccccggctaccagcccacctacaaccccaccctgccctactaccagcccatccccggcggcctgaacgtgggcatgagcgtgtacatccagggcgtggccagcgagcacatgaagagattcttcgtgaacttcgtggtgggccaggaccccggcagcgacgtggccttccacttcaaccccagattcgacggctgggacaaggtggtgttcaacaccctgcagggcggcaagtggggcagcgaggagagaaagagaagcatgcccttcaagaagggcgccgccttcgagctggtgttcatcgtgctggccgagcactacaaggtggtggtgaacggcaaccccttctacgagtacggccacagactgcccctgcagatggtgacccacctgcaggtggacggcgacctgcagctgcagagcatcaacttcatcggcggccagcccctgagaccccagggcccccccatgatgcccccctaccccggccccggccactgccaccagcagctgaacagcctgcccaccatggagggcccccccaccttcaacccccccgtgccctacttcggcagactgcagggcggcctgaccgccagaagaaccatcatcatcaagggctacgtgccccccaccggcaagagcttcgccatcaacttcaaggtgggcagcagcggcgacatcgccctgcacatcaaccccagaatgggcaacggcaccgtggtgagaaacagcctgctgaacggcagctggggcagcgaggagaagaagatcacccacaaccccttcggccccggccagttcttcgacctgagcatcagatgcggcctggacagattcaaggtgtacgccaacggccagcacctgttcgacttcgcccacagactgagcgccttccagagagtggacaccctggagatccagggcgacgtgaccctgagctacgtgcagatctag

SEQ ID NO: 11300 - DNA, 1530 bp, Artificial Sequence
  Description of Artificial Sequence: Synthetic coding sequence
atgaacaacgaggaggacctgctgcaggaggacagcaccagagacgagggcaacgagaccgaggccaacagcatgaacaccctgagaagaaccagaaagaaggtgaccaagccctacgtgtgcagcaccgaggtgggcgagaccgacatgagcaacagcaacgactgcatgagagacagcagccagatcctgacccccccccagctgagcagcagaatgaagcacatcagacaggccatggccaagaacagactgcagttcgtgagattcgaggccaccgacctgcacggcgtgagcagaagcaagaccatccccgcccacttcttccaggagaaggtgagccacggcgtgtgcatgcccagaggctacctggaggtgatccccaaccccaaggacaacgagatgaacaacatcagagccacctgcttcaacagcgacatcgtgctgatgcccgagctgagcaccttcagagtgctgccctgggccgacagaaccgccagagtgatctgcgacaccttcaccgtgaccggcgagcccctgctgaccagccccagatacatcgccaagagacagctgagccacctgcaggccagcggcttcagcctgctgagcgccttcatctacgacttctgcatcttcggcgtgcccgagatcctgaacagcaagatcatcagcttccccgccctgaccttcctgaacaaccacgaccagcccttcatgcaggagctggtggacggcctgtaccacaccggcgccaacgtggagagcttcagcagcagcaccagacccggccagatggagatcagcttcctgcccgagttcggcatcagcagcgccgacaacgccttcaccctgagaaccggcgtgaaggaggtggccagaaagtacaactacatcgccagcttcttcatcgagaccggcttctgcgacagcggcatcctgagccacagcctgtgggacgtggacagaaagaagaacatgttctgcagcaccagcggcaccgagcagctgaccatcaccggcaagaagtggctggccggcctgctgaagcacagcgccgccctgagctgcctgatggcccccagcgtgagctgcagaaagagatacagcaaggacagaaaggacctgaagaagagcgtgcccaccacctggggctacaacgacaacagctgcatcttcaacatcaagtgccacggcgagaagggcaccagaatcgagaacaagctgggcagcgccaccgccaacccctacctggtgctggccgccaccgtggccgccggcctggacggcctgcacagcagcaacgaggtgctggccggccccgacgagagcaccgacttctaccaggtggagcccagcgagatccccctgaagctggaggacgccctggtggccctggaggaggaccagtgcctgagacaggccctgggcgagaccttcatcagatacttcgtggccatgaagaagtacgagctggagaacgaggagatcgccgccgagagaaacaagttcctggagtacttcatctag

SEQ ID NO: 11301 - DNA, 627 bp, Artificial Sequence
  Description of Artificial Sequence: Synthetic coding sequence
atgaacaacgaggaggacctgctgcaggaggacagcaccagagacgagggcaacgagaccgaggccaacagcatgaacaccctgagaagaaccagaaagaaggtgaccaagccctacgtgtgcagcaccgaggtgggcgagaccgacatgagcaacagcaacgactgcatgagagacagcagccagatcctgacccccccccagctgagcagcagaatgaagcacatcagacaggccatggccaagaacagactgcagttcgtgagattcgaggccaccgacctgcacggcgtgagcagaagcaagaccatccccgcccacttcttccaggagaaggtgagccacggcgtgtgcatgcccagaggctacctggaggtgatccccaaccccaaggacaacgagatgaacaacatcagagccacctgcttcaacagcgacatcgtgctgatgcccgagctgagcaccttcagagtgctgccctgggccgacagaaccgccagagtgatctgcgacaccttcaccgtgaccgtgagcggcatgagcatcggcagaaagacctgcagcgccgccctgctggagctgagcagcagcagaagcctgggcaagaacggctggcaggacagctag

SEQ ID NO: 11302 - DNA, 504 bp, Artificial Sequence
  Description of Artificial Sequence: Synthetic coding sequence
atgcactggggcaccctgtgcggcttcctgtggctgtggccctacctgttctacgtgcaggccgtgcccatccagaaggtgcaggacgacaccaagaccctgatcaagaccatcgtgaccagaatcaacgacatcagccacacccagagcgtgagcagcaagcagaaggtgaccggcctggacttcatccccggcctgcaccccatcctgaccctgagcaagatggaccagaccctggccgtgtaccagcagatcctgaccagcatgcccagcagaaacgtgatccagatcagcaacgacctggagaacctgagagacctgctgcacgtgctggccttcagcaagagctgccacctgccctgggccagcggcctggagaccctggacagcctgggcggcgtgctggaggccagcggctacagcaccgaggtggtggccctgagcagactgcagggcagcctgcaggacatgctgtggcagctggacctgagccccggctgctag

SEQ ID NO: 11303 - DNA, 1791 bp, Artificial Sequence
  Description of Artificial Sequence: Synthetic coding sequence
atgggcagcgtgagcagcctgatcagcggccacagcttccacagcaagcactgcagagccagccagtacaagctgagaaagagcagccacctgaagaagctgaacagatacagcgacggcctgctgagattcggcttcagccaggacagcggccacggcaagagcagcagcaagatgggcaagagcgaggacttcttctacatcaaggtgagccagaaggccagaggcagccaccaccccgactacaccgccctgagcagcggcgacctgggcggccaggccggcgtggacttcgaccccagcaccccccccaagctgatgcccttcagcaaccagctggagatgggcagcgagaagggcgccgtgagacccaccgccttcaagcccgtgctgcccagaagcggcgccatcctgcacagcagccccgagagcgccagccaccagctgcaccccgccccccccgacaagcccaaggagcaggagctgaagcccggcctgtgcagcggcgccctgagcgacagcggcagaaacagcatgagcagcctgcccacccacagcaccagcagcagctaccagctggaccccctggtgacccccgtgggccccaccagcagattcggcggcagcgcccacaacatcacccagggcatcgtgctgcaggacagcaacatgatgagcctgaaggccctgagcttcagcgacggcggcagcaagctgggccacagcaacaaggccgacaagggccccagctgcgtgagaagccccatcagcaccgacgagtgcagcatccaggagctggagcagaagctgctggagagagagggcgccctgcagaagctgcagagaagcttcgaggagaaggagctggccagcagcctggcctacgaggagagacccagaagatgcagagacgagctggagggccccgagcccaagggcggcaacaagctgaagcaggccagccagaagagccagagagcccagcaggtgctgcacctgcaggtgctgcagctgcagcaggagaagagacagctgagacaggagctggagagcctgatgaaggagcaggacctgctggagaccaagctgagaagctacgagagagagaagaccagcttcggccccgccctggaggagacccagtgggaggtgtgccagaagagcggcgagatcagcctgctgaagcagcagctgaaggagagccagaccgaggtgaacgccaaggccagcgagatcctgggcctgaaggcccagctgaaggacaccagaggcaagctggagggcctggagctgagaacccaggacctggagggcgccctgagaaccaagggcctggagctggaggtgtgcgagaacgagctgcagagaaagaagaacgaggccgagctgctgagagagaaggtgaacctgctggagcaggagctgcaggagctgagagcccaggccgccctggccagagacatgggcccccccaccttccccgaggacgtgcccgccctgcagagagagctggagagactgagagccgagctgagagaggagagacagggccacgaccagatgagcagcggcttccagcacgagagactggtgtggaaggaggagaaggagaaggtgatccagtaccagaagcagctgcagcagagctacgtggccatgtaccagagaaaccagagactggagaaggccctgcagcagctggccagaggcgacagcgccggcgagcccctggaggtggacctggagggcgccgacatcccctacgaggacatcatcgccaccgagatctag

SEQ ID NO: 11304 - DNA, 231 bp, Artificial Sequence
  Description of Artificial Sequence: Synthetic coding sequence
atgggcagcgtgagcagcctgatcagcggccacagcttccacagcaagcactgcagagccagccagtacaagctgagaaagagcagccacctgaagaagctgaacagatacagcgacggcctgctgagattcggcttcagccaggacagcggccacggcaaggccatgaccagatgccccagagccagcagcatgagcggcagctgcggcagaagaagaagaagaagatag

SEQ ID NO: 11305 - DNA, 1722 bp, Artificial Sequence
  Description of Artificial Sequence: Synthetic coding sequence
atgggcagcgtgagcagcctgatcagcggccacagcttccacagcaagcactgcagagccagccagtacaagctgagaaagagcagccacctgaagaagctgaacagatacagcgacggcctgctgagattcggcttcagccaggacagcggccacggcaagagcagcagcaagatgggcaagagcgaggacttcttctacatcaaggtgagccagaaggccagaggcagccaccaccccgactacaccgccctgagcagcggcgacctgggcggccaggccggcgtggacttcgaccccagcaccccccccaagctgatgcccttcagcaaccagctggagatgggcagcgagaagggcgccgtgagacccaccgccttcaagcccgtgctgcccagaagcggcgccatcctgcacagcagccccgagagcgccagccaccagctgcaccccgccccccccgacaagcccaaggagcaggagctgaagcccggcctgtgcagcggcgccctgagcgacagcggcagaaacagcatgagcagcctgcccacccacagcaccagcagcagctaccagctggaccccctggtgacccccgtgggccccaccagcagattcggcggcagcgcccacaacatcacccagggcatcgtgctgcaggacagcaacatgatgagcctgaaggccctgagcttcagcgacggcggcagcaagctgggccacagcaacaaggccgacaagggccccagctgcgtgagaagccccatcagcaccgacgagtgcagcatccaggagctggagcagaagctgctggagagagagggcgccctgcagaagctgcagagaagcttcgaggagaaggagctggccagcagcctggcctacgaggagagacccagaagatgcagagacgagctggagggccccgagcccaagggcggcaacaagctgaagcaggccagccagaagagccagagagcccagcaggtgctgcacctgcaggtgctgcagctgcagcaggagaagagacagctgagacaggagctggagagcctgatgaaggagcaggacctgctggagaccaagctgagaagctacgagagagagaagaccagcttcggccccgccctggaggagacccagtgggaggtgtgccagaagagcggcgagatcagcctgctgaagcagcagctgaaggagagccagaccgaggtgaacgccaaggccagcgagatcctgggcctgaaggcccagctgaaggacaccagaggcaagctggagggcctggagctgagaacccaggacctggagggcgccctgagaaccaagggcctggagctggaggtgtgcgagaacgagctgcagagaaagaagaacgaggccgagctgctgagagagaaggtgaacctgctggagcaggagctgcaggagctgagagcccaggccgccctggccagagacatgggcccccccaccttccccgaggacgtgcccgccctgcagagagagctggagagactggtgtggaaggaggagaaggagaaggtgatccagtaccagaagcagctgcagcagagctacgtggccatgtaccagagaaaccagagactggagaaggccctgcagcagctggccagaggcgacagcgccggcgagcccctggaggtggacctggagggcgccgacatcccctacgaggacatcatcgccaccgagatctag

SEQ ID NO: 11306 - DNA, 1791 bp, Artificial Sequence; identical to SEQ ID NO: 11303
  Description of Artificial Sequence: Synthetic coding sequence

SEQ ID NO: 11307 - DNA, 1614 bp, Artificial Sequence
  Description of Artificial Sequence: Synthetic coding sequence
atgggcagcgtgagcagcctgatcagcggccacagcttccacagcaagcactgcagagccagccagtacaagctgagaaagagcagccacctgaagaagctgaacagatacagcgacggcctgctgagattcggcttcagccaggacagcggccacggcaagagcagcagcaagatgggcaagagcgaggacttcttctacatcaaggtgagccagaaggccagaggcagccaccaccccgactacaccgccctgagcagcggcgacctgggcggccaggccggcgtggacttcgaccccagcaccccccccaagctgatgcccttcagcaaccagctggagatgggcagcgagaagggcgccgtgagacccaccgccttcaagcccgtgctgcccagaagcggcgccatcctgcacagcagccccgagagcgccagccaccagctgcaccccgccccccccgacaagcccaaggagcaggagctgaagcccggcctgtgcagcggcgccctgagcgacagcggcagaaacagcatgagcagcctgcccacccacagcaccagcagcagctaccagctggaccccctggtgacccccgtgggccccaccagcagattcggcggcagcgcccacaacatcacccagggcatcgtgctgcaggacagcaacatgatgagcctgaaggccctgagcttcagcgacggcggcagcaagctgggccacagcaacaaggccgacaagggccccagctgcgtgagaagccccatcagcaccgacgagtgcagcatccaggagctggagcagaagctgctggagagagagggcgccctgcagaagctgcagagaagcttcgaggagaaggagctggccagcagcctggcctacgaggagagacccagaagatgcagagacgagctggagggccccgagcccaagggcggcaacaagctgaagcaggccagccagaagagccagagagcccagcaggtgctgcacctgcaggtgctgcagctgcagcaggagaagagacagctgagacaggagctggagagcctgatgaaggagcaggacctgctggagaccaagctgagaagctacgagagagagaagaccagcttcggccccgccctggaggagacccagtgggaggtgtgccagaagagcggcgagatcagcctgctgaagcagcagctgaaggagagccagaccgaggtgaacgccaaggccagcgagatcctgggcctgaaggcccagctgaaggacaccagaggcaagctggagggcctggagctgagaacccaggacctggagggcgccctgagaaccaagggcctggagctggaggtgtgcgagaacgagctgcagagaaagaagaacgaggccgagctgctgagagagaagcacgagagactggtgtggaaggaggagaaggagaaggtgatccagtaccagaagcagctgcagcagagctacgtggccatgtaccagagaaaccagagactggagaaggccctgcagcagctggccagaggcgacagcgccggcgagcccctggaggtggacctggagggcgccgacatcccctacgaggacatcatcgccaccgagatctag

SEQ ID NO: 11308 - DNA, 1005 bp, Artificial Sequence
  Description of Artificial Sequence: Synthetic coding sequence
atgaccgagaacagcgacaaggtgcccatcgccctggtgggccccgacgacgtggagttctgcagcccccccgcctacgccaccctgaccgtgaagcccagcagccccgccagactgctgaaggtgggcgccgtggtgctgatcagcggcgccgtgctgctgctgttcggcgccatcggcgccttctacttctggaagggcagcgacagccacatctacaacgtgcactacaccatgagcatcaacggcaagctgcaggacggcagcatggagatcgacgccggcaacaacctggagaccttcaagatgggcagcggcgccgaggaggccatcgccgtgaacgacttccagaacggcatcaccggcatcagattcgccggcggcgagaagtgctacatcaaggcccaggtgaaggccagaatccccgaggtgggcgccgtgaccaagcagagcatcagcagcaagctggagggcaagatcatgcccgtgaagtacgaggagaacagcctgatctgggtggccgtggaccagcccgtgaaggacaacagcttcctgagcagcaaggtgctggagctgtgcggcgacctgcccatcttctggctgaagcccacctaccccaaggagatccagagagagagaagagaggtggtgagaaagatcgtgcccaccaccaccaagagaccccacagcggccccagaagcaaccccggcgccggcagactgaacaacgagaccagacccagcgtgcaggaggacagccaggccttcaaccccgacaacccctaccaccagcaggagggcgagagcatgaccttcgaccccagactggaccacgagggcatctgctgcatcgagtgcagaagaagctacacccactgccagaagatctgcgagcccctgggcggctactacccctggccctacaactaccagggctgcagaagcgcctgcagagtgatcatgccctgcagctggtgggtggccagaatcctgggcatggtgtag

SEQ ID NO: 11309 - DNA, 390 bp, Artificial Sequence
  Description of Artificial Sequence: Synthetic coding sequence
atgagcatcaacggcaagctgcaggacggcagcatggagatcgacgccggcaacaacctggagaccttcaagatgggcagcggcgccgaggaggccatcgccgtgaacgacttccagaacggcatcaccggcatcagattcgccggcggcgagaagtgctacatcaaggcccaggtgaaggccagaatccccgaggtgggcgccgtgaccaagcagagcatcagcagcaagctggagggcaagatcatgcccgtgaagtacgaggagaacagcctgatctgggtggccgtggaccagcccgtgaaggacaacagcttcctgagcagcaaggtgctggagctgtgcggcgacctgcccatcttctggctgaagcccacctaccccaagtag

SEQ ID NO: 11310 - DNA, 1002 bp, Artificial Sequence
  Description of Artificial Sequence: Synthetic coding sequence
atgaccgagaacagcgacaaggtgcccatcgccctggtgggccccgacgacgtggagttctgcagcccccccgcctacgccaccctgaccgtgaagcccagcagccccgccagactgctgaaggtgggcgccgtggtgctgatcagcggcgccgtgctgctgctgttcggcgccatcggcgccttctacttctggaagggcagcgacagccacatctacaacgtgcactacaccatgagcatcaacggcaagctgcaggacggcagcatggagatcgacgccggcaacaacctggagaccttcaagatgggcagcggcgccgaggaggccatcgccgtgaacgacttccagaacggcatcaccggcatcagattcgccggcggcgagaagtgctacatcaaggcccaggtgaaggccagaatccccgaggtgggcgccgtgaccaagcagagcatcagcagcaagctggagggcaagatcatgcccgtgaagtacgaggagaacagcctgatctgggtggccgtggaccagcccgtgaaggacaacagcttcctgagcagcaaggtgctggagctgtgcggcgacctgcccatcttctggctgaagcccacctaccccaaggagatccagagagagagaagagaggtggtgagaaagatcgtgcccaccaccaccaagagaccccacagcggccccagaagcaaccccggcgccggcagactgaacaacgagaccagacccagcgtgcaggaggacagccaggccttcaaccccgacaacccctaccaccaggagggcgagagcatgaccttcgaccccagactggaccacgagggcatctgctgcatcgagtgcagaagaagctacacccactgccagaagatctgcgagcccctgggcggctactacccctggccctacaactaccagggctgcagaagcgcctgcagagtgatcatgccctgcagctggtgggtggccagaatcctgggcatggtgtag

SEQ ID NO: 11311 - DNA, 408 bp, Artificial Sequence
  Description of Artificial Sequence: Synthetic coding sequence
atgaacgaggtgatcatctacaacgtgctgctgctgagaaccatcagctgcatcagcgagacctacggccactacctgatccactgccccagcaagatcagccccgagctgctgaagaaggagagcatcaccaacagctacgcccacttccagatctacaacgtgcactacaccatgagcatcaacggcaagctgcaggacggcagcatggagatcgacgccggcaacaacctggagaccttcaagatgggcagcggcgccgaggaggccatcgccgtgaacgacttccagaacgtgagcatcttccacgccttcagagagttcaaccaggccagcctgagagacttcagcaacagcagaagaagcagcgtgagccacacccaccccaacggcaactgcagcctgtag

SEQ ID NO: 11312 - DNA, 2760 bp, Artificial Sequence
  Description of Artificial Sequence: Synthetic coding sequence
atgcagagaagcatcatgagcttcttccaccccaagaaggagggcaaggccaagaagcccgagaaggaggccagcaacagcagcagagagaccgagcccccccccaaggccgccctgaaggagtggaacggcgtggtgagcgagagcgacagccccgtgaagagacccggcagaaaggccgccagagtgctgggcagcgagggcgaggaggaggacgaggccctgagccccgccaagggccagaagcccgccctggactgcagccaggtgagcccccccagacccgccaccagccccgagaacaacgccagcctgagcgacaccagccccatggacagcagccccagcggcatccccaagagaagaaccgccagaaagcagctgcccaagagaaccatccaggaggtgctggaggagcagagcgaggacgaggacagagaggccaagagaaagaaggaggaggaggaggaggagacccccaaggagagcctgaccgaggccgaggtggccaccgagaaggagggcgaggacggcgaccagcccaccaccccccccaagcccctgaagaccagcaaggccgagacccccaccgagagcgtgagcgagcccgaggtggccaccaagcaggagctgcaggaggaggaggagcagaccaagccccccagaagagcccccaagaccctgagcagcttcttcacccccagaaagcccgccgtgaagaaggaggtgaaggaggaggagcccggcgcccccggcaaggagggcgccgccgagggccccctggaccccagcggctacaaccccgccaagaacaactaccaccccgtggaggacgcctgctggaagcccggccagaaggtgccctacctggccgtggccagaaccttcgagaagatcgaggaggtgagcgccagactgagaatggtggagaccctgagcaacctgctgagaagcgtggtggccctgagcccccccgacctgctgcccgtgctgtacctgagcctgaaccacctgggccccccccagcagggcctggagctgggcgtgggcgacggcgtgctgctgaaggccgtggcccaggccaccggcagacagctggagagcgtgagagccgaggccgccgagaagggcgacgtgggcctggtggccgagaacagcagaagcacccagagactgatgctgccccccccccccctgaccgccagcggcgtgttcagcaagttcagagacatcgccagactgaccggcagcgccagcaccgccaagaagatcgacatcatcaagggcctgttcgtggcctgcagacacagcgaggccagattcatcgccagaagcctgagcggcagactgagactgggcctggccgagcagagcgtgctggccgccctgagccaggccgtgagcctgaccccccccggccaggagttcccccccgccatggtggacgccggcaagggcaagaccgccgaggccagaaagacctggctggaggagcagggcatgatcctgaagcagaccttctgcgaggtgcccgacctggacagaatcatccccgtgctgctggagcacggcctggagagactgcccgagcactgcaagctgagccccggcatccccctgaagcccatgctggcccaccccaccagaggcatcagcgaggtgctgaagagattcgaggaggccgccttcacctgcgagtacaagtacgacggccagagagcccagatccacgccctggagggcggcgaggtgaagatcttcagcagaaaccaggaggacaacaccggcaagtaccccgacatcatcagcagaatccccaagatcaagctgcccagcgtgaccagcttcatcctggacaccgaggccgtggcctgggacagagagaagaagcagatccagcccttccaggtgctgaccaccagaaagagaaaggaggtggacgccagcgagatccaggtgcaggtgtgcctgtacgccttcgacctgatctacctgaacggcgagagcctggtgagagagcccctgagcagaagaagacagctgctgagagagaacttcgtggagaccgagggcgagttcgtgttcgccaccagcctggacaccaaggacatcgagcagatcgccgagttcctggagcagagcgtgaaggacagctgcgagggcctgatggtgaagaccctggacgtggacgccacctacgagatcgccaagagaagccacaactggctgaagctgaagaaggactacctggacggcgtgggcgacaccctggacctggtggtgatcggcgcctacctgggcagaggcaagagagccggcagatacggcggcttcctgctggccagctacgacgaggacagcgaggagctgcaggccatctgcaagctgggcaccggcttcagcgacgaggagctggaggagcaccaccagagcctgaaggccctggtgctgcccagccccagaccctacgtgagaatcgacggcgccgtgatccccgaccactggctggaccccagcgccgtgtgggaggtgaagtgcgccgacctgagcctgagccccatctaccccgccgccagaggcctggtggacagcgacaagggcatcagcctgagattccccagattcatcagagtgagagaggacaagcagcccgagcaggccaccaccagcgcccaggtggcctgcctgtacagaaagcagagccagatccagaaccagcagggcgaggacagcggcagcgaccccgaggacacctactag

SEQ ID NO: 11313 - DNA, 2667 bp, Artificial Sequence
  Description of Artificial Sequence: Synthetic coding sequence
atgcagagaagcatcatggccgccctgaaggagtggaacggcgtggtgagcgagagcgacagccccgtgaagagacccggcagaaaggccgccagagtgctgggcagcgagggcgaggaggaggacgaggccctgagccccgccaagggccagaagcccgccctggactgcagccaggtgagcccccccagacccgccaccagccccgagaacaacgccagcctgagcgacaccagccccatggacagcagccccagcggcatccccaagagaagaaccgccagaaagcagctgcccaagagaaccatccaggaggtgctggaggagcagagcgaggacgaggacagagaggccaagagaaagaaggaggaggaggaggagacccccaaggagagcctgaccgaggccgaggtggccaccgagaaggagggcgaggacggcgaccagcccaccaccccccccaagcccctgaagaccagcaaggccgagacccccaccgagagcgtgagcgagcccgaggtggccaccaagcaggagctgcaggaggaggaggagcagaccaagccccccagaagagcccccaagaccctgagcagcttcttcacccccagaaagcccgccgtgaagaaggaggtgaaggaggaggagcccggcgcccccggcaaggagggcgccgccgagggccccctggaccccagcggctacaaccccgccaagaacaactaccaccccgtggaggacgcctgctggaagcccggccagaaggtgccctacctggccgtggccagaaccttcgagaagatcgaggaggtgagcgccagactgagaatggtggagaccctgagcaacctgctgagaagcgtggtggccctgagcccccccgacctgctgcccgtgctgtacctgagcctgaaccacctgggccccccccagcagggcctggagctgggcgtgggcgacggcgtgctgctgaaggccgtggcccaggccaccggcagacagctggagagcgtgagagccgaggccgccgagaagggcgacgtgggcctggtggccgagaacagcagaagcacccagagactgatgctgccccccccccccctgaccgccagcggcgtgttcagcaagttcagagacatcgccagactgaccggcagcgccagcaccgccaagaagatcgacatcatcaagggcctgttcgtggcctgcagacacagcgaggccagattcatcgccagaagcctgagcggcagactgagactgggcctggccgagcagagcgtgctggccgccctgagccaggccgtgagcctgaccccccccggccaggagttcccccccgccatggtggacgccggcaagggcaagaccgccgaggccagaaagacctggctggaggagcagggcatgatcctgaagcagaccttctgcgaggtgcccgacctggacagaatcatccccgtgctgctggagcacggcctggagagactgcccgagcactgcaagctgagccccggcatccccctgaagcccatgctggcccaccccaccagaggcatcagcgaggtgctgaagagattcgaggaggccgccttcacctgcgagtacaagtacgacggccagagagcccagatccacgccctggagggcggcgaggtgaagatcttcagcagaaaccaggaggacaacaccggcaagtaccccgacatcatcagcagaatccccaagatcaagctgcccagcgtgaccagcttcatcctggacaccgaggccgtggcctgggacagagagaagaagcagatccagcccttccaggtgctgaccaccagaaagagaaaggaggtggacgccagcgagatccaggtgcaggtgtgcctgtacgccttcgacctgatctacctgaacggcgagagcctggtgagagagcccctgagcagaagaagacagctgctgagagagaacttcgtggagaccgagggcgagttcgtgttcgccaccagcctggacaccaaggacatcgagcagatcgccgagttcctggagcagagcgtgaaggacagctgcgagggcctgatggtgaagaccctggacgtggacgccacctacgagatcgccaagagaagccacaactggctgaagctgaagaaggactacctggacggcgtgggcgacaccctggacctggtggtgatcggcgcctacctgggcagaggcaagagagccggcagatacggcggcttcctgctggccagctacgacgaggacagcgaggagctgcaggccatctgcaagctgggcaccggcttcagcgacgaggagctggaggagcaccaccagagcctgaaggccctggtgctgcccagccccagaccctacgtgagaatcgacggcgccgtgatccccgaccactggctggaccccagcgccgtgtgggaggtgaagtgcgccgacctgagcctgagccccatctaccccgccgccagaggcctggtggacagcgacaagggcatcagcctgagattccccagattcatcagagtgagagaggacaagcagcccgagcaggccaccaccagcgcccaggtggcctgcctgtacagaaagcagagccagatccagaaccagcagggcgaggacagcggcagcgaccccgaggacacctactag

SEQ ID NO: 11314 - DNA, 2556 bp, Artificial Sequence
  Description of Artificial Sequence: Synthetic coding sequence
atgcagagaagcatcatgagcttcttccaccccaagaaggagggcaaggccaagaagcccgagaaggaggccagcaacagcagcagagagaccgagcccccccccaaggccgccctgaaggagtggaacggcgtggtgagcgagagcgacagccccgtgaagagacccggcagaaaggccgccagagtgctgggcagcgagggcgaggaggaggacgaggccctgagccccgccaagggccagaagcccgccctggactgcagccaggtgagcccccccagacccgccaccagccccgagaacaacgccagcctgagcgacaccagccccatggacagcagccccagcggcatccccaagagaagaaccgaggccgagacccccaccgagagcgtgagcgagcccgaggtggccaccaagcaggagctgcaggaggaggaggagcagaccaagccccccagaagagcccccaagaccctgagcagcttcttcacccccagaaagcccgccgtgaagaaggaggtgaaggaggaggagcccggcgcccccggcaaggagggcgccgccgagggccccctggaccccagcggctacaaccccgccaagaacaactaccaccccgtggaggacgcctgctggaagcccggccagaaggtgccctacctggccgtggccagaaccttcgagaagatcgaggaggtgagcgccagactgagaatggtggagaccctgagcaacctgctgagaagcgtggtggccctgagcccccccgacctgctgcccgtgctgtacctgagcctgaaccacctgggccccccccagcagggcctggagctgggcgtgggcgacggcgtgctgctgaaggccgtggcccaggccaccggcagacagctggagagcgtgagagccgaggccgccgagaagggcgacgtgggcctggtggccgagaacagcagaagcacccagagactgatgctgccccccccccccctgaccgccagcggcgtgttcagcaagttcagagacatcgccagactgaccggcagcgccagcaccgccaagaagatcgacatcatcaagggcctgttcgtggcctgcagacacagcgaggccagattcatcgccagaagcctgagcggcagactgagactgggcctggccgagcagagcgtgctggccgccctgagccaggccgtgagcctgaccccccccggccaggagttcccccccgccatggtggacgccggcaagggcaagaccgccgaggccagaaagacctggctggaggagcagggcatgatcctgaagcagaccttctgcgaggtgcccgacctggacagaatcatccccgtgctgctggagcacggcctggagagactgcccgagcactgcaagctgagccccggcatccccctgaagcccatgctggcccaccccaccagaggcatcagcgaggtgctgaagagattcgaggaggccgccttcacctgcgagtacaagtacgacggccagagagcccagatccacgccctggagggcggcgaggtgaagatcttcagcagaaaccaggaggacaacaccggcaagtaccccgacatcatcagcagaatccccaagatcaagctgcccagcgtgaccagcttcatcctggacaccgaggccgtggcctgggacagagagaagaagcagatccagcccttccaggtgctgaccaccagaaagagaaaggaggtggacgccagcgagatccaggtgcaggtgtgcctgtacgccttcgacctgatctacctgaacggcgagagcctggtgagagagcccctgagcagaagaagacagctgctgagagagaacttcgtggagaccgagggcgagttcgtgttcgccaccagcctggacaccaaggacatcgagcagatcgccgagttcctggagcagagcgtgaaggacagctgcgagggcctgatggtgaagaccctggacgtggacgccacctacgagatcgccaagagaagccacaactggctgaagctgaagaaggactacctggacggcgtgggcgacaccctggacctggtggtgatcggcgcctacctgggcagaggcaagagagccggcagatacggcggcttcctgctggccagctacgacgaggacagcgaggagctgcaggccatctgcaagctgggcaccggcttcagcgacgaggagctggaggagcaccaccagagcctgaaggccctggtgctgcccagccccagaccctacgtgagaatcgacggcgccgtgatccccgaccactggctggaccccagcgccgtgtgggaggtgaagtgcgccgacctgagcctgagccccatctaccccgccgccagaggcctggtggacagcgacaagggcatcagcctgagattccccagattcatcagagtgagagaggacaagcagcccgagcaggccaccaccagcgcccaggtggcctgcctgtacagaaagcagagccagatccagaaccagcagggcgaggacagcggcagcgaccccgaggacacctactag

SEQ ID NO: 11315 - DNA, 1248 bp, Artificial Sequence
  Description of Artificial Sequence: Synthetic coding sequence
atgcagagaagcatcatgagcttcttccaccccaagaaggagggcaaggccaagaagcccgagaaggaggccagcaacagcagcagagagaccgagcccccccccaaggccgccctgaaggagtggaacggcgtggtgagcgagagcgacagccccgtgaagagacccggcagaaaggccgccagagtgctgggcagcgagggcgaggaggaggacgaggccctgagccccgccaagggccagaagcccgccctggactgcagccaggtgagcccccccagacccgccaccagccccgagaacaacgccagcctgagcgacaccagccccatggacagcagccccagcggcatccccaagagaagaaccgaggaggagacccccaaggagagcctgaccgaggccgaggtggccaccgagaaggagggcgaggacggcgaccagcccaccaccccccccaagcccctgaagaccagcaaggccgagacccccaccgagagcgtgagcgagcccgaggtggccaccaagcaggagctgcaggaggaggaggagcagaccaagccccccagaagagcccccaagaccctgagcagcttcttcacccccagaaagcccgccgtgaagaaggaggtgaaggaggaggagcccggcgcccccggcaaggagggcgccgccgagggccccctggaccccagcggctacaaccccgccaagaacaactaccaccccgtggaggacgcctgctggaagcccggccagaaggtgccctacctggccgtggccagaaccttcgagaagatcgaggaggtgagcgccagactgagaatggtggagaccctgagcaacctgctgagaagcgtggtggccctgagcccccccgacctgctgcccgtgctgtacctgagcctgaaccacctgggccccccccagcagggcctggagctgggcgtgggcgacggcgtgctgctgaaggccgtggcccaggccaccggcagagagagaagagagaccagaagccacaactgccaccccagacacccccaccccagaagccccctgaaggtgggcagctggagccccagcggcctgagacagcccagaaaggccacctggggctggtggcccagaaccgccgccgcccccagaggcagctgctgccaccacctgagaagcctgccccccggcagcagcgccagcagcgccaccagccccggcagcctggccgtgctgccccagcccagaagatag

SEQ ID NO: 11316 - DNA, 2499 bp, Artificial Sequence
  Description of Artificial Sequence: Synthetic coding sequence
gtgtgctgccccggcagcggcgccagagaccagagaaaggccagactgaccgacgaggagaagtgctggaccggcagagagaacagcgacgccaacatgcagagaagcatcatgagcttcttccaccccaagaaggagggcaaggccaagaagcccgagaaggaggccagcaacagcagcagagagaccgagcccccccccaaggccgccctgaaggagtggaacggcgtggtgagcgagagcgacagccccgtgaagagacccggcagaaaggccgccagagtgctgggcagcgagggcgaggaggaggacgaggccctgagccccgccaagggccagaagcccgccctggactgcagccaggtgagcccccccagacccgccaccagccccgagaacaacgccagcctgagcgacaccagccccatggacagcagccccagcggcatccccaagagaagaaccgccagaaagcagctgcccaagagaaccatccaggaggtgctggaggagcagagcgaggacgaggacagagaggccaagagaaagaaggaggaggaggaggagacccccaaggagagcctgaccgaggccgaggtggccaccgagaaggagggcgaggacggcgaccagcccaccaccccccccaagcccctgaagaccagcaaggccgagacccccaccgagagcgtgagcgagcccgaggtggccaccaagcaggagctgcaggaggaggaggagcagaccaagccccccagaagagcccccaagaccctgagcagcttcttcacccccagaaagcccgccgtgaagaaggaggtgaaggaggaggagcccggcgcccccggcaaggagggcgccgccgagggccccctggaccccagcggctacaaccccgccaagaacaactaccaccccgtggaggacgcctgctggaagcccggccagaaggtgccctacctggccgtggccagaaccttcgagaagatcgaggaggtgagcgccagactgagaatggtggagaccctgagcaacctgctgagaagcgtggtggccctgagcccccccgacctgctgcccgtgctgtacctgagcctgaaccacctgggccccccccagcagggcctggagctgggcgtgggcgacggcgtgctgctgaaggccgtggcccaggccaccggcagacagctggagagcgtgagagccgaggccgccgagaagggcgacgtgggcctggtggccgagaacagcagaagcacccagagactgatgctgccccccccccccctgaccgccagcggcgtgttcagcaagttcagagacatcgccagactgaccggcagcgccagcaccgccaagaagatcgacatcatcaagggcctgttcgtggcctgcagacacagcgaggccagattcatcgccagaagcctgagcggcagactgagactgggcctggccgagcagagcgtgctggccgccctgagccaggccgtgagcctgaccccccccggccaggagttcccccccgccatggtggacgccggcaagggcaagaccgccgaggccagaaagacctggctggaggagcagggcatgatcctgaagcagaccttctgcgaggtgcccgacctggacagaatcatccccgtgctgctggagcacggcctggagagactgcccgagcactgcaagctgagccccggcatccccctgaagcccatgctggcccaccccaccagaggcatcagcgaggtgctgaagagattcgaggaggccgccttcacctgcgagtacaagtacgacggccagagagcccagatccacgccctggagggcggcgaggtgaagatcttcagcagaaaccaggaggacaacaccggcaagtaccccgacatcatcagcagaatccccaagatcaagctgcccagcgtgaccagcttcatcctggacaccgaggccgtggcctgggacagagagaagaagcagatccagcccttccaggtgctgaccaccagaaagagaaaggaggtggacgccagcgagatccaggtgcaggtgtgcctgtacgccttcgacctgatctacctgaacggcgagagcctggtgagagagcccctgagcagaagaagacagctgctgagagagaacttcgtggagaccgagggcgagttcgtgttcgccaccagcctggacaccaaggacatcgagcagatcgccgagttcctggagcagagcgtgaaggacagctgcgagggcctgatggtgaagaccctggacgtggacgccacctacgagatcgccaagagaagccacaactggctgaagctgaagaaggactacctggacggcgtgggcgacaccctggacctggtggtgatcggcgcctacctgggcagaggcaagagagccggcagatacggcggcttcctgctggccagctacgacgaggacagcgaggagctgcaggccatctgcaaggtgctgggcaactggggctag

SEQ ID NO: 11317 - DNA, 2850 bp, Artificial Sequence
  Description of Artificial Sequence: Synthetic coding sequence
atgagcctggccttcaagatcttcttcccccagaccctgagagccctgagcagaaaggagctgtgcctgttcagaaagcaccactggagagacgtgagacagttcagccagtggagcgagaccgacctgctgcacggccaccccctgttcctgagaagaaagcccgtgctgagcttccagggcagccacctgagaagcagagccacctacctggtgttcctgcccggcctgcacgtgggcctgtgcagcggcccctgcgagatggccgagcagagattctgcgtggactacgccaagagaggcaccgccggctgcaagaagtgcaaggagaagatcgtgaagggcgtgtgcagaatcggcaaggtggtgcccaaccccttcagcgagagcggcggcgacatgaaggagtggtaccacatcaagtgcatgttcgagaagctggagagagccagagccaccaccaagaagatcgaggacctgaccgagctggagggctgggaggagctggaggacaacgagaaggagcagatcacccagcacatcgccgacctgagcagcaaggccgccggcacccccaagaagaaggccgtggtgcaggccaagctgaccaccaccggccaggtgaccagccccgtgaagggcgccagcttcgtgaccagcaccaaccccagaaagttcagcggcttcagcgccaagcccaacaacagcggcgaggcccccagcagccccacccccaagagaagcctgagcagcagcaagtgcgaccccagacacaaggactgcctgctgagagagttcagaaagctgtgcgccatggtggccgacaaccccagctacaacaccaagacccagatcatccaggacttcctgagaaagggcagcgccggcgacggcttccacggcgacgtgtacctgaccgtgaagctgctgctgcccggcgtgatcaagaccgtgtacaacctgaacgacaagcagatcgtgaagctgttcagcagaatcttcaactgcaaccccgacgacatggccagagacctggagcagggcgacgtgagcgagaccatcagagtgttcttcgagcagagcaagagcttcccccccgccgccaagagcctgctgaccatccaggaggtggacgagttcctgctgagactgagcaagctgaccaaggaggacgagcagcagcaggccctgcaggacatcgccagcagatgcaccgccaacgacctgaagtgcatcatcagactgatcaagcacgacctgaagatgaacagcggcgccaagcacgtgctggacgccctggaccccaacgcctacgaggccttcaaggccagcagaaacctgcaggacgtggtggagagagtgctgcacaacgcccaggaggtggagaaggagcccggccagagaagagccctgagcgtgcaggccagcctgatgacccccgtgcagcccatgctggccgaggcctgcaagagcgtggagtacgccatgaagaagtgccccaacggcatgttcagcgagatcaagtacgacggcgagagagtgcaggtgcacaagaacggcgaccacttcagctacttcagcagaagcctgaagcccgtgctgccccacaaggtggcccacttcaaggactacatcccccaggccttccccggcggccacagcatgatcctggacagcgaggtgctgctgatcgacaacaagaccggcaagcccctgcccttcggcaccctgggcgtgcacaagaaggccgccttccaggacgccaacgtgtgcctgttcgtgttcgactgcatctacttcaacgacgtgagcctgatggacagacccctgtgcgagagaagaaagttcctgcacgacaacatggtggagatccccaacagaatcatgttcagcgagatgaagagagtgaccaaggccctggacctggccgacatgatcaccagagtgatccaggagggcctggagggcctggtgctgaaggacgtgaagggcacctacgagcccggcaagagacactggctgaaggtgaagaaggactacctgaacgagggcgccatggccgacaccgccgacctggtggtgctgggcgccttctacggccagggcagcaagggcggcatgatgagcatcttcctgatgggctgctacgaccccggcagccagaagtggtgcaccgtgaccaagtgcgccggcggccacgacgacgccaccctggccagactgcagaacgagctggacatggtgaagatcagcaaggaccccagcaagatccccagctggctgaaggtgaacaagatctactaccccgacttcatcgtgcccgaccccaagaaggccgccgtgtgggagatcaccggcgccgagttcagcaagagcgaggcccacaccgccgacggcatcagcatcagattccccagatgcaccagaatcagagacgacaaggactggaagagcgccaccaacctgccccagctgaaggagctgtaccagctgagcaaggagaaggccgacttcaccgtggtggccggcgacgagggcagcagcaccaccggcggcagcagcgaggagaacaagggccccagcggcagcgccgtgagcagaaaggcccccagcaagcccagcgccagcaccaagaaggccgagggcaagctgagcaacagcaacagcaaggacggcaacatgcagaccgccaagcccagcgccatgaaggtgggcgagaagctggccaccaagagcagccccgtgaaggtgggcgagaagagaaaggccgccgacgagaccctgtgccagaccaagagaagacccgccagcgagcagagaggcagaaccgtgcccgccggcagaagatag

SEQ ID NO: 11318 - DNA, 3030 bp, Artificial Sequence
  Description of Artificial Sequence: Synthetic coding sequence
atgagcctggccttcaagatcttcttcccccagaccctgagagccctgagcagaaaggagctgtgcctgttcagaaagcaccactggagagacgtgagacagttcagccagtggagcgagaccgacctgctgcacggccaccccctgttcctgagaagaaagcccgtgctgagcttccagggcagccacctgagaagcagagccacctacctggtgttcctgcccggcctgcacgtgggcctgtgcagcggcccctgcgagatggccgagcagagattctgcgtggactacgccaagagaggcaccgccggctgcaagaagtgcaaggagaagatcgtgaagggcgtgtgcagaatcggcaaggtggtgcccaaccccttcagcgagagcggcggcgacatgaaggagtggtaccacatcaagtgcatgttcgagaagctggagagagccagagccaccaccaagaagatcgaggacctgaccgagctggagggctgggaggagctggaggacaacgagaaggagcagatcacccagcacatcgccgacctgagcagcaaggccgccggcacccccaagaagaaggccgtggtgcaggccaagctgaccaccaccggccaggtgaccagccccgtgaagggcgccagcttcgtgaccagcaccaaccccagaaagttcagcggcttcagcgccaagcccaacaacagcggcgaggcccccagcagccccacccccaagagaagcctgagcagcagcaagtgcgaccccagacacaaggactgcctgctgagagagttcagaaagctgtgcgccatggtggccgacaaccccagctacaacaccaagacccagatcatccaggacttcctgagaaagggcagcgccggcgacggcttccacggcgacgtgtacctgaccgtgaagctgctgctgcccggcgtgatcaagaccgtgtacaacctgaacgacaagcagatcgtgaagctgttcagcagaatcttcaactgcaaccccgacgacatggccagagacctggagcagggcgacgtgagcgagaccatcagagtgttcttcgagcagagcaagagcttcccccccgccgccaagagcctgctgaccatccaggaggtggacgagttcctgctgagactgagcaagctgaccaaggaggacgagcagcagcaggccctgcaggacatcgccagcagatgcaccgccaacgacctgaagtgcatcatcagactgatcaagcacgacctgaagatgaacagcggcgccaagcacgtgctggacgccctggaccccaacgcctacgaggccttcaaggccagcagaaacctgcaggacgtggtggagagagtgctgcacaacgcccaggaggtggagaaggagcccggccagagaagagccctgagcgtgcaggccagcctgatgacccccgtgcagcccatgctggccgaggcctgcaagagcgtggagtacgccatgaagaagtgccccaacggcatgttcagcgagatcaagtacgacggcgagagagtgcaggtgcacaagaacggcgaccacttcagctacttcagcagaagcctgaagcccgtgctgccccacaaggtggcccacttcaaggactacatcccccaggccttccccggcggccacagcatgatcctggacagcgaggtgctgctgatcgacaacaagaccggcaagcccctgcccttcggcaccctgggcgtgcacaagaaggccgccttccaggacgccaacgtgtgcctgttcgtgttcgactgcatctacttcaacgacgtgagcctgatggacagacccctgtgcgagagaagaaagttcctgcacgacaacatggtggagatccccaacagaatcatgttcagcgagatgaagagagtgaccaaggccctggacctggccgacatgatcaccagagtgatccaggagggcctggagggcctggtgctgaaggacgtgaagggcacctacgagcccggcaagagacactggctgaaggtgaagaaggactacctgaacgagggcgccatggccgacaccgccgacctggtggtgctgggcgccttctacggccagggcagcaagggcggcatgatgagcatcttcctgatgggctgctacgaccccggcagccagaagtggtgcaccgtgaccaagtgcgccggcggccacgacgacgccaccctggccagactgcagaacgagctggacatggtgaagatcagcaaggaccccagcaagatccccagctggctgaaggtgaacaagatctactaccccgacttcatcgtgcccgaccccaagaaggccgccgtgtgggagatcaccggcgccgagttcagcaagagcgaggcccacaccgccgacggcatcagcatcagattccccagatgcaccagaatcagagacgacaaggactggaagagcgccaccaacctgccccagctgaaggagctgtaccagctgagcaaggagaaggccgacttcaccgtggtggccggcgacgagggcagcagcaccaccggcggcagcagcgaggagaacaagggccccagcggcagcgccgtgagcagaaaggcccccagcaagcccagcgccagcaccaagaaggccgagggcaagctgagcaacagcaacagcaaggacggcaacatgcagaccgccaagcccagcgccatgaaggtgggcgagaagctggccaccaagagcagccccgtgaaggtgggcgagaagagaaaggccgccgacgagaccctgtgccagaccaaggtgctgctggacatcttcaccggcgtgagactgtacctgccccccagcacccccgacttcagcagactgagaagatacttcgtggccttcgacggcgacctggtgcaggagttcgacatgaccagcgccacccacgtgctgggcagcagagacaagaaccccgccgcccagcaggtgagccccgagtggatctgggcctgcatcagaaagagaagactggtggccccctgctag

SEQ ID NO: 11319 - DNA, 2736 bp, Artificial Sequence
  Description of Artificial Sequence: Synthetic coding sequence
atggccgccagccagaccagccagaccgtggccagccacgtgcccttcgccgacctgtgcagcaccctggagagaatccagaagagcaagggcagagccgagaagatcagacacttcagagagttcctggacagctggagaaagttccacgacgccctgcacaagaaccacaaggacgtgaccgacagcttctaccccgccatgagactgatcctgccccagctggagagagagagaatggcctacggcatcaaggagaccatgctggccaagctgtacatcgagctgctgaacctgcccagagacggcaaggacgccctgaagctgctgaactacagaacccccaccggcacccacggcgacgccggcgacttcgccatgatcgcctacttcgtgctgaagcccagatgcctgcagaagggcagcctgaccatccagcaggtgaacgacctgctggacagcatcgccagcaacaacagcgccaagagaaaggacctgatcaagaagagcctgctgcagctgatcacccagagcagcgccctggagcagaagtggctgatcagaatgatcatcaaggacctgaagctgggcgtgagccagcagaccatcttcagcgtgttccacaacgacgccgccgagctgcacaacgtgaccaccgacctggagaaggtgtgcagacagctgcacgaccccagcgtgggcctgagcgacatcagcatcaccctgttcagcgccttcaagcccatgctggccgccatcgccgacatcgagcacatcgagaaggacatgaagcaccagagcttctacatcgagaccaagctggacggcgagagaatgcagatgcacaaggacggcgacgtgtacaagtacttcagcagaaacggctacaactacaccgaccagttcggcgccagccccaccgagggcagcctgacccccttcatccacaacgccttcaaggccgacatccagatctgcatcctggacggcgagatgatggcctacaaccccaacacccagaccttcatgcagaagggcaccaagttcgacatcaagagaatggtggaggacagcgacctgcagacctgctactgcgtgttcgacgtgctgatggtgaacaacaagaagctgggccacgagaccctgagaaagagatacgagatcctgagcagcatcttcacccccatccccggcagaatcgagatcgtgcagaagacccaggcccacaccaagaacgaggtgatcgacgccctgaacgaggccatcgacaagagagaggagggcatcatggtgaagcagcccctgagcatctacaagcccgacaagagaggcgagggctggctgaagatcaagcccgagtacgtgagcggcctgatggacgagctggacatcctgatcgtgggcggctactggggcaagggcagcagaggcggcatgatgagccacttcctgtgcgccgtggccgagaagcccccccccggcgagaagcccagcgtgttccacaccctgagcagagtgggcagcggctgcaccatgaaggagctgtacgacctgggcctgaagctggccaagtactggaagcccttccacagaaaggccccccccagcagcatcctgtgcggcaccgagaagcccgaggtgtacatcgagccctgcaacagcgtgatcgtgcagatcaaggccgccgagatcgtgcccagcgacatgtacaagaccggctgcaccctgagattccccagaatcgagaagatcagagacgacaaggagtggcacgagtgcatgaccctggacgacctggagcagctgagaggcaaggccagcggcaagctggccagcaagcacctgtacatcggcggcgacgacgagccccaggagaagaagagaaaggccgcccccaagatgaagaaggtgatcggcatcatcgagcacctgaaggcccccaacctgaccaacgtgaacaagatcagcaacatcttcgaggacgtggagttctgcgtgatgagcggcaccgacagccagcccaagcccgacctggagaacagaatcgccgagttcggcggctacatcgtgcagaaccccggccccgacacctactgcgtgatcgccggcagcgagaacatcagagtgaagaacatcatcctgagcaacaagcacgacgtggtgaagcccgcctggctgctggagtgcttcaagaccaagagcttcgtgccctggcagcccagattcatgatccacatgtgccccagcaccaaggagcacttcgccagagagtacgactgctacggcgacagctacttcatcgacaccgacctgaaccagctgaaggaggtgttcagcggcatcaagaacagcaacgagcagacccccgaggagatggccagcctgatcgccgacctggagtacagatacagctgggactgcagccccctgagcatgttcagaagacacaccgtgtacctggacagctacgccgtgatcaacgacctgagcaccaagaacgagggcaccagactggccatcaaggccctggagctgagattccacggcgccaaggtggtgagctgcctggccgagggcgtgagccacgtgatcatcggcgaggaccacagcagagtggccgacttcaaggccttcagaagaaccttcaagagaaagttcaagatcctgaaggagagctgggtgaccgacagcatcgacaagtgcgagctgcaggaggagaaccagtacctgatctag

SEQ ID NO: 11320 - DNA, 2736 bp, Artificial Sequence; identical to SEQ ID NO: 11319
  Description of Artificial Sequence: Synthetic coding sequence

SEQ ID NO: 11321 - DNA, 2736 bp, Artificial Sequence; identical to SEQ ID NO: 11319
  Description of Artificial Sequence: Synthetic coding sequence

SEQ ID NO: 11322 - DNA, 1944 bp, Artificial Sequence
  Description of Artificial Sequence: Synthetic coding sequence
atgagactgaccctgctgtgctgcacctggagagaggagagaatgggcgaggagggcagcgagctgcccgtgtgcgccagctgcggccagagaatctacgacggccagtacctgcaggccctgaacgccgactggcacgccgactgcttcagatgctgcgactgcagcgccagcctgagccaccagtactacgagaaggacggccagctgttctgcaagaaggactactgggccagatacggcgagagctgccacggctgcagcgagcagatcaccaagggcctggtgatggtggccggcgagctgaagtaccaccccgagtgcttcatctgcctgacctgcggcaccttcatcggcgacggcgacacctacaccctggtggagcacagcaagctgtactgcggccactgctactaccagaccgtggtgacccccgtgatcgagcagatcctgcccgacagccccggcagccacctgccccacaccgtgaccctggtgagcatccccgccagcagccacggcaagagaggcctgagcgtgagcatcgaccccccccacggcccccccggctgcggcaccgagcacagccacaccgtgagagtgcagggcgtggaccccggctgcatgagccccgacgtgaagaacagcatccacgtgggcgacagaatcctggagatcaacggcacccccatcagaaacgtgcccctggacgagatcgacctgctgatccaggagaccagcagactgctgcagctgaccctggagcacgacccccacgacaccctgggccacggcctgggccccgagaccagccccctgagcagccccgcctacacccccagcggcgaggccggcagcagcgccagacagaagcccgtgctgagaagctgcagcatcgacagaagccccggcgccggcagcctgggcagccccgccagccagagaaaggacctgggcagaagcgagagcctgagagtggtgtgcagaccccacagaatcttcagacccagcgacctgatccacggcgaggtgctgggcaagggctgcttcggccaggccatcaaggtgacccacagagagaccggcgaggtgatggtgatgaaggagctgatcagattcgacgaggagacccagagaaccttcctgaaggaggtgaaggtgatgagatgcctggagcaccccaacgtgctgaagttcatcggcgtgctgtacaaggacaagagactgaacttcatcaccgagtacatcaagggcggcaccctgagaggcatcatcaagagcatggacagccagtacccctggagccagagagtgagcttcgccaaggacatcgccagcggcatggcctacctgcacagcatgaacatcatccacagagacctgaacagccacaactgcctggtgagagagaacaagaacgtggtggtggccgacttcggcctggccagactgatggtggacgagaagacccagcccgagggcctgagaagcctgaagaagcccgacagaaagaagagatacaccgtggtgggcaacccctactggatggcccccgagatgatcaacggcagaagctacgacgagaaggtggacgtgttcagcttcggcatcgtgctgtgcgagatcatcggcagagtgaacgccgaccccgactacctgcccagaaccatggacttcggcctgaacgtgagaggcttcctggacagatactgcccccccaactgcccccccagcttcttccccatcaccgtgagatgctgcgacctggaccccgagaagagacccagcttcgtgaagctggagcactggctggagaccctgagaatgcacctggccggccacctgcccctgggcccccagctggagcagctggacagaggcttctgggagacctacagaagaggcgagagcggcctgcccgcccaccccgaggtgcccgactag

SEQ ID NO: 11323 - DNA, 1944 bp, Artificial Sequence; identical to SEQ ID NO: 11322
  Description of Artificial Sequence: Synthetic coding sequence

SEQ ID NO: 11324 - DNA, 1842 bp, Artificial Sequence
  Description of Artificial Sequence: Synthetic coding sequence
atgctgctggccagcgcccccagaagaagaagattcctgcagagagccaagtgctgcgactgcagcgccagcctgagccaccagtactacgagaaggacggccagctgttctgcaagaaggactactgggccagatacggcgagagctgccacggctgcagcgagcagatcaccaagggcctggtgatggtggccggcgagctgaagtaccaccccgagtgcttcatctgcctgacctgcggcaccttcatcggcgacggcgacacctacaccctggtggagcacagcaagctgtactgcggccactgctactaccagaccgtggtgacccccgtgatcgagcagatcctgcccgacagccccggcagccacctgccccacaccgtgaccctggtgagcatccccgccagcagccacggcaagagaggcctgagcgtgagcatcgaccccccccacggcccccccggctgcggcaccgagcacagccacaccgtgagagtgcagggcgtggaccccggctgcatgagccccgacgtgaagaacagcatccacgtgggcgacagaatcctggagatcaacggcacccccatcagaaacgtgcccctggacgagatcgacctgctgatccaggagaccagcagactgctgcagctgaccctggagcacgacccccacgacaccctgggccacggcctgggccccgagaccagccccctgagcagccccgcctacacccccagcggcgaggccggcagcagcgccagacagaagcccgtgctgagaagctgcagcatcgacagaagccccggcgccggcagcctgggcagccccgccagccagagaaaggacctgggcagaagcgagagcctgagagtggtgtgcagaccccacagaatcttcagacccagcgacctgatccacggcgaggtgctgggcaagggctgcttcggccaggccatcaaggtgacccacagagagaccggcgaggtgatggtgatgaaggagctgatcagattcgacgaggagacccagagaaccttcctgaaggaggtgaaggtgatgagatgcctggagcaccccaacgtgctgaagttcatcggcgtgctgtacaaggacaagagactgaacttcatcaccgagtacatcaagggcggcaccctgagaggcatcatcaagagcatggacagccagtacccctggagccagagagtgagcttcgccaaggacatcgccagcggcatggcctacctgcacagcatgaacatcatccacagagacctgaacagccacaactgcctggtgagagagaacaagaacgtggtggtggccgacttcggcctggccagactgatggtggacgagaagacccagcccgagggcctgagaagcctgaagaagcccgacagaaagaagagatacaccgtggtgggcaacccctactggatggcccccgagatgatcaacggcagaagctacgacgagaaggtggacgtgttcagcttcggcatcgtgctgtgcgagatcatcggcagagtgaacgccgaccccgactacctgcccagaaccatggacttcggcctgaacgtgagaggcttcctggacagatactgcccccccaactgcccccccagcttcttccccatcaccgtgagatgctgcgacctggaccccgagaagagacccagcttcgtgaagctggagcactggctggagaccctgagaatgcacctggccggccacctgcccctgggcccccagctggagcagctggacagaggcttctgggagacctacagaagaggcgagagcggcctgcccgcccaccccgaggtgcccgactag

SEQ ID NO: 11325 - DNA, 471 bp, Artificial Sequence
  Description of Artificial Sequence: Synthetic coding sequence
atgatggtgctggacaaggaggacggcgtgcccatgctgagcgtgcagcccaagggcaagcagaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcaccaccggcaactgcgccgcctgcagcaagctgatccccgccttcgagatggtgatgagagccagagacaacgtgtaccacctggactgcttcgcctgccagctgtgcaaccagagattctgcgtgggcgacaagttcttcctgaagaacaacatgatcctgtgccagatggactacgaggagggccagctgaacggcaccttcgagagccaggtgcagtag

SEQ ID NO: 11326 - DNA, 468 bp, Artificial Sequence
  Description of Artificial Sequence: Synthetic coding sequence
atggtgctggaccaggaggacggcgtgcccatgctgagcgtgcagcccaagggcaagcagaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcaccaccggcaactgcgccgcctgcagcaagctgatccccgccttcgagatggtgatgagagccagagacaacgtgtaccacctggactgcttcgcctgccagctgtgcaaccagagattctgcgtgggcgacaagttcttcctgaagaacaacatgatcctgtgccagatggactacgaggagggccagctgaacggcaccttcgagagccaggtgcagtag

SEQ ID NO: 11327 - DNA, 684 bp, Artificial Sequence
  Description of Artificial Sequence: Synthetic coding sequence
atggagggcagcgccgtgaccgtgctggagagaggcggcgccagcagccccgccgagagaagaagcaagagaagaagaagaagcggcggcgacggcggcggcggcggcggcgccagagcccccgagggcgtgagagcccccgccgccggccagcccagagccaccaagggcgccccccccccccccggcacccccccccccagccccatgagcagcgccatcgagagaaagagcctggaccccagcgaggagcccgtggacgaggtgctgcagatcccccccagcctgctgacctgcggcggctgccagcagaacatcggcgacagatacttcctgaaggccatcgaccagtactggcacgaggactgcctgagctgcgacctgtgcggctgcagactgggcgaggtgggcagaagactgtactacaagctgggcagaaagctgtgcagaagagactacctgagactgttcggccaggacggcctgtgcgccagctgcgacaagagaatcagagcctacgagatgaccatgagagtgaaggacaaggtgtaccacctggagtgcttcaagtgcgccgcctgccagaagcacttctgcgtgggcgacagatacctgctgatcaacagcgacatcgtgtgcgagcaggacatctacgagtggaccaagatcaacggcatgatctag

SEQ ID NO: 11328 - DNA, 477 bp, Artificial Sequence
  Description of Artificial Sequence: Synthetic coding sequence
atgagcagcgccatcgagagaaagagcctggaccccagcgaggagcccgtggacgaggtgctgcagatcccccccagcctgctgacctgcggcggctgccagcagaacatcggcgacagatacttcctgaaggccatcgaccagtactggcacgaggactgcctgagctgcgacctgtgcggctgcagactgggcgaggtgggcagaagactgtactacaagctgggcagaaagctgtgcagaagagactacctgagactgttcggccaggacggcctgtgcgccagctgcgacaagagaatcagagcctacgagatgaccatgagagtgaaggacaaggtgtaccacctggagtgcttcaagtgcgccgcctgccagaagcacttctgcgtgggcgacagatacctgctgatcaacagcgacatcgtgtgcgagcaggacatctacgagtggaccaagatcaacggcatgatctag

SEQ ID NO: 11329 - DNA, 1677 bp, Artificial Sequence
  Description of Artificial Sequence: Synthetic coding sequence
atgcacagaggcggccagcccctgaagaagagaagaggcagcttcaagatggccgagctggaccagctgcccgacgagagcagcagcgccaaggccctggtgagcctgaaggagggcagcctgagcaacacctggaacgagaagtacagcagcctgcagaagacccccgtgtggaagggcagaaacaccagcagcgccgtggagatgcccttcagaaacagcaagagaagcagactgttcagcgacgaggacgacagacagatcaacaccagaagccccaagagaaaccagagagtggccatggtgccccagaagttcaccgccaccatgagcacccccgacaagaaggccagccagaagatcggcttcagactgagaaacctgctgaagctgcccaaggcccacaagtggtgcatctacgagtggttctacagcaacatcgacaagcccctgttcgagggcgacaacgacttctgcgtgtgcctgaaggagagcttccccaacctgaagaccagaaagctgaccagagtggagtggggcaagatcagaagactgatgggcaagcccagaagatgcagcagcgccttcttcgaggaggagagaagcgccctgaagcagaagagacagaagatcagactgctgcagcagagaaaggtggccgacgtgagccagttcaaggacctgcccgacgagatccccctgcccctggtgatcggcaccaaggtgaccgccagactgagaggcgtgcacgacggcctgttcaccggccagatcgacgccgtggacaccctgaacgccacctacagagtgaccttcgacagaaccggcctgggcacccacaccatccccgactacgaggtgctgagcaacgagccccacgagaccatgcccatcgccgccttcggccagaagcagagacccagcagattcttcatgaccccccccagactgcactacaccccccccctgcagagccccatcatcgacaacgaccccctgctgggccagagcccctggagaagcaagatcagcggcagcgacaccgagaccctgggcggcttccccgtggagttcctgatccaggtgaccagactgagcaagatcctgatgatcaagaaggagcacatcaagaagctgagagagatgaacaccgaggccgagaagctgaagagctacagcatgcccatcagcatcgagttccagagaagatacgccaccatcgtgctggagctggagcagctgaacaaggacctgaacaaggtgctgcacaaggtgcagcagtactgctacgagctggcccccgaccagggcctgcagcccgccgaccagcccaccgacatgagaagaagatgcgaggaggaggcccaggagatcgtgagacacgccaacagcagcaccggccagccctgcgtggagaacgagaacctgaccgacctgatcagcagactgaccgccatcctgctgcagatcaagtgcctggccgagggcggcgacctgaacagcttcgagttcaagagcctgaccgacagcctgaacgacatcaagagcaccatcgacgccagcaacatcagctgcttccagaacaacgtggagatccacgtggcccacatccagagcggcctgagccagatgggcaacctgcacgccttcgccgccaacaacaccaacagagactag

SEQ ID NO: 11330 - DNA, 1524 bp, Artificial Sequence
  Description of Artificial Sequence: Synthetic coding sequence
atggccgagctggaccagctgcccgacgagagcagcagcgccaaggccctggtgagcctgaaggagggcagcctgagcaacacctggaacgagaagtacagcagcctgcagaagacccccgtgtggaagggcagaaacaccagcagcgccgtggagatgaagttcaccgccaccatgagcacccccgacaagaaggccagccagaagatcggcttcagactgagaaacctgctgaagctgcccaaggcccacaagtggtgcatctacgagtggttctacagcaacatcgacaagcccctgttcgagggcgacaacgacttctgcgtgtgcctgaaggagagcttccccaacctgaagaccagaaagctgaccagagtggagtggggcaagatcagaagactgatgggcaagcccagaagatgcagcagcgccttcttcgaggaggagagaagcgccctgaagcagaagagacagaagatcagactgctgcagcagagaaaggtggccgacgtgagccagttcaaggacctgcccgacgagatccccctgcccctggtgatcggcaccaaggtgaccgccagactgagaggcgtgcacgacggcctgttcaccggccagatcgacgccgtggacaccctgaacgccacctacagagtgaccttcgacagaaccggcctgggcacccacaccatccccgactacgaggtgctgagcaacgagccccacgagaccatgcccatcgccgccttcggccagaagcagagacccagcagattcttcatgaccccccccagactgcactacaccccccccctgcagagccccatcatcgacaacgaccccctgctgggccagagcccctggagaagcaagatcagcggcagcgacaccgagaccctgggcggcttccccgtggagttcctgatccaggtgaccagactgagcaagatcctgatgatcaagaaggagcacatcaagaagctgagagagatgaacaccgaggccgagaagctgaagagctacagcatgcccatcagcatcgagttccagagaagatacgccaccatcgtgctggagctggagcagctgaacaaggacctgaacaaggtgctgcacaaggtgcagcagtactgctacgagctggcccccgaccagggcctgcagcccgccgaccagcccaccgacatgagaagaagatgcgaggaggaggcccaggagatcgtgagacacgccaacagcagcaccggccagccctgcgtggagaacgagaacctgaccgacctgatcagcagactgaccgccatcctgctgcagatcaagtgcctggccgagggcggcgacctgaacagcttcgagttcaagagcctgaccgacagcctgaacgacatcaagagcaccatcgacgccagcaacatcagctgcttccagaacaacgtggagatccacgtggcccacatccagagcggcctgagccagatgggcaacctgcacgccttcgccgccaacaacaccaacagagactag

SEQ ID NO: 11331 - DNA, 1572 bp, Artificial Sequence
  Description of Artificial Sequence: Synthetic coding sequence
atgagacccagaaccgagggcttcttcccccccgccggcgccagcctgcccttcagcaccagaaacaagcagcccgccgtgcccgccgccgccgccagagccgccgagcacgcccccggcgccggccccggcagagacagcggcgccggcaccgccccccccgccctgagaagaagagccagcccctgcggcctgctgccccccttcctgccccccggcagcgccggcggcggcggcggcggcgccagaagaggcccccccagcgccgcccccccccccagagccggcgccggcggcgccggccccgccagcgccagcagaggcggcagcagcgccgccagaagaagaggccagagagccccccacagcaacctgcccagaaaggacagcctgagacccaccatgcacagaggcggccagcccctgaagaagagaagaggcagcttcaagatggccgagctggaccagctgcccgacgagagcagcagcgccaaggccctggtgagcctgaaggagggcagcctgagcaacacctggaacgagaagtacagcagcctgcagaagacccccgtgtggaagggcagaaacaccagcagcgccgtggagatgcccttcagaaacagcaagagaagcagactgttcagcgacgaggacgacagacagatcaacaccagaagccccaagagaaaccagagagtggccatggtgccccagaagttcaccgccaccatgagcacccccgacaagaaggccagccagaagatcggcttcagactgagaaacctgctgaagctgcccaaggcccacaagtggtgcatctacgagtggttctacagcaacatcgacaagcccctgttcgagggcgacaacgacttctgcgtgtgcctgaaggagagcttccccaacctgaagaccagaaagctgaccagagtggagtggggcaagatcagaagactgatgggcaagcccagaagatgcagcagcgccttcttcgaggaggagagaagcgccctgaagcagaagagacagaagatcagactgctgcagcagagaaaggtggccgacgtgagccagttcaaggacctgcccgacgagatccccctgcccctggtgatcggcaccaaggtgaccgccagactgagaggcgtgcacgacggcctgttcaccggccagatcgacgccgtggacaccctgaacgccacctacagagtgaccttcgacagaaccggcctgggcacccacaccatccccgactacgaggtgctgagcaacgagccccacgagaccatgcccatcgccgccttcggccagaagcagagacccagcagattcttcatgaccccccccagactgcactacaccccccccctgcagagccccatcatcgacaacgaccccctgctgggccagagcccctggagaagcaagatcagcggcagcgacaccgagaccctgggcggcttccccgtggagttcctgatccaggtgaccagactgagcaagatcctgatgatcaagggcacctaccaggagatcaagggcaacgagcacagaagcagaaagatcggctag

SEQ ID NO: 11332 - DNA, 1842 bp, Artificial Sequence
  Description of Artificial Sequence: Synthetic coding sequence
gagaccgccgagcagaacagcagcctggccgtgggcctgaacgaccagctgcacgacctgagcagaagcagaagccccgccgccagaagcagcgccagcaacatcagagagagaagagccagaatcgccagaggcagatgggacagagtgcccgacgtggccaccagaagaggcctgctgagacccgccgtgagcggcaaggtgagaggcagaagaagacccagcaacgtgggcttcggcaactgcagcagcgccaaggccctggtgagcctgaaggagggcagcctgagcaacacctggaacgagaagtacagcagcctgcagaagacccccgtgtggaagggcagaaacaccagcagcgccgtggagatgcccttcagaaacagcaagagaagcagactgttcagcgacgaggacgacagacagatcaacaccagaagccccaagagaaaccagagagtggccatggtgccccagaagttcaccgccaccatgagcacccccgacaagaaggccagccagaagatcggcttcagactgagaaacctgctgaagctgcccaaggcccacaagtggtgcatctacgagtggttctacagcaacatcgacaagcccctgttcgagggcgacaacgacttctgcgtgtgcctgaaggagagcttccccaacctgaagaccagaaagctgaccagagtggagtggggcaagatcagaagactgatgggcaagcccagaagatgcagcagcgccttcttcgaggaggagagaagcgccctgaagcagaagagacagaagatcagactgctgcagcagagaaaggtggccgacgtgagccagttcaaggacctgcccgacgagatccccctgcccctggtgatcggcaccaaggtgaccgccagactgagaggcgtgcacgacggcctgttcaccggccagatcgacgccgtggacaccctgaacgccacctacagagtgaccttcgacagaaccggcctgggcacccacaccatccccgactacgaggtgctgagcaacgagccccacgagaccatgcccatcgccgccttcggccagaagcagagacccagcagattcttcatgaccccccccagactgcactacaccccccccctgcagagccccatcatcgacaacgaccccctgctgggccagagcccctggagaagcaagatcagcggcagcgacaccgagaccctgggcggcttccccgtggagttcctgatccaggtgaccagactgagcaagatcctgatgatcaagaaggagcacatcaagaagctgagagagatgaacaccgaggccgagaagctgaagagctacagcatgcccatcagcatcgagttccagagaagatacgccaccatcgtgctggagctggagcagctgaacaaggacctgaacaaggtgctgcacaaggtgcagcagtactgctacgagctggcccccgaccagggcctgcagcccgccgaccagcccaccgacatgagaagaagatgcgaggaggaggcccaggagatcgtgagacacgccaacagcagcaccggccagccctgcgtggagaacgagaacctgaccgacctgatcagcagactgaccgccatcctgctgcagatcaagtgcctggccgagggcggcgacctgaacagcttcgagttcaagagcctgaccgacagcctgaacgacatcaagagcaccatcgacgccagcaacatcagctgcttccagaacaacgtggagatccacgtggcccacatccagagcggcctgagccagatgggcaacctgcacgccttcgccgccaacaacaccaacagagactag

SEQ ID NO: 11333 - DNA, 13800 bp, Artificial Sequence
  Description of Artificial Sequence: Synthetic coding sequence
atgagcgagttcctgctggccctgctgaccctgagcggcctgctgcccatcgccagagtgctgaccgtgggcgccgacagagaccagcagctgtgcgaccccggcgagttcctgtgccacgaccacgtgacctgcgtgagccagagctggctgtgcgacggcgaccccgactgccccgacgacagcgacgagagcctggacacctgccccgaggaggtggagatcaagtgccccctgaaccacatcgcctgcctgggcaccaacaagtgcgtgcacctgagccagctgtgcaacggcgtgctggactgccccgacggctacgacgagggcgtgcactgccaggagctgctgagcaactgccagcagctgaactgccagtacaagtgcaccatggtgagaaacagcaccagatgctactgcgaggacggcttcgagatcaccgaggacggcagaagctgcaaggaccaggacgagtgcgccgtgtacggcacctgcagccagacctgcagaaacacccacggcagctacacctgcagctgcgtggagggctacctgatgcagcccgacaacagaagctgcaaggccaagatcgagcccaccgacagaccccccatcctgctgatcgccaacttcgagaccatcgaggtgttctacctgaacggcagcaagatggccaccctgagcagcgtgaacggcaacgagatccacaccctggacttcatctacaacgaggacatgatctgctggatcgagagcagagagagcagcaaccagctgaagtgcatccagatcaccaaggccggcggcctgaccgacgagtggaccatcaacatcctgcagagcttccacaacgtgcagcagatggccatcgactggctgaccagaaacctgtacttcgtggaccacgtgggcgacagaatcttcgtgtgcaacagcaacggcagcgtgtgcgtgaccctgatcgacctggagctgcacaaccccaaggccatcgccgtggaccccatcgccggcaagctgttcttcaccgactacggcaacgtggccaaggtggagagatgcgacatggacggcatgaacagaaccagaatcatcgacagcaagaccgagcagcccgccgccctggccctggacctggtgaacaagctggtgtactgggtggacctgtacctggactacgtgggcgtggtggactaccagggcaagaacagacacaccgtgatccagggcagacaggtgagacacctgtacggcatcaccgtgttcgaggactacctgtacgccaccaacagcgacaactacaacatcgtgagaatcaacagattcaacggcaccgacatccacagcctgatcaagatcgagaacgcctggggcatcagaatctaccagaagagaacccagcccaccgtgagaagccacgcctgcgaggtggacccctacggcatgcccggcggctgcagccacatctgcctgctgagcagcagctacaagaccagaacctgcagatgcagaaccggcttcaacctgggcagcgacggcagaagctgcaagagacccaagaacgagctgttcctgttctacggcaagggcagacccggcatcgtgagaggcatggacctgaacaccaagatcgccgacgagtacatgatccccatcgagaacctggtgaaccccagagccctggacttccacgccgagaccaactacatctacttcgccgacaccaccagcttcctgatcggcagacagaagatcgacggcaccgagagagagaccatcctgaaggacgacctggacaacgtggagggcatcgccgtggactggatcggcaacaacctgtactggaccaacgacggccacagaaagaccatcaacgtggccagactggagaaggccagccagagcagaaagaccctgctggagggcgagatgagccaccccagaggcatcgtggtggaccccgtgaacggctggatgtactggaccgactgggaggaggacgagatcgacgacagcgtgggcagaatcgagaaggcctggatggacggcttcaacagacagatcttcgtgaccagcaagatgctgtggcccaacggcctgaccctggacttccacaccaacaccctgtactggtgcgacgcctactacgaccacatcgagaaggtgttcctgaacggcacccacagaaagatcgtgtacagcggcagagagctgaaccaccccttcggcctgagccaccacggcaactacgtgttctggaccgactacatgaacggcagcatcttccagctggacctgatcaccagcgaggtgaccctgctgagacacgagagaccccccctgttcggcctgcagatctacgaccccagaaagcagcagggcgacaacatgtgcagagtgaacaacggcggctgcagcaccctgtgcctggccatccccggcggcagagtgtgcgcctgcgccgacaaccagctgctggacgagaacggcaccacctgcaccttcaaccccggcgaggccctgccccacatctgcaaggccggcgagttcagatgcaagaacagacactgcatccaggccagatggaagtgcgacggcgacgacgactgcctggacggcagcgacgaggacagcgtgaactgcttcaaccacagctgccccgacgaccagttcaagtgccagaacaacagatgcatccccaagagatggctgtgcgacggcgccaacgactgcggcagcaacgaggacgagagcaaccagacctgcaccgccagaacctgccaggtggaccagttcagctgcggcaacggcagatgcatccccagagcctggctgtgcgacagagaggacgactgcggcgaccagaccgacgagatggccagctgcgagttccccacctgcgagcccctgacccagttcgtgtgcaagagcggcagatgcatcagcagcaagtggcactgcgacagcgacgacgactgcggcgacggcagcgacgaggtgggctgcgtgcacagctgcttcgacaaccagttcagatgcagcagcggcagatgcatccccggccactgggcctgcgacggcgacaacgactgcggcgacttcagcgacgaggcccagatcaactgcaccaaggaggagatccacagccccgccggctgcaacggcaacgagttccagtgccaccccgacggcaactgcgtgcccgacctgtggagatgcgacggcgagaaggactgcgaggacggcagcgacgagaagggctgcaacggcaccatcagactgtgcgaccacaagaccaagttcagctgctggagcaccggcagatgcatcaacaaggcctgggtgtgcgacggcgacatcgactgcgaggaccagagcgacgaggacgactgcgacagcttcctgtgcggcccccccaagcacccctgcgccaacgacaccagcgtgtgcctgcagcccgagaagctgtgcaacggcaagaaggactgccccgacggcagcgacgagggctacctgtgcgacgagtgcagcctgaacaacggcggctgcagcaaccactgcagcgtggtgcccggcagaggcatcgtgtgcagctgccccgagggcctgcagctgaacaaggacaacaagacctgcgagatcgtggactactgcagcaaccacctgaagtgcagccaggtgtgcgagcagcacaagcacaccgtgaagtgcagctgctacgagggctggaagctggacgtggacggcgagagctgcaccagcgtggaccccttcgaggccttcatcatcttcagcatcagacacgagatcagaagaatcgacctgcacaagagagactacagcctgctggtgcccggcctgagaaacaccatcgccctggacttccacttcaaccagagcctgctgtactggaccgacgtggtggaggacagaatctacagaggcaagctgagcgagagcggcggcgtgagcgccatcgaggtggtggtggagcacggcctggccacccccgagggcctgaccgtggactggatcgccggcaacatctactggatcgacagcaacctggaccagatcgaggtggccaagctggacggcagcctgagaaccaccctgatcgccggcgccatggagcaccccagagccatcgccctggaccccagatacggcatcctgttctggaccgactgggacgccaacttccccagaatcgagagcgccagcatgagcggcgccggcagaaagaccatctacaaggacatgaagaccggcgcctggcccaacggcctgaccgtggaccacttcgagaagagaatcgtgtggaccgacgccagaagcgacgccatctacagcgccctgtacgacggcaccaacatgatcgagatcatcagaggccacgagtacctgagccaccccttcgccgtgagcctgtacggcagcgaggtgtactggaccgactggagaaccaacaccctgagcaaggccaacaagtggaccggccagaacgtgagcgtgatccagaagaccagcgcccagcccttcgacctgcagatctaccaccccagcagacagccccaggcccccaacccctgcgccgccaacgacggcaagggcccctgcagccacatgtgcctgatcaaccacaacagaagcgccgcctgcgcctgcccccacctgatgaagctgagcagcgacaagaagacctgctacgagatgaagaagttcctgctgtacgccagaagaagcgagatcagaggcgtggacatcgacaacccctacttcaacttcatcaccgccttcaccgtgcccgacatcgacgacgtgaccgtgatcgacttcgacgccagcgaggagagactgtactggaccgacatcaagacccagaccatcaagagagccttcatcaacggcaccggcctggagaccgtgatcagcagagacatccagagcatcagaggcctggccgtggactgggtgagcagaaacctgtactggatcagcagcgagttcgacgagacccagatcaacgtggccagactggacggcagcctgaagaccagcatcatccacggcatcgacaagccccagtgcctggccgcccaccccgtgagaggcaagctgtactggaccgacggcaacaccatcaacatggccaacatggacggcagcaacagcaagatcctgttccagaaccagaaggagcccgtgggcctgagcatcgactacgtggagaacaagctgtactggatcagcagcggcaacggcaccatcaacagatgcaacctggacggcggcaacctggaggtgatcgagagcatgaaggaggagctgaccaaggccaccgccctgaccatcatggacaagaagctgtggtgggccgaccagaacctggcccagctgggcacctgcagcaagagagacggcagaaaccccaccatcctgagaaacaagaccagcggcgtggtgcacatgaaggtgtacgacaaggaggcccagcagggcagcaacagctgccagctgaacaacggcggctgcagccagctgtgcctgcccaccagcgagaccaccagaacctgcatgtgcaccgtgggctactacctgcagaagaacagaatgagctgccagggcatcgagagcttcctgatgtacagcgtgcacgagggcatcagaggcatccccctggagcccagcgacaagatggacgccctgatgcccatcagcggcaccagcttcgccgtgggcatcgacttccacgccgagaacgacaccatctactggaccgacatgggcttcaacaagatcagcagagccaagagagaccagacctggaaggaggacatcatcaccaacggcctgggcagagtggagggcatcgccgtggactggatcgccggcaacatctactggaccgaccacggcttcaacctgatcgaggtggccagactgaacggcagcttcagatacgtgatcatcagccagggcctggaccagcccagaagcatcgccgtgcaccccgagaagggcctgctgttctggaccgagtggggccagatgccctgcatcggcaaggccagactggacggcagcgagaaggtggtgctggtgagcatgggcatcgcctggcccaacggcatcagcatcgactacgaggagaacaagctgtactggtgcgacgccagaaccgacaagatcgagagaatcgacctggagaccggcggcaacagagagatggtgctgagcggcagcaacgtggacatgttcagcgtggccgtgttcggcgcctacatctactggagcgacagagcccacgccaacggcagcgtgagaagaggccacaagaacgacgccaccgagaccatcaccatgagaaccggcctgggcgtgaacctgaaggaggtgaagatcttcaacagagtgagagagaagggcaccaacgtgtgcgccagagacaacggcggctgcaagcagctgtgcctgtacagaggcaacagcagaagaacctgcgcctgcgcccacggctacctggccgaggacggcgtgacctgcctgagacacgagggctacctgctgtacagcggcagaaccatcctgaagagcatccacctgagcgacgagaccaacctgaacagccccatcagaccctacgagaaccccagatacttcaagaacgtgatcgccctggccttcgactacaaccagagaagaaagggcaccaacagaatcttctacagcgacgcccacttcggcaacatccagctgatcaaggacaactgggaggacagacaggtgatcgtggagaacgtgggcagcgtggagggcctggcctaccacagagcctgggacaccctgtactggaccagcagcaccaccagcagcatcaccagacacaccgtggaccagaccagacccggcgccttcgacagagaggccgtgatcaccatgagcgaggacgaccacccccacgtgctggccctggacgagtgccagaacctgatgttctggaccaactggaacgagcagcaccccagcatcatgagaagcaccctgaccggcaagaacgcccaggtggtggtgagcaccgacatcctgacccccaacggcctgaccatcgactacagagccgagaagctgtacttcagcgacggcagcctgggcaagatcgagagatgcgagtacgacggcagccagagacacgtgatcgtgaagagcggccccggcaccttcctgagcctggccgtgtacgacaactacatcttctggagcgactggggcagaagagccatcctgagaagcaacaagtacaccggcggcgacaccaagatcctgagaagcgacatcccccaccagcccatgggcatcatcgccgtggccaacgacaccaacagctgcgagctgagcccctgcgccctgctgaacggcggctgccacgacctgtgcctgctgacccccaacggcagagtgaactgcagctgcagaggcgacagaatcctgctggaggacaacagatgcgtgaccaagaacagcagctgcaacgcctacagcgagttcgagtgcggcaacggcgagtgcatcgactaccagctgacctgcgacggcatcccccactgcaaggacaagagcgacgagaagctgctgtactgcgagaacagaagctgcagaagaggcttcaagccctgctacaacagaagatgcatcccccacggcaagctgtgcgacggcgagaacgactgcggcgacaacagcgacgagctggactgcaaggtgagcacctgcgccaccgtggagttcagatgcgccgacggcacctgcatccccagaagcgccagatgcaaccagaacatcgactgcgccgacgccagcgacgagaagaactgcaacaacaccgactgcacccacttctacaagctgggcgtgaagaccaccggcttcatcagatgcaacagcaccagcctgtgcgtgctgcccacctggatctgcgacggcagcaacgactgcggcgactacagcgacgagctgaagtgccccgtgcagaacaagcacaagtgcgaggagaactacttcagctgccccagcggcagatgcatcctgaacacctggatctgcgacggccagaaggactgcgaggacggcagagacgagttccactgcgacagcagctgcagctggaaccagttcgcctgcagcgcccagaagtgcatcagcaagcactggatctgcgacggcgaggacgactgcggcgacggcctggacgagagcgacagcatctgcggcgccatcacctgcgccgccgacatgttcagctgccagggcagcagagcctgcgtgcccagacactggctgtgcgacggcgagagagactgccccgacggcagcgacgagctgagcaccgccggctgcgcccccaacaacacctgcgacgagaacgccttcatgtgccacaacaaggtgtgcatccccaagcagttcgtgtgcgaccacgacgacgactgcggcgacggcagcgacgagagcccccagtgcggctacagacagtgcggcaccgaggagttcagctgcgccgacggcagatgcctgctgaacacccagtggcagtgcgacggcgacttcgactgccccgaccacagcgacgaggcccccctgaaccccaagtgcaagagcgccgagcagagctgcaacagcagcttcttcatgtgcaagaacggcagatgcatccccagcggcggcctgtgcgacaacaaggacgactgcggcgacggcagcgacgagagaaactgccacatcaacgagtgcctgagcaagaaggtgagcggctgcagccaggactgccaggacctgcccgtgagctacaagtgcaagtgctggcccggcttccagctgaaggacgacggcaagacctgcgtggacatcgacgagtgcagcagcggcttcccctgcagccagcagtgcatcaacacctacggcacctacaagtgcctgtgcaccgacggctacgagatccagcccgacaaccccaacggctgcaagagcctgagcgacgaggagcccttcctgatcctggccgaccaccacgagatcagaaagatcagcaccgacggcagcaactacaccctgctgaagcagggcctgaacaacgtgatcgccatcgacttcgactacagagaggagttcatctactggatcgacagcagcagacccaacggcagcagaatcaacagaatgtgcctgaacggcagcgacatcaaggtggtgcacaacaccgccgtgcccaacgccctggccgtggactggatcggcaagaacctgtactggagcgacaccgagaagagaatcatcgaggtgagcaagctgaacggcctgtaccccaccatcctggtgagcaagagactgaagttccccagagacctgagcctggacccccaggccggctacctgtactggatcgactgctgcgagtacccccacatcggcagagtgggcatggacggcaccaaccagagcgtggtgatcgagaccaagatcagcagacccatggccctgaccatcgactacgtgaacagaagactgtactgggccgacgagaaccacatcgagttcagcaacatggacggcagccacagacacaaggtgcccaaccaggacatccccggcgtgatcgccctgaccctgttcgaggactacatctactggaccgacggcaagaccaagagcctgagcagagcccacaagaccagcggcgccgacagactgagcctgatctacagctggcacgccatcaccgacatccaggtgtaccacagctacagacagcccgacgtgagcaagcacctgtgcatgatcaacaacggcggctgcagccacctgtgcctgctggcccccggcaagacccacacctgcgcctgccccaccaacttctacctggccgccgacaacagaacctgcctgagcaactgcaccgccagccagttcagatgcaagaccgacaagtgcatccccttctggtggaagtgcgacaccgtggacgactgcggcgacggcagcgacgagcccgacgactgccccgagttcagatgccagcccggcagattccagtgcggcaccggcctgtgcgccctgcccgccttcatctgcgacggcgagaacgactgcggcgacaacagcgacgagctgaactgcgacacccacgtgtgcctgagcggccagttcaagtgcaccaagaaccagaagtgcatccccgtgaacctgagatgcaacggccaggacgactgcggcgacgaggaggacgagagagactgccccgagaacagctgcagccccgactacttccagtgcaagaccaccaagcactgcatcagcaagctgtgggtgtgcgacgaggaccccgactgcgccgacgccagcgacgaggccaactgcgacaagaagacctgcggcccccacgagttccagtgcaagaacaacaactgcatccccgaccactggagatgcgacagccagaacgactgcagcgacaacagcgacgaggagaactgcaagccccagacctgcaccctgaaggacttcctgtgcgccaacggcgactgcgtgagcagcagattctggtgcgacggcgacttcgactgcgccgacggcagcgacgagagaaactgcgagaccagctgcagcaaggaccagttcagatgcagcaacggccagtgcatccccgccaagtggaagtgcgacggccacgaggactgcaagtacggcgaggacgagaagagctgcgagcccgccagccccacctgcagcagcagagagtacatctgcgccagcgacggctgcatcagcgccagcctgaagtgcaacggcgagtacgactgcgccgacggcagcgacgagatggactgcgtgaccgagtgcaaggaggaccagttcagatgcaagaacaaggcccactgcatccccatcagatggctgtgcgacggcatccacgactgcgtggacggcagcgacgaggagaactgcgagagaggcggcaacatctgcagagccgacgagttcctgtgcaacaacagcctgtgcaagctgcacttctgggtgtgcgacggcgaggacgactgcggcgacaacagcgacgaggcccccgacatgtgcgtgaagttcctgtgccccagcaccagaccccacagatgcagaaacaacagaatctgcctgcagagcgagcagatgtgcaacggcatcgacgagtgcggcgacaacagcgacgaggaccactgcggcggcaagctgacctacaaggccagaccctgcaagaaggacgagttcgcctgcagcaacaagaagtgcatccccatggacctgcagtgcgacagactggacgactgcggcgacggcagcgacgagcagggctgcagaatcgcccccaccgagtacacctgcgaggacaacgtgaacccctgcggcgacgacgcctactgcaaccagatcaagaccagcgtgttctgcagatgcaagcccggcttccagagaaacatgaagaacagacagtgcgaggacctgaacgagtgcctggtgttcggcacctgcagccaccagtgcatcaacgtggagggcagctacaagtgcgtgtgcgaccagaacttccaggagagaaacaacacctgcatcgccgagggcagcgaggaccaggtgctgtacatcgccaacgacaccgacatcctgggcttcatctaccccttcaactacagcggcgaccaccagcagatcagccacatcgagcacaacagcagaatcaccggcatggacgtgtactaccagagagacatgatcatctggagcacccagttcaaccccggcggcatcttctacaagagaatccacggcagagagaagagacaggccaacagcggcctgatctgccccgagttcaagagacccagagacatcgccgtggactgggtggccggcaacatctactggaccgaccacagcagaatgcactggttcagctactacaccacccactggaccagcctgagatacagcatcaacgtgggccagctgaacggccccaactgcaccagactgctgaccaacatggccggcgagccctacgccatcgccgtgaaccccaagagaggcatgatgtactggaccgtggtgggcgaccacagccacatcgaggaggccgccatggacggcaccctgagaagaatcctggtgcagaagaacctgcagagacccaccggcctggccgtggactacttcagcgagagaatctactgggccgacttcgagctgagcatcatcggcagcgtgctgtacgacggcagcaacagcgtggtgagcgtgagcagcaagcagggcctgctgcacccccacagaatcgacatcttcgaggactacatctacggcgccggccccaagaacggcgtgttcagagtgcagaagttcggccacggcagcgtggagtacctggccctgaacatcgacaagaccaagggcgtgctgatcagccacagatacaagcagctggacctgcccaacccctgcctggacctggcctgcgagttcctgtgcctgctgaaccccagcggcgccacctgcgtgtgccccgagggcaagtacctgatcaacggcacctgcaacgacgacagcctgctggacgacagctgcaagctgacctgcgagaacggcggcagatgcatcctgaacgagaagggcgacctgagatgccactgctggcccagctacagcggcgagagatgcgaggtgaaccactgcagcaactactgccagaacggcggcacctgcgtgcccagcgtgctgggcagacccacctgcagctgcgccctgggcttcaccggccccaactgcggcaagaccgtgtgcgaggacttctgccagaacggcggcacctgcatcgtgaccgccggcaaccagccctactgccactgccagcccgagtacaccggcgacagatgccagtactacgtgtgccaccactactgcgtgaacagcgagagctgcaccatcggcgacgacggcagcgtggagtgcgtgtgccccaccagatacgagggccccaagtgcgaggtggacaagtgcgtgagatgccacggcggccactgcatcatcaacaaggacagcgaggacatcttctgcaactgcaccaacggcaagatcgccagcagctgccagctgtgcgacggctactgctacaacggcggcacctgccagctggaccccgagaccaacgtgcccgtgtgcctgtgcagcaccaactggagcggcacccagtgcgagagacccgcccccaagagcagcaagagcgaccacatcagcaccagaagcatcgccatcatcgtgcccctggtgctgctggtgaccctgatcaccaccctggtgatcggcctggtgctgtgcaagagaaagagaagaaccaagaccatcagaagacagcccatcatcaacggcggcatcaacgtggagatcggcaaccccagctacaacatgtacgaggtggaccacgaccacaacgacggcggcctgctggaccccggcttcatgatcgaccccaccaaggccagatacatcggcggcggccccagcgccttcaagctgccccacaccgccccccccatctacctgaacagcgacctgaagggccccctgaccgccggccccaccaactacagcaaccccgtgtacgccaagctgtacatggacggccagaactgcagaaacagcctgggcagcgtggacgagagaaaggagctgctgcccaagaagatcgagatcggcatcagagagaccgtggcctag

SEQ ID NO: 11334 - DNA, 2349 bp, Artificial Sequence
  Description of Artificial Sequence: Synthetic coding sequence
atgagcgagttcctgctggccctgctgaccctgagcggcctgctgcccatcgccagagtgctgaccgtgggcgccgacagagaccagcagctgtgcgaccccggcgagttcctgtgccacgaccacgtgacctgcgtgagccagagctggctgtgcgacggcgaccccgactgccccgacgacagcgacgagagcctggacaccagcagaacctgccaggtggaccagttcagctgcggcaacggcagatgcatccccagagcctggctgtgcgacagagaggacgactgcggcgaccagaccgacgagatggccagctgcgagttccccacctgcgagcccctgacccagttcgtgtgcaagagcggcagatgcatcagcagcaagtggcactgcgacagcgacgacgactgcggcgacggcagcgacgaggtgggctgcgtgcacagctgcttcgacaaccagttcagatgcagcagcggcagatgcatccccggccactgggcctgcgacggcgacaacgactgcggcgacttcagcgacgaggcccagatcaactgcaccaaggaggagatccacagccccgccggctgcaacggcaacgagttccagtgccaccccgacggcaactgcgtgcccgacctgtggagatgcgacggcgagaaggactgcgaggacggcagcgacgagaagggctgcaacggcaccatcagactgtgcgaccacaagaccaagttcagctgctggagcaccggcagatgcatcaacaaggcctgggtgtgcgacggcgacatcgactgcgaggaccagagcgacgaggacgactgcgacagcttcctgtgcggcccccccaagcacccctgcgccaacgacaccagcgtgtgcctgcagcccgagaagctgtgcaacggcaagaaggactgccccgacggcagcgacgagggctacctgtgcgacgagtgcagcctgaacaacggcggctgcagcaaccactgcagcgtggtgcccggcagaggcatcgtgtgcagctgccccgagggcctgcagctgaacaaggacaacaagacctgcgagatcgtggactactgcagcaaccacctgaagtgcagccaggtgtgcgagcagcacaagcacaccgtgaagtgcagctgctacgagggctggaagctggacgtggacggcgagagctgcaccagcgtggaccccttcgaggccttcatcatcttcagcatcagacacgagatcagaagaatcgacctgcacaagagagactacagcctgctggtgcccggcctgagaaacaccatcgccctggacttccacttcaaccagagcctgctgtactggaccgacgtggtggaggacagaatctacagaggcaagctgagcgagagcggcggcgtgagcgccatcgaggtggtggtggagcacggcctggccacccccgagggcctgaccgtggactggatcgccggcaacatctactggatcgacagcaacctggaccagatcgaggtggccaagctggacggcagcctgagaaccaccctgatcgccggcgccatggagcaccccagagccatcgccctggaccccagatacggcatcctgttctggaccgactgggacgccaacttccccagaatcgagagcgccagcatgagcggcgccggcagaaagaccatctacaaggacatgaagaccggcgcctggcccaacggcctgaccgtggaccacttcgagaagagaatcgtgtggaccgacgccagaagcgacgccatctacagcgccctgtacgacggcaccaacatgatcgagatcatcagaggccacgagtacctgagccaccccttcgccgtgagcctgtacggcagcgaggtgtactggaccgactggagaaccaacaccctgagcaaggccaacaagtggaccggccagaacgtgagcgtgatccagaagaccagcgcccagcccttcgacctgcagatctaccaccccagcagacagccccaggcccccaacccctgcgccgccaacgacggcaagggcccctgcagccacatgtgcctgatcaaccacaacagaagcgccgcctgcgcctgcccccacctgatgaagctgagcagcgacaagaagacctgctacgagatgaagaagttcctgctgtacgccagaagaagcgagatcagaggcgtggacatcgacaacccctacttcaacttcatcaccgccttcaccgtgcccgacatcgacgacgtgaccgtgatcgacttcgacgccagcgaggagagactgtactggaccgacatcaagacccagaccatcaagagagccttcatcaacggctag

SEQ ID NO: 11335 - DNA, 13614 bp, Artificial Sequence
  Description of Artificial Sequence: Synthetic coding sequence
ttcctgcacagcggccccgaggaggtggagatcaagtgccccctgaaccacatcgcctgcctgggcaccaacaagtgcgtgcacctgagccagctgtgcaacggcgtgctggactgccccgacggctacgacgagggcgtgcactgccagggcgagagcatctgccagcagctgaactgcaccatgtacaagtacaagtgcaccatggtgagaaacagcaccagatgctactgcgaggacggcttcgagatcaccgaggacggcagaagctgcaaggaccaggacgagtgcgccgtgtacggcacctgcagccagacctgcagaaacacccacggcagctacacctgcagctgcgtggagggctacctgatgcagcccgacaacagaagctgcaaggccaagatcgagcccaccgacagaccccccatcctgctgatcgccaacttcgagaccatcgaggtgttctacctgaacggcagcaagatggccaccctgagcagcgtgaacggcaacgagatccacaccctggacttcatctacaacgaggacatgatctgctggatcgagagcagagagagcagcaaccagctgaagtgcatccagatcaccaaggccggcggcctgaccgacgagtggaccatcaacatcctgcagagcttccacaacgtgcagcagatggccatcgactggctgaccagaaacctgtacttcgtggaccacgtgggcgacagaatcttcgtgtgcaacagcaacggcagcgtgtgcgtgaccctgatcgacctggagctgcacaaccccaaggccatcgccgtggaccccatcgccggcaagctgttcttcaccgactacggcaacgtggccaaggtggagagatgcgacatggacggcatgaacagaaccagaatcatcgacagcaagaccgagcagcccgccgccctggccctggacctggtgaacaagctggtgtactgggtggacctgtacctggactacgtgggcgtggtggactaccagggcaagaacagacacaccgtgatccagggcagacaggtgagacacctgtacggcatcaccgtgttcgaggactacctgtacgccaccaacagcgacaactacaacatcgtgagaatcaacagattcaacggcaccgacatccacagcctgatcaagatcgagaacgcctggggcatcagaatctaccagaagagaacccagcccaccgtgagaagccacgcctgcgaggtggacccctacggcatgcccggcggctgcagccacatctgcctgctgagcagcagctacaagaccagaacctgcagatgcagaaccggcttcaacctgggcagcgacggcagaagctgcaagagacccaagaacgagctgttcctgttctacggcaagggcagacccggcatcgtgagaggcatggacctgaacaccaagatcgccgacgagtacatgatccccatcgagaacctggtgaaccccagagccctggacttccacgccgagaccaactacatctacttcgccgacaccaccagcttcctgatcggcagacagaagatcgacggcaccgagagagagaccatcctgaaggacgacctggacaacgtggagggcatcgccgtggactggatcggcaacaacctgtactggaccaacgacggccacagaaagaccatcaacgtggccagactggagaaggccagccagagcagaaagaccctgctggagggcgagatgagccaccccagaggcatcgtggtggaccccgtgaacggctggatgtactggaccgactgggaggaggacgagatcgacgacagcgtgggcagaatcgagaaggcctggatggacggcttcaacagacagatcttcgtgaccagcaagatgctgtggcccaacggcctgaccctggacttccacaccaacaccctgtactggtgcgacgcctactacgaccacatcgagaaggtgttcctgaacggcacccacagaaagatcgtgtacagcggcagagagctgaaccaccccttcggcctgagccaccacggcaactacgtgttctggaccgactacatgaacggcagcatcttccagctggacctgatcaccagcgaggtgaccctgctgagacacgagagaccccccctgttcggcctgcagatctacgaccccagaaagcagcagggcgacaacatgtgcagagtgaacaacggcggctgcagcaccctgtgcctggccatccccggcggcagagtgtgcgcctgcgccgacaaccagctgctggacgagaacggcaccacctgcaccttcaaccccggcgaggccctgccccacatctgcaaggccggcgagttcagatgcaagaacagacactgcatccaggccagatggaagtgcgacggcgacgacgactgcctggacggcagcgacgaggacagcgtgaactgcttcaaccacagctgccccgacgaccagttcaagtgccagaacaacagatgcatccccaagagatggctgtgcgacggcgccaacgactgcggcagcaacgaggacgagagcaaccagacctgcaccgccagaacctgccaggtggaccagttcagctgcggcaacggcagatgcatccccagagcctggctgtgcgacagagaggacgactgcggcgaccagaccgacgagatggccagctgcgagttccccacctgcgagcccctgacccagttcgtgtgcaagagcggcagatgcatcagcagcaagtggcactgcgacagcgacgacgactgcggcgacggcagcgacgaggtgggctgcgtgcacagctgcttcgacaaccagttcagatgcagcagcggcagatgcatccccggccactgggcctgcgacggcgacaacgactgcggcgacttcagcgacgaggcccagatcaactgcaccaaggaggagatccacagccccgccggctgcaacggcaacgagttccagtgccaccccgacggcaactgcgtgcccgacctgtggagatgcgacggcgagaaggactgcgaggacggcagcgacgagaagggctgcaacggcaccatcagactgtgcgaccacaagaccaagttcagctgctggagcaccggcagatgcatcaacaaggcctgggtgtgcgacggcgacatcgactgcgaggaccagagcgacgaggacgactgcgacagcttcctgtgcggcccccccaagcacccctgcgccaacgacaccagcgtgtgcctgcagcccgagaagctgtgcaacggcaagaaggactgccccgacggcagcgacgagggctacctgtgcgacgagtgcagcctgaacaacggcggctgcagcaaccactgcagcgtggtgcccggcagaggcatcgtgtgcagctgccccgagggcctgcagctgaacaaggacaacaagacctgcgagatcgtggactactgcagcaaccacctgaagtgcagccaggtgtgcgagcagcacaagcacaccgtgaagtgcagctgctacgagggctggaagctggacgtggacggcgagagctgcaccagcgtggaccccttcgaggccttcatcatcttcagcatcagacacgagatcagaagaatcgacctgcacaagagagactacagcctgctggtgcccggcctgagaaacaccatcgccctggacttccacttcaaccagagcctgctgtactggaccgacgtggtggaggacagaatctacagaggcaagctgagcgagagcggcggcgtgagcgccatcgaggtggtggtggagcacggcctggccacccccgagggcctgaccgtggactggatcgccggcaacatctactggatcgacagcaacctggaccagatcgaggtggccaagctggacggcagcctgagaaccaccctgatcgccggcgccatggagcaccccagagccatcgccctggaccccagatacggcatcctgttctggaccgactgggacgccaacttccccagaatcgagagcgccagcatgagcggcgccggcagaaagaccatctacaaggacatgaagaccggcgcctggcccaacggcctgaccgtggaccacttcgagaagagaatcgtgtggaccgacgccagaagcgacgccatctacagcgccctgtacgacggcaccaacatgatcgagatcatcagaggccacgagtacctgagccaccccttcgccgtgagcctgtacggcagcgaggtgtactggaccgactggagaaccaacaccctgagcaaggccaacaagtggaccggccagaacgtgagcgtgatccagaagaccagcgcccagcccttcgacctgcagatctaccaccccagcagacagccccaggcccccaacccctgcgccgccaacgacggcaagggcccctgcagccacatgtgcctgatcaaccacaacagaagcgccgcctgcgcctgcccccacctgatgaagctgagcagcgacaagaagacctgctacgagatgaagaagttcctgctgtacgccagaagaagcgagatcagaggcgtggacatcgacaacccctacttcaacttcatcaccgccttcaccgtgcccgacatcgacgacgtgaccgtgatcgacttcgacgccagcgaggagagactgtactggaccgacatcaagacccagaccatcaagagagccttcatcaacggcaccggcctggagaccgtgatcagcagagacatccagagcatcagaggcctggccgtggactgggtgagcagaaacctgtactggatcagcagcgagttcgacgagacccagatcaacgtggccagactggacggcagcctgaagaccagcatcatccacggcatcgacaagccccagtgcctggccgcccaccccgtgagaggcaagctgtactggaccgacggcaacaccatcaacatggccaacatggacggcagcaacagcaagatcctgttccagaaccagaaggagcccgtgggcctgagcatcgactacgtggagaacaagctgtactggatcagcagcggcaacggcaccatcaacagatgcaacctggacggcggcaacctggaggtgatcgagagcatgaaggaggagctgaccaaggccaccgccctgaccatcatggacaagaagctgtggtgggccgaccagaacctggcccagctgggcacctgcagcaagagagacggcagaaaccccaccatcctgagaaacaagaccagcggcgtggtgcacatgaaggtgtacgacaaggaggcccagcagggcagcaacagctgccagctgaacaacggcggctgcagccagctgtgcctgcccaccagcgagaccaccagaacctgcatgtgcaccgtgggctactacctgcagaagaacagaatgagctgccagggcatcgagagcttcctgatgtacagcgtgcacgagggcatcagaggcatccccctggagcccagcgacaagatggacgccctgatgcccatcagcggcaccagcttcgccgtgggcatcgacttccacgccgagaacgacaccatctactggaccgacatgggcttcaacaagatcagcagagccaagagagaccagacctggaaggaggacatcatcaccaacggcctgggcagagtggagggcatcgccgtggactggatcgccggcaacatctactggaccgaccacggcttcaacctgatcgaggtggccagactgaacggcagcttcagatacgtgatcatcagccagggcctggaccagcccagaagcatcgccgtgcaccccgagaagggcctgctgttctggaccgagtggggccagatgccctgcatcggcaaggccagactggacggcagcgagaaggtggtgctggtgagcatgggcatcgcctggcccaacggcatcagcatcgactacgaggagaacaagctgtactggtgcgacgccagaaccgacaagatcgagagaatcgacctggagaccggcggcaacagagagatggtgctgagcggcagcaacgtggacatgttcagcgtggccgtgttcggcgcctacatctactggagcgacagagcccacgccaacggcagcgtgagaagaggccacaagaacgacgccaccgagaccatcaccatgagaaccggcctgggcgtgaacctgaaggaggtgaagatcttcaacagagtgagagagaagggcaccaacgtgtgcgccagagacaacggcggctgcaagcagctgtgcctgtacagaggcaacagcagaagaacctgcgcctgcgcccacggctacctggccgaggacggcgtgacctgcctgagacacgagggctacctgctgtacagcggcagaaccatcctgaagagcatccacctgagcgacgagaccaacctgaacagccccatcagaccctacgagaaccccagatacttcaagaacgtgatcgccctggccttcgactacaaccagagaagaaagggcaccaacagaatcttctacagcgacgcccacttcggcaacatccagctgatcaaggacaactgggaggacagacaggtgatcgtggagaacgtgggcagcgtggagggcctggcctaccacagagcctgggacaccctgtactggaccagcagcaccaccagcagcatcaccagacacaccgtggaccagaccagacccggcgccttcgacagagaggccgtgatcaccatgagcgaggacgaccacccccacgtgctggccctggacgagtgccagaacctgatgttctggaccaactggaacgagcagcaccccagcatcatgagaagcaccctgaccggcaagaacgcccaggtggtggtgagcaccgacatcctgacccccaacggcctgaccatcgactacagagccgagaagctgtacttcagcgacggcagcctgggcaagatcgagagatgcgagtacgacggcagccagagacacgtgatcgtgaagagcggccccggcaccttcctgagcctggccgtgtacgacaactacatcttctggagcgactggggcagaagagccatcctgagaagcaacaagtacaccggcggcgacaccaagatcctgagaagcgacatcccccaccagcccatgggcatcatcgccgtggccaacgacaccaacagctgcgagctgagcccctgcgccctgctgaacggcggctgccacgacctgtgcctgctgacccccaacggcagagtgaactgcagctgcagaggcgacagaatcctgctggaggacaacagatgcgtgaccaagaacagcagctgcaacgcctacagcgagttcgagtgcggcaacggcgagtgcatcgactaccagctgacctgcgacggcatcccccactgcaaggacaagagcgacgagaagctgctgtactgcgagaacagaagctgcagaagaggcttcaagccctgctacaacagaagatgcatcccccacggcaagctgtgcgacggcgagaacgactgcggcgacaacagcgacgagctggactgcaaggtgagcacctgcgccaccgtggagttcagatgcgccgacggcacctgcatccccagaagcgccagatgcaaccagaacatcgactgcgccgacgccagcgacgagaagaactgcaacaacaccgactgcacccacttctacaagctgggcgtgaagaccaccggcttcatcagatgcaacagcaccagcctgtgcgtgctgcccacctggatctgcgacggcagcaacgactgcggcgactacagcgacgagctgaagtgccccgtgcagaacaagcacaagtgcgaggagaactacttcagctgccccagcggcagatgcatcctgaacacctggatctgcgacggccagaaggactgcgaggacggcagagacgagttccactgcgacagcagctgcagctggaaccagttcgcctgcagcgcccagaagtgcatcagcaagcactggatctgcgacggcgaggacgactgcggcgacggcctggacgagagcgacagcatctgcggcgccatcacctgcgccgccgacatgttcagctgccagggcagcagagcctgcgtgcccagacactggctgtgcgacggcgagagagactgccccgacggcagcgacgagctgagcaccgccggctgcgcccccaacaacacctgcgacgagaacgccttcatgtgccacaacaaggtgtgcatccccaagcagttcgtgtgcgaccacgacgacgactgcggcgacggcagcgacgagagcccccagtgcggctacagacagtgcggcaccgaggagttcagctgcgccgacggcagatgcctgctgaacacccagtggcagtgcgacggcgacttcgactgccccgaccacagcgacgaggcccccctgaaccccaagtgcaagagcgccgagcagagctgcaacagcagcttcttcatgtgcaagaacggcagatgcatccccagcggcggcctgtgcgacaacaaggacgactgcggcgacggcagcgacgagagaaactgccacatcaacgagtgcctgagcaagaaggtgagcggctgcagccaggactgccaggacctgcccgtgagctacaagtgcaagtgctggcccggcttccagctgaaggacgacggcaagacctgcgtggacatcgacgagtgcagcagcggcttcccctgcagccagcagtgcatcaacacctacggcacctacaagtgcctgtgcaccgacggctacgagatccagcccgacaaccccaacggctgcaagagcctgagcgacgaggagcccttcctgatcctggccgaccaccacgagatcagaaagatcagcaccgacggcagcaactacaccctgctgaagcagggcctgaacaacgtgatcgccatcgacttcgactacagagaggagttcatctactggatcgacagcagcagacccaacggcagcagaatcaacagaatgtgcctgaacggcagcgacatcaaggtggtgcacaacaccgccgtgcccaacgccctggccgtggactggatcggcaagaacctgtactggagcgacaccgagaagagaatcatcgaggtgagcaagctgaacggcctgtaccccaccatcctggtgagcaagagactgaagttccccagagacctgagcctggacccccaggccggctacctgtactggatcgactgctgcgagtacccccacatcggcagagtgggcatggacggcaccaaccagagcgtggtgatcgagaccaagatcagcagacccatggccctgaccatcgactacgtgaacagaagactgtactgggccgacgagaaccacatcgagttcagcaacatggacggcagccacagacacaaggtgcccaaccaggacatccccggcgtgatcgccctgaccctgttcgaggactacatctactggaccgacggcaagaccaagagcctgagcagagcccacaagaccagcggcgccgacagactgagcctgatctacagctggcacgccatcaccgacatccaggtgtaccacagctacagacagcccgacgtgagcaagcacctgtgcatgatcaacaacggcggctgcagccacctgtgcctgctggcccccggcaagacccacacctgcgcctgccccaccaacttctacctggccgccgacaacagaacctgcctgagcaactgcaccgccagccagttcagatgcaagaccgacaagtgcatccccttctggtggaagtgcgacaccgtggacgactgcggcgacggcagcgacgagcccgacgactgccccgagttcagatgccagcccggcagattccagtgcggcaccggcctgtgcgccctgcccgccttcatctgcgacggcgagaacgactgcggcgacaacagcgacgagctgaactgcgacacccacgtgtgcctgagcggccagttcaagtgcaccaagaaccagaagtgcatccccgtgaacctgagatgcaacggccaggacgactgcggcgacgaggaggacgagagagactgccccgagaacagctgcagccccgactacttccagtgcaagaccaccaagcactgcatcagcaagctgtgggtgtgcgacgaggaccccgactgcgccgacgccagcgacgaggccaactgcgacaagaagacctgcggcccccacgagttccagtgcaagaacaacaactgcatccccgaccactggagatgcgacagccagaacgactgcagcgacaacagcgacgaggagaactgcaagccccagacctgcaccctgaaggacttcctgtgcgccaacggcgactgcgtgagcagcagattctggtgcgacggcgacttcgactgcgccgacggcagcgacgagagaaactgcgagaccagctgcagcaaggaccagttcagatgcagcaacggccagtgcatccccgccaagtggaagtgcgacggccacgaggactgcaagtacggcgaggacgagaagagctgcgagcccgccagccccacctgcagcagcagagagtacatctgcgccagcgacggctgcatcagcgccagcctgaagtgcaacggcgagtacgactgcgccgacggcagcgacgagatggactgcgtgaccgagtgcaaggaggaccagttcagatgcaagaacaaggcccactgcatccccatcagatggctgtgcgacggcatccacgactgcgtggacggcagcgacgaggagaactgcgagagaggcggcaacatctgcagagccgacgagttcctgtgcaacaacagcctgtgcaagctgcacttctgggtgtgcgacggcgaggacgactgcggcgacaacagcgacgaggcccccgacatgtgcgtgaagttcctgtgccccagcaccagaccccacagatgcagaaacaacagaatctgcctgcagagcgagcagatgtgcaacggcatcgacgagtgcggcgacaacagcgacgaggaccactgcggcggcaagctgacctacaaggccagaccctgcaagaaggacgagttcgcctgcagcaacaagaagtgcatccccatggacctgcagtgcgacagactggacgactgcggcgacggcagcgacgagcagggctgcagaatcgcccccaccgagtacacctgcgaggacaacgtgaacccctgcggcgacgacgcctactgcaaccagatcaagaccagcgtgttctgcagatgcaagcccggcttccagagaaacatgaagaacagacagtgcgaggacctgaacgagtgcctggtgttcggcacctgcagccaccagtgcatcaacgtggagggcagctacaagtgcgtgtgcgaccagaacttccaggagagaaacaacacctgcatcgccgagggcagcgaggaccaggtgctgtacatcgccaacgacaccgacatcctgggcttcatctaccccttcaactacagcggcgaccaccagcagatcagccacatcgagcacaacagcagaatcaccggcatggacgtgtactaccagagagacatgatcatctggagcacccagttcaaccccggcggcatcttctacaagagaatccacggcagagagaagagacaggccaacagcggcctgatctgccccgagttcaagagacccagagacatcgccgtggactgggtggccggcaacatctactggaccgaccacagcagaatgcactggttcagctactacaccacccactggaccagcctgagatacagcatcaacgtgggccagctgaacggccccaactgcaccagactgctgaccaacatggccggcgagccctacgccatcgccgtgaaccccaagagaggcatgatgtactggaccgtggtgggcgaccacagccacatcgaggaggccgccatggacggcaccctgagaagaatcctggtgcagaagaacctgcagagacccaccggcctggccgtggactacttcagcgagagaatctactgggccgacttcgagctgagcatcatcggcagcgtgctgtacgacggcagcaacagcgtggtgagcgtgagcagcaagcagggcctgctgcacccccacagaatcgacatcttcgaggactacatctacggcgccggccccaagaacggcgtgttcagagtgcagaagttcggccacggcagcgtggagtacctggccctgaacatcgacaagaccaagggcgtgctgatcagccacagatacaagcagctggacctgcccaacccctgcctggacctggcctgcgagttcctgtgcctgctgaaccccagcggcgccacctgcgtgtgccccgagggcaagtacctgatcaacggcacctgcaacgacgacagcctgctggacgacagctgcaagctgacctgcgagaacggcggcagatgcatcctgaacgagaagggcgacctgagatgccactgctggcccagctacagcggcgagagatgcgaggtgaaccactgcagcaactactgccagaacggcggcacctgcgtgcccagcgtgctgggcagacccacctgcagctgcgccctgggcttcaccggccccaactgcggcaagaccgtgtgcgaggacttctgccagaacggcggcacctgcatcgtgaccgccggcaaccagccctactgccactgccagcccgagtacaccggcgacagatgccagtactacgtgtgccaccactactgcgtgaacagcgagagctgcaccatcggcgacgacggcagcgtggagtgcgtgtgccccaccagatacgagggccccaagtgcgaggtggacaagtgcgtgagatgccacggcggccactgcatcatcaacaaggacagcgaggacatcttctgcaactgcaccaacggcaagatcgccagcagctgccagctgtgcgacggctactgctacaacggcggcacctgccagctggaccccgagaccaacgtgcccgtgtgcctgtgcagcaccaactggagcggcacccagtgcgagagacccgcccccaagagcagcaagagcgaccacatcagcaccagaagcatcgccatcatcgtgcccctggtgctgctggtgaccctgatcaccaccctggtgatcggcctggtgctgtgcaagagaaagagaagaaccaagaccatcagaagacagcccatcatcaacggcggcatcaacgtggagatcggcaaccccagctacaacatgtacgaggtggaccacgaccacaacgacggcggcctgctggaccccggcttcatgatcgaccccaccaaggccagatacatcggcggcggccccagcgccttcaagctgccccacaccgccccccccatctacctgaacagcgacctgaagggccccctgaccgccggccccaccaactacagcaaccccgtgtacgccaagctgtacatggacggccagaactgcagaaacagcctgggcagcgtggacgagagaaaggagctgctgcccaagaagatcgagatcggcatcagagagaccgtggcctag

SEQ ID NO: 11336 - DNA, 843 bp, Artificial Sequence
  Description of Artificial Sequence: Synthetic coding sequence
atgtgccccccccaggcccaggccgaggtgggccccaccatgaccgagaaggccgagatggtgtgcgcccccagccccgcccccgcccccccccccaagcccgccagccccggccccccccaggtggaggaggtgggccacagaggcggcagcagcccccccagactgccccccggcgtgcccgtgatcagcctgggccacagcagaccccccggcgtggccatgcccaccaccgagctgggcaccctgagaccccccctgctgcagctgagcaccctgggcaccgccccccccaccctggccctgcactaccacccccaccccttcctgaacagcgtgtacatcggccccgccggccccttcagcatcttccccagcagcagactgaagagaagacccagccactgcgagctggacctggccgagggccaccagccccagaaggtggccagaagagtgttcaccaacagcagagagagatggagacagcagaacgtgaacggcgccttcgccgagctgagaaagctgctgcccacccacccccccgacagaaagctgagcaagaacgaggtgctgagactggccatgaagtacatcggcttcctggtgagactgctgagagaccaggccgccgccctggccgccggccccaccccccccggccccagaaagagacccgtgcacagagtgcccgacgacggcgccagaagaggcagcggcagaagagccgaggccgccgccagaagccagcccgccccccccgccgaccccgacggcagccccggcggcgccgccagacccatcaagatggagcagaccgccctgagccccgaggtgagatag

SEQ ID NO: 11337 - DNA, 1620 bp, Artificial Sequence
  Description of Artificial Sequence: Synthetic coding sequence
atgggctgcggctgcagcagccaccccgaggacgactggatggagaacatcgacgtgtgcgagaactgccactaccccatcgtgcccctggacggcaagggcaccctgctgatcagaaacggcagcgaggtgagagaccccctggtgacctacgagggcagcaacccccccgccagccccctgcaggacaacctggtgatcgccctgcacagctacgagcccagccacgacggcgacctgggcttcgagaagggcgagcagctgagaatcctggagcagagcggcgagtggtggaaggcccagagcctgaccaccggccaggagggcttcatccccttcaacttcgtggccaaggccaacagcctggagcccgagccctggttcttcaagaacctgagcagaaaggacgccgagagacagctgctggcccccggcaacacccacggcagcttcctgatcagagagagcgagagcaccgccggcagcttcagcctgagcgtgagagacttcgaccagaaccagggcgaggtggtgaagcactacaagatcagaaacctggacaacggcggcttctacatcagccccagaatcaccttccccggcctgcacgagctggtgagacactacaccaacgccagcgacggcctgtgcaccagactgagcagaccctgccagacccagaagccccagaagccctggtgggaggacgagtgggaggtgcccagagagaccctgaagctggtggagagactgggcgccggccagttcggcgaggtgtggatgggctactacaacggccacaccaaggtggccgtgaagagcctgaagcagggcagcatgagccccgacgccttcctggccgaggccaacctgatgaagcagctgcagcaccagagactggtgagactgtacgccgtggtgacccaggagcccatctacatcatcaccgagtacatggagaacgacaccctgctggacagccagctggaggagaagggcctgggcgccagcccctggggcaacctgggccagcagctgctgctgctgcccaccggcagcctggtggacttcctgaagacccccagcggcatcaagctgaccatcaacaagctgctggacatggccgcccagatcgccgagggcatggccttcatcgaggagagaaactacatccacagagacctgagagccgccaacatcctggtgagcgacaccctgagctgcaagatcgccgacttcggcctggccagactgatcgaggacaacgagtacaccgccagagagggcgccaagttccccatcaagtggaccgcccccgaggccatcaactacggcaccttcaccatcaagagcgacgtgtggagcttcggcatcctgctgaccgagatcgtgacccacggcagaatcccctaccccggcatgaccaaccccgaggtgatccagaacctggagagaggctacagaatggtgagacccgacaactgccccgaggagctgtaccagctgatgagactgtgctggaaggagagacccgaggacagacccaccttcgactacctgagaagcgtgctggaggacttcttcaccgccaccgagggccagtaccagccccagccctag

SEQ ID NO: 11338 - DNA, 1530 bp, Artificial Sequence
  Description of Artificial Sequence: Synthetic coding sequence
atgggctgcggctgcagcagccaccccgaggacgactggatggagaacatcgacgtgtgcgagaactgccactaccccatcgtgcccctggacggcaagggcaccctgctgatcagaaacggcagcgaggtgagagaccccctggtgacctacgagggcagcaacccccccgccagccccctgcaggacaacctggtgatcgccctgcacagctacgagcccagccacgacggcgacctgggcttcgagaagggcgagcagctgagaatcctggagcagagcggcgagtggtggaaggcccagagcctgaccaccggccaggagggcttcatccccttcaacttcgtggccaaggccaacagcctggagcccgagccctggttcttcaagaacctgagcagaaaggacgccgagagacagctgctggcccccggcaacacccacggcagcttcctgatcagagagagcgagagcaccgccggcagcttcagcctgagcgtgagagacttcgaccagaaccagggcgaggtggtgaagcactacaagatcagaaacctggacaacggcggcttctacatcagccccagaatcaccttccccggcctgcacgagctggtgagacactacaccaacgccagcgacggcctgtgcaccagactgagcagaccctgccagacccagaagccccagaagccctggtgggaggacgagtgggaggtgcccagagagaccctgaagctggtggagagactgggcgccggccagttcggcgaggtgtggatgggctactacaacggccacaccaaggtggccgtgaagagcctgaagcagggcagcatgagccccgacgccttcctggccgaggccaacctgatgaagcagctgcagcaccagagactggtgagactgtacgccgtggtgacccaggagcccatctacatcatcaccgagtacatggagaacggcagcctggtggacttcctgaagacccccagcggcatcaagctgaccatcaacaagctgctggacatggccgcccagatcgccgagggcatggccttcatcgaggagagaaactacatccacagagacctgagagccgccaacatcctggtgagcgacaccctgagctgcaagatcgccgacttcggcctggccagactgatcgaggacaacgagtacaccgccagagagggcgccaagttccccatcaagtggaccgcccccgaggccatcaactacggcaccttcaccatcaagagcgacgtgtggagcttcggcatcctgctgaccgagatcgtgacccacggcagaatcccctaccccggcatgaccaaccccgaggtgatccagaacctggagagaggctacagaatggtgagacccgacaactgccccgaggagctgtaccagctgatgagactgtgctggaaggagagacccgaggacagacccaccttcgactacctgagaagcgtgctggaggacttcttcaccgccaccgagggccagtaccagccccagccctag

SEQ ID NO: 11339 - DNA, 1551 bp, Artificial Sequence
  Description of Artificial Sequence: Synthetic coding sequence
atgggctgcggctgcagcagccaccccgaggacgactggatggagaacatcgacgtgtgcgagaactgccactaccccatcgtgcccctggacggcaagggcaccctgctgatcagaaacggcagcgaggtgagagaccccctggtgacctacgagggcagcaacccccccgccagccccctgcagggcgaccccagacagcagggcctgaaggacaaggcctgcggcagcctggccgtgggcttccacctgagccccacctacttcctgcccggcctggccttcctggtgccccaccccgtgacccccggcttcctgcccatccccgccagattcagcctgatgcccctggtgttcaccgacaacctggtgatcgccctgcacagctacgagcccagccacgacggcgacctgggcttcgagaagggcgagcagctgagaatcctggagcagagcggcgagtggtggaaggcccagagcctgaccaccggccaggagggcttcatccccttcaacttcgtggccaaggccaacagcctggagcccgagccctggttcttcaagaacctgagcagaaaggacgccgagagacagctgctggcccccggcaacacccacggcagcttcctgatcagagagagcgagagcaccgccggcagcttcagcctgagcgtgagagacttcgaccagaaccagggcgaggtggtgaagcactacaagatcagaaacctggacaacggcggcttctacatcagccccagaatcaccttccccggcctgcacgagctggtgagacactacaccagatactacaacggccacaccaaggtggccgtgaagagcctgaagcagggcagcatgagccccgacgccttcctggccgaggccaacctgatgaagcagctgcagcaccagagactggtgagactgtacgccgtggtgacccaggagcccatctacatcatcaccgagtacatggagaacggcagcctggtggacttcctgaagacccccagcggcatcaagctgaccatcaacaagctgctggacatggccgcccagatcgccgagggcatggccttcatcgaggagagaaactacatccacagagacctgagagccgccaacatcctggtgagcgacaccctgagctgcaagatcgccgacttcggcctggccagactgatcgaggacaacgagtacaccgccagagagggcgccaagttccccatcaagtggaccgcccccgaggccatcaactacggcaccttcaccatcaagagcgacgtgtggagcttcggcatcctgctgaccgagatcgtgacccacggcagaatcccctaccccggcatgaccaaccccgaggtgatccagaacctggagagaggctacagaatggtgagacccgacaactgccccgaggagctgtaccagctgatgagactgtgctggaaggagagacccgaggacagacccaccttcgactacctgagaagcgtgctggaggacttcttcaccgccaccgagggccagtaccagccccagccctag

SEQ ID NO: 11340 - DNA, 750 bp, Artificial Sequence
  Description of Artificial Sequence: Synthetic coding sequence
atgggctactacaacggccacaccaaggtggccgtgaagagcctgaagcagggcagcatgagccccgacgccttcctggccgaggccaacctgatgaagcagctgcagcaccagagactggtgagactgtacgccgtggtgacccaggagcccatctacatcatcaccgagtacatggagaacggcagcctggtggacttcctgaagacccccagcggcatcaagctgaccatcaacaagctgctggacatggccgcccagatcgccgagggcatggccttcatcgaggagagaaactacatccacagagacctgagagccgccaacatcctggtgagcgacaccctgagctgcaagatcgccgacttcggcctggccagactgatcgaggacaacgagtacaccgccagagagggcgccaagttccccatcaagtggaccgcccccgaggccatcaactacggcaccttcaccatcaagagcgacgtgtggagcttcggcatcctgctgaccgagatcgtgacccacggcagaatcccctaccccggcatgaccaaccccgaggtgatccagaacctggagagaggctacagaatggtgagacccgacaactgccccgaggagctgtaccagctgatgagactgtgctggaaggagagacccgaggacagacccaccttcgactacctgagaagcgtgctggaggacttcttcaccgccaccgagggccagtaccagccccagccctag

SEQ ID NO: 11341 - DNA, 1611 bp, Artificial Sequence
  Description of Artificial Sequence: Synthetic coding sequence
atgggcatccccggcagccacaacctgagatacttctggaacttccccggccagggccccatcatcagcgacgtgggcggcgccgacctgggcggcgcccccagcgcccccagcagcatccccagcggcaccatgggctgcggctgcagcagccaccccgaggacgactggatggagaacatcgacgtgtgcgagaactgccactaccccatcgtgcccctggacggcaagggcaccctgctgatcagaaacggcagcgaggtgagagaccccctggtgacctacgagggcagcaacccccccgccagccccctgcaggacaacctggtgatcgccctgcacagctacgagcccagccacgacggcgacctgggcttcgagaagggcgagcagctgagaatcctggagcagagcggcgagtggtggaaggcccagagcctgaccaccggccaggagggcttcatccccttcaacttcgtggccaaggccaacagcctggagcccgagccctggttcttcaagaacctgagcagaaaggacgccgagagacagctgctggcccccggcaacacccacggcagcttcctgatcagagagagcgagagcaccgccggcagcttcagcctgagcgtgagagacttcgaccagaaccagggcgaggtggtgaagcactacaagatcagaaacctggacaacggcggcttctacatcagccccagaatcaccttccccggcctgcacgagctggtgagacactacaccaacgccagcgacggcctgtgcaccagactgagcagaccctgccagacccagaagccccagaagccctggtgggaggacgagtgggaggtgcccagagagaccctgaagctggtggagagactgggcgccggccagttcggcgaggtgtggatgggctactacaacggccacaccaaggtggccgtgaagagcctgaagcagggcagcatgagccccgacgccttcctggccgaggccaacctgatgaagcagctgcagcaccagagactggtgagactgtacgccgtggtgacccaggagcccatctacatcatcaccgagtacatggagaacggcagcctggtggacttcctgaagacccccagcggcatcaagctgaccatcaacaagctgctggacatggccgcccagatcgccgagggcatggccttcatcgaggagagaaactacatccacagagacctgagagccgccaacatcctggtgagcgacaccctgagctgcaagatcgccgacttcggcctggccagactgatcgaggacaacgagtacaccgccagagagggcgccaagttccccatcaagtggaccgcccccgaggccatcaactacggcaccttcacccacggcagaatcccctaccccggcatgaccaaccccgaggtgatccagaacctggagagaggctacagaatggtgagacccgacaactgccccgaggagctgtaccagctgatgagactgtgctggaaggagagacccgaggacagacccaccttcgactacctgagaagcgtgctggaggacttcttcaccgccaccgagggccagtaccagccccagccctag

SEQ ID NO: 11342 - DNA, 1200 bp, Artificial Sequence
  Description of Artificial Sequence: Synthetic coding sequence
atgccccagctgagcggcggcggcggcggcggcggcggcgaccccgagctgtgcgccaccgacgagatgatccccttcaaggacgagggcgacccccagaaggagaagatcttcgccgagatcagccaccccgaggaggagggcgacctggccgacatcaagagcagcctggtgaacgagagcgagatcatccccgccagcaacggccacgaggtggccagacaggcccagaccagccaggagccctaccacgacaaggccagagagcaccccgacgacggcaagcaccccgacggcggcctgtacaacaagggccccagctacagcagctacagcggctacatcatgatgcccaacatgaacaacgacccctacatgagcaacggcagcctgagcccccccatccccagaaccagcaacaaggtgcccgtggtgcagcccagccacgccgtgcaccccctgacccccctgatcacctacagcgacgagcacttcagccccggcagccaccccagccacatccccagcgacgtgaacagcaagcagggcatgagcagacacccccccgcccccgacatccccaccttctaccccctgagccccggcggcgtgggccagatcaccccccccctgggctggcagggccagcccgtgtaccccatcaccggcggcttcagacagccctaccccagcagcctgagcgtggacaccagcatgagcagattcagccaccacatgatccccggcccccccggcccccacaccaccggcatcccccaccccgccatcgtgaccccccaggtgaagcaggagcacccccacaccgacagcgacctgatgcacgtgaagccccagcacgagcagagaaaggagcaggagcccaagagaccccacatcaagaagcccctgaacgccttcatgctgtacatgaaggagatgagagccaacgtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagagaagctgcaggagagcgccagcggcaccggccccagaatgaccgccgcctacatctag

SEQ ID NO: 11343 - DNA, 1161 bp, Artificial Sequence
  Description of Artificial Sequence: Synthetic coding sequence
atgccccagctgagcggcggcggcggcggcggcggcggcgaccccgagctgtgcgccaccgacgagatgatccccttcaaggacgagggcgacccccagaaggagaagatcttcgccgagatcagccaccccgaggaggagggcgacctggccgacatcaagagcagcctggtgaacgagagcgagatcatccccgccagcaacggccacgaggtggccagacaggcccagaccagccaggagccctaccacgacaaggccagagagcaccccgacgacggcaagcaccccgacggcggcctgtacaacaagggccccagctacagcagctacagcggctacatcatgatgcccaacatgaacaacgacccctacatgagcaacggcagcctgagcccccccatccccagaaccagcaacaaggtgcccgtggtgcagcccagccacgccgtgcaccccctgacccccctgatcacctacagcgacgagcacttcagccccggcagccaccccagccacatccccagcgacgtgaacagcaagcagggcatgagcagacacccccccgcccccgacatccccaccttctaccccctgagccccggcggcgtgggccagatcaccccccccctgggctggttcagccaccacatgatccccggcccccccggcccccacaccaccggcatcccccaccccgccatcgtgaccccccaggtgaagcaggagcacccccacaccgacagcgacctgatgcacgtgaagccccagcacgagcagagaaaggagcaggagcccaagagaccccacatcaagaagcccctgaacgccttcatgctgtacatgaaggagatgagagccaacgtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagagaagctgcaggagagcgccagcggcggcaagagaagcagcttccccacctgcaaggccaaggccgccacccccggccccctgctggagatggaggcctgctag

SEQ ID NO: 11344 - DNA, 1116 bp, Artificial Sequence
  Description of Artificial Sequence: Synthetic coding sequence
atgccccagctgagcggcggcggcggcggcggcggcggcgaccccgagctgtgcgccaccgacgagatgatccccttcaaggacgagggcgacccccagaaggagaagatcttcgccgagatcagccaccccgaggaggagggcgacctggccgacatcaagagcagcctggtgaacgagagcgagatcatccccgccagcaacggccacgaggtggccagacaggcccagaccagccaggagccctaccacgacaaggccagagagcaccccgacgacggcaagcaccccgacggcggcctgtacaacaagggccccagctacagcagctacagcggctacatcatgatgcccaacatgaacaacgacccctacatgagcaacggcagcctgagcccccccatccccagaaccagcaacaaggtgcccgtggtgcagcccagccacgccgtgcaccccctgacccccctgatcacctacagcgacgagcacttcagccccggcagccaccccagccacatccccagcgacgtgaacagcaagcagggcatgagcagacacccccccgcccccgacatccccaccttctaccccctgagccccggcggcgtgggccagatcaccccccccctgggctggttcagccaccacatgatccccggcccccccggcccccacaccaccggcatcccccaccccgccatcgtgaccccccaggtgaagcaggagcacccccacaccgacagcgacctgatgcacgtgaagccccagcacgagcagagaaaggagcaggagcccaagagaccccacatcaagaagcccctgaacgccttcatgctgtacatgaaggagatgagagccaacgtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagagaagctgcaggagagcgccagcggcaccggccccagaatgaccgccgcctacatctag

SEQ ID NO: 11345 - DNA, 912 bp, Artificial Sequence
  Description of Artificial Sequence: Synthetic coding sequence
atggccgaggtggccagacaggcccagaccagccaggagccctaccacgacaaggccagagagcaccccgacgacggcaagcaccccgacggcggcctgtacaacaagggccccagctacagcagctacagcggctacatcatgatgcccaacatgaacaacgacccctacatgagcaacggcagcctgagcccccccatccccagaaccagcaacaaggtgcccgtggtgcagcccagccacgccgtgcaccccctgacccccctgatcacctacagcgacgagcacttcagccccggcagccaccccagccacatccccagcgacgtgaacagcaagcagggcatgagcagacacccccccgcccccgacatccccaccttctaccccctgagccccggcggcgtgggccagatcaccccccccctgggctggttcagccaccacatgatccccggcccccccggcccccacaccaccggcatcccccaccccgccatcgtgaccccccaggtgaagcaggagcacccccacaccgacagcgacctgatgcacgtgaagccccagcacgagcagagaaaggagcaggagcccaagagaccccacatcaagaagcccctgaacgccttcatgctgtacatgaaggagatgagagccaacgtggtggccgagtgcaccctgaaggagagcgccgccatcaaccagatcctgggcagaagatggcacgccctgagcagagaggagcaggccaagtactacgagctggccagaaaggagagacagctgcacatgcagctgtaccccggctggagcgccagagacaactacggcaagaagaagaagagaaagagagagaagctgcaggagagcgccagcggcaccggccccagaatgaccgccgcctacatctag

SEQ ID NO: 11346 - DNA, 1500 bp, Artificial Sequence
  Description of Artificial Sequence: Synthetic coding sequence
atgaacgacgaccccagcatggaggagaacggcgtggagagagtgtgccccgagagcctgctgcagagcagagagtacagcagcctgcccctgcccagacacaccagcagcaccgacggcaccatcaccagcagcgaccccggcctggagatcctgaacatggccagctgcgacctggacagaaacagcctgtgcaagaaggaggaggacaccagaagcgccagccccaccatcgaggcccagggcaccagccccgcccacgacaacatcgccttccaggacagcaccagcaaggacaagaccatcctgaacctggaggccaaggaggagcccgagaccatcgaggagcacaagaaggagcacgccagcggcgacagcgtggtgagccccctgcccgtgaccaccgtgaagagcgtgaacctgagacagagcgagaacaccagcgccaacgagaaggaggtggaggccgagttcctgagactgagcctgggcttcaagtgcgactggttcaccctggagaagagagtgaagctggaggagagaagcagagacctggccgaggagaacctgaagaaggagatcaccaactgcctgaagctgctggagagcctgacccccctgtgcgaggacgacaaccaggcccaggagatcatcaagaagctggagaagagcatcaagttcctgagccagtgcgccgccagagtggccagcagagccgagatgctgggcgccatcaaccaggagagcagagtgagcaaggccgtggaggtgatgatccagcacgtggagaacctgaagagaatgtacgccaaggagcacgccgagctggaggagctgaagcaggtgctgctgcagaacgagagaagcttcaaccccctggaggacgacgacgactgccagatcaagaagagaagcgccagcctgaacagcaagcccagcagcctgagaagagtgaccatcgccagcctgcccagaaacatcggcaacgccggcatggtggccggcatggagaacaacgacagattcagcagaagaagcagcagctggagaatcctgggcagcaagcagagcgagcacagacccagcctgcccagattcatcagcacctacagctgggccgacgccgaggaggagaagtgcgagctgaagaccaaggacgacagcgagcccagcggcgaggagaccgtggagagaaccagaaagcccagcctgagcgagaagaagaacaaccccagcaagtgggacgtgagcagcgtgtacgacaccatcgccagctgggccaccaacctgaagagcagcatcagaaaggccaacaaggccctgtggctgagcatcgccttcatcgtgctgttcgccgccctgatgagcttcctgaccggccagctgttccagaagagcgtggacgccgcccccacccagcaggaggacagctggaccagcctggagcacatcctgtggcccttcaccagactgagacacaacggccccccccccgtgtag

SEQ ID NO: 11347 - DNA, 1500 bp, Artificial Sequence; identical to SEQ ID NO: 11346
  Description of Artificial Sequence: Synthetic coding sequence

SEQ ID NO: 11348 - DNA, 1500 bp, Artificial Sequence; identical to SEQ ID NO: 11346
  Description of Artificial Sequence: Synthetic coding sequence

SEQ ID NO: 11349 - DNA, 234 bp, Artificial Sequence
  Description of Artificial Sequence: Synthetic coding sequence
atgaacgacgaccccagcatggaggagaacggcgtggagagagtgtgccccgagagcctgctgcagagcagagagtacagcagcctgcccctgcccagacacaccagcagcaccgacggcaccatcaccagcagcgaccccggcctggagatcctgaacatggccagctgcgacctggacagaaacagcctgtgcaagaaggaggaggacaccagaagcgccagccccacctag

SEQ ID NO: 11350 - DNA, 27 bp, Artificial Sequence
  Description of Artificial Sequence: Synthetic coding sequence
atgaacgacgaccccagcatggagtag

SEQ ID NO: 11351 - DNA, 618 bp, Artificial Sequence
  Description of Artificial Sequence: Synthetic coding sequence
atgaccccccccgagagactgttcctgcccagagtgagaggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaccctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtaccccggcctgcaggagccctggctgcacagcatgtaccacggcgccgccttccagctgacccagggcgaccagctgagcacccacaccgacggcatcccccacctggtgctgagccccagcaccgtgttcttcggcgccttcgccctgtag

SEQ ID NO: 11352 - DNA, 618 bp, Artificial Sequence; identical to SEQ ID NO: 11351
  Description of Artificial Sequence: Synthetic coding sequence

SEQ ID NO: 11353 - DNA, 417 bp, Artificial Sequence
  Description of Artificial Sequence: Synthetic coding sequence
atgaccccccccgagagactgttcctgcccagagtgagaggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaccctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccagggcagcagcccccccctgctgtggcccttccagcagctgaagagcagcctgatcaagagccccgagctgagcaagaagtag

SEQ ID NO: 11354 - DNA, 2010 bp, Artificial Sequence
  Description of Artificial Sequence: Synthetic coding sequence
atggagggcaacaagctggaggagcaggacagcagccccccccagagcacccccggcctgatgaagggcaacaagagagaggagcagggcctgggccccgagcccgccgccccccagcagcccaccgccgaggaggaggccctgatcgagttccacagaagctacagagagctgttcgagttcttctgcaacaacaccaccatccacggcgccatcagactggtgtgcagccagcacaacagaatgaagaccgccttctgggccgtgctgtggctgtgcaccttcggcatgatgtactggcagttcggcctgctgttcggcgagtacttcagctaccccgtgagcctgaacatcaacctgaacagcgacaagctggtgttccccgccgtgaccatctgcaccctgaacccctacagataccccgagatcaaggaggagctggaggagctggacagaatcaccgagcagaccctgttcgacctgtacaagtacagcagcttcaccaccctggtggccggcagcagaagcagaagagacctgagaggcaccctgccccaccccctgcagagactgagagtgcccccccccccccacggcgccagaagagccagaagcgtggccagcagcctgagagacaacaacccccaggtggactggaaggactggaagatcggcttccagctgtgcaaccagaacaagagcgactgcttctaccagacctacagcagcggcgtggacgccgtgagagagtggtacagattccactacatcaacatcctgagcagactgcccgagaccctgcccagcctggaggaggacaccctgggcaacttcatcttcgcctgcagattcaaccaggtgagctgcaaccaggccaactacagccacttccaccaccccatgtacggcaactgctacaccttcaacgacaagaacaacagcaacctgtggatgagcagcatgcccggcatcaacaacggcctgagcctgatgctgagagccgagcagaacgacttcatccccctgctgagcaccgtgaccggcgccagagtgatggtgcacggccaggacgagcccgccttcatggacgacggcggcttcaacctgagacccggcgtggagaccagcatcagcatgagaaaggagaccctggacagactgggcggcgactacggcgactgcaccaagaacggcagcgacgtgcccgtggagaacctgtaccccagcaagtacacccagcaggtgtgcatccacagctgcttccaggagagcatgatcaaggagtgcggctgcgcctacatcttctaccccagaccccagaacgtggagtactgcgactacagaaagcacagcagctggggctactgctactacaagctgcaggtggacttcagcagcgaccacctgggctgcttcaccaagtgcagaaagccctgcagcgtgaccagctaccagctgagcgccggctacagcagatggcccagcgtgaccagccaggagtgggtgttccagatgctgagcagacagaacaactacaccgtgaacaacaagagaaacggcgtggccaaggtgaacatcttcttcaaggagctgaactacaagaccaacagcgagagccccagcgtgaccatggtgaccctgctgagcaacctgggcagccagtggagcctgtggttcggcagcagcgtgctgagcgtggtggagatggccgagctggtgttcgacctgctggtgatcatgttcctgatgctgctgagaagattcagaagcagatactggagccccggcagaggcggcagaggcgcccaggaggtggccagcaccctggccagcagcccccccagccacttctgcccccaccccatgagcctgagcctgagccagcccggccccgcccccagccccgccctgaccgcccccccccccgcctacgccaccctgggccccagacccagccccggcggcagcgccggcgccagcagcagcacctgccccctgggcggcccctag

SEQ ID NO: 11355 - DNA, 987 bp, Artificial Sequence
  Description of Artificial Sequence: Synthetic coding sequence
atgggcctggaggagatcgccccctgcaccagcaagagaaagacccagtgcagatgccagcccggcatgttctgcgccgcctgggccctggagtgcacccactgcgagctgctgagcgactgcccccccggcaccgaggccgagctgaaggacgaggtgggcaagggcaacaaccactgcgtgccctgcaaggccggccacttccagaacaccagcagccccagcgccagatgccagccccacaccagatgcgagaaccagggcctggtggaggccgcccccggcaccgcccagagcgacaccacctgcaagaaccccctggagcccctgccccccgagatgagcggcaccatgctgatgctggccgtgctgctgcccctggccttcttcctgctgctggccaccgtgttcagctgcatctggaagagccaccccagcctgtgcagaaagctgggcagcctgctgaagagaagaccccagggcgagggccccaaccccgtggccggcagctgggagccccccaaggcccacccctacttccccgacctggtgcagcccctgctgcccatcagcggcgacgtgagccccgtgagcaccggcctgcccgccgcccccgtgctggaggccggcgtgccccagcagcagagccccctggacctgaccagagagccccagctggagcccggcgagcagagccaggtggcccacggcaccaacggcatccacgtgaccggcggcagcatgaccatcaccggcaacatctacatctacaacggccccgtgctgggcggcccccccggccccggcgacctgcccgccacccccgagcccccctaccccatccccgaggagggcgaccccggcccccccggcctgagcaccccccaccaggaggacggcaaggcctggcacctggccgagaccgagcactgcggcgccacccccagcaacagaggccccagaaaccagttcatcacccacgactag

SEQ ID NO: 11356 - DNA, 1725 bp, Artificial Sequence
  Description of Artificial Sequence: Synthetic coding sequence
atggccctggccagaggcagcagacagctgggcgccctggtgtggggcgcctgcctgtgcgtgctggtgcacggccagcaggcccagcccggccagggcagcgaccccgccagatggagacagctgatccagtgggagaacaacggccaggtgtacagcctgctgaacagcggcagcgagtacgtgcccgccggcccccagagaagcgagagcagcagcagagtgctgctggccggcgccccccaggcccagcagagaagaagccacggcagccccagaagaagacaggcccccagcctgcccctgcccggcagagtgggcagcgacaccgtgagaggccaggccagacaccccttcggcttcggccaggtgcccgacaactggagagaggtggccgtgggcgacagcaccggcatggccagagccagaaccagcgtgagccagcagagacacggcggcagcgccagcagcgtgagcgccagcgccttcgccagcacctacagacagcagcccagctacccccagcagttcccctacccccaggcccccttcgtgagccagtacgagaactacgaccccgccagcagaacctacgaccagggcttcgtgtactacagacccgccggcggcggcgtgggcgccggcgccgccgccgtggccagcgccggcgtgatctacccctaccagcccagagccagatacgaggagtacggcggcggcgaggagctgcccgagtaccccccccagggcttctaccccgcccccgagagaccctacgtgcccccccccccccccccccccgacggcctggacagaagatacagccacagcctgtacagcgagggcacccccggcttcgagcaggcctaccccgaccccggccccgaggccgcccaggcccacggcggcgaccccagactgggctggtaccccccctacgccaaccccccccccgaggcctacggcccccccagagccctggagcccccctacctgcccgtgagaagcagcgacacccccccccccggcggcgagagaaacggcgcccagcagggcagactgagcgtgggcagcgtgtacagacccaaccagaacggcagaggcctgcccgacctggtgcccgaccccaactacgtgcaggccagcacctacgtgcagagagcccacctgtacagcctgagatgcgccgccgaggagaagtgcctggccagcaccgcctacgcccccgaggccaccgactacgacgtgagagtgctgctgagattcccccagagagtgaagaaccagggcaccgccgacttcctgcccaacagacccagacacacctgggagtggcacagctgccaccagcactaccacagcatggacgagttcagccactacgacctgctggacgccgccaccggcaagaaggtggccgagggccacaaggccagcttctgcctggaggacagcacctgcgacttcggcaacctgaagagatacgcctgcaccagccacacccagggcctgagccccggctgctacgacacctacaacgccgacatcgactgccagtggatcgacatcaccgacgtgcagcccggcaactacatcctgaaggtgcacgtgaaccccaagtacatcgtgctggagagcgacttcaccaacaacgtggtgagatgcaacatccactacaccggcagatacgtgagcgccaccaactgcaagatcgtgcagagctag

SEQ ID NO: 11357 - DNA, 1311 bp, Artificial Sequence
  Description of Artificial Sequence: Synthetic coding sequence
atggccagagccagaaccagcgtgagccagcagagacacggcggcagcgccagcagcgtgagcgccagcgccttcgccagcacctacagacagcagcccagctacccccagcagttcccctacccccaggcccccttcgtgagccagtacgagaactacgaccccgccagcagaacctacgaccagggcttcgtgtactacagacccgccggcggcggcgtgggcgccggcgccgccgccgtggccagcgccggcgtgatctacccctaccagcccagagccagatacgaggagtacggcggcggcgaggagctgcccgagtaccccccccagggcttctaccccgcccccgagagaccctacgtgcccccccccccccccccccccgacggcctggacagaagatacagccacagcctgtacagcgagggcacccccggcttcgagcaggcctaccccgaccccggccccgaggccgcccaggcccacggcggcgaccccagactgggctggtaccccccctacgccaaccccccccccgaggcctacggcccccccagagccctggagcccccctacctgcccgtgagaagcagcgacacccccccccccggcggcgagagaaacggcgcccagcagggcagactgagcgtgggcagcgtgtacagacccaaccagaacggcagaggcctgcccgacctggtgcccgaccccaactacgtgcaggccagcacctacgtgcagagagcccacctgtacagcctgagatgcgccgccgaggagaagtgcctggccagcaccgcctacgcccccgaggccaccgactacgacgtgagagtgctgctgagattcccccagagagtgaagaaccagggcaccgccgacttcctgcccaacagacccagacacacctgggagtggcacagctgccaccagcactaccacagcatggacgagttcagccactacgacctgctggacgccgccaccggcaagaaggtggccgagggccacaaggccagcttctgcctggaggacagcacctgcgacttcggcaacctgaagagatacgcctgcaccagccacacccagggcctgagccccggctgctacgacacctacaacgccgacatcgactgccagtggatcgacatcaccgacgtgcagcccggcaactacatcctgaaggtgcacgtgaaccccaagtacatcgtgctggagagcgacttcaccaacaacgtggtgagatgcaacatccactacaccggcagatacgtgagcgccaccaactgcaagatcgtgcagagctag

SEQ ID NO: 11358 - DNA, 636 bp, Artificial Sequence
  Description of Artificial Sequence: Synthetic coding sequence
atgaccaccctgaccagacaggacctgaacttcggccaggtggtggccgacgtgctgtgcgagttcctggaggtggccgtgcacctgatcctgtacgtgagagaggtgtaccccgtgggcatcttccagaagagaaagaagtacaacgtgcccgtgcagatgagctgccaccccgagctgaaccagtacatccaggacaccctgcactgcgtgaagcccctgctggagaagaacgacgtggagaaggtggtggtggtgatcctggacaaggagcacagacccgtggagaagttcgtgttcgagatcacccagccccccctgctgagcatcagcagcgacagcctgctgagccacgtggagcagctgctgagagccttcatcctgaagatcagcgtgtgcgacgccgtgctggaccacaacccccccggctgcaccttcaccgtgctggtgcacaccagagaggccgccaccagaaacatggagaagatccaggtgatcaaggacttcccctggatcctggccgacgagcaggacgtgcacatgcacgaccccagactgatccccctgaagaccatgaccagcgacatcctgaagatgcagctgtacgtggaggagagagcccacaagggcagctag

SEQ ID NO: 11359 - DNA, 318 bp, Artificial Sequence
  Description of Artificial Sequence: Synthetic coding sequence
atgaccaccctgaccagacaggacctgaacttcggccaggtggtggccgacgtgctgtgcgagttcctggaggtggccgtgcacctgatcctgtacgtgagagaggtgtaccccgtgggcatcttccagaagagaaagaagtacaacgtgcccgtgcagatgagctgccaccccgagctgaaccagtacatccaggacaccctgcactgcgtgaagcccctgctggagaaggtgagagtgcactgggccccccagcccagccaccccatgctgacccccgtgcccgtgtgcagccagagcaacagcggcatgggctag

SEQ ID NO: 11360 - DNA, 531 bp, Artificial Sequence
  Description of Artificial Sequence: Synthetic coding sequence
atgaccaccctgaccagacaggacctgaacttcggccaggtggtggccgacgtgctgtgcgagttcctggaggtggccgtgcacctgatcctgtacgtgagagaggtgtaccccgtgggcatcttccagaagagaaagaagtacaacgtgcccgtgcagaacgacgtggagaaggtggtggtggtgatcctggacaaggagcacagacccgtggagaagttcgtgttcgagatcacccagccccccctgctgagcatcagcagcgacagcctgctgagccacgtggagcagctgctgagagccttcatcctgaagatcagcgtgtgcgacgccgtgctggaccacaacccccccggcgtgagcaccccccaccccctgttcccctggcacttccacggctacctgggcctggtgtgcgtgcccagaagcatgttcggctgcagcgagacccacctgttcctgaccctgagagtgcacctgctgtgggaggccagcctgatcgacagcacctggctgcccagcccctactag

SEQ ID NO: 11361 - DNA, 636 bp, Artificial Sequence; identical to SEQ ID NO: 11358
  Description of Artificial Sequence: Synthetic coding sequence

SEQ ID NO: 11362 - DNA, 675 bp, Artificial Sequence
  Description of Artificial Sequence: Synthetic coding sequence
atgaccaccctgaccagacaggacctgaacttcggccaggtggtggccgacgtgctgtgcgagttcctggaggtggccgtgcacctgatcctgtacgtgagagaggtgtaccccgtgggcatcttccagaagagaaagaagtacaacgtgcccgtgcagatgagctgccaccccgagctgaaccagtacatccaggacaccctgcactgcgtgaagcccctgctggagaagaacgacgtggagaaggtggtggtggtgatcctggacaaggagcacagacccgtggagaagttcgtgttcgagatcacccagccccccctgctgagcatcagatgggccgcccccgcccccagacccctggccggcatcagcagcgacagcctgctgagccacgtggagcagctgctgagagccttcatcctgaagatcagcgtgtgcgacgccgtgctggaccacaacccccccggctgcaccttcaccgtgctggtgcacaccagagaggccgccaccagaaacatggagaagatccaggtgatcaaggacttcccctggatcctggccgacgagcaggacgtgcacatgcacgaccccagactgatccccctgaagaccatgaccagcgacatcctgaagatgcagctgtacgtggaggagagagcccacaagggcagctag

SEQ ID NO: 11363 - DNA, 675 bp, Artificial Sequence; identical to SEQ ID NO: 11362
  Description of Artificial Sequence: Synthetic coding sequence

SEQ ID NO: 11364 - DNA, 636 bp, Artificial Sequence; identical to SEQ ID NO: 11358
  Description of Artificial Sequence: Synthetic coding sequence

SEQ ID NO: 11365 - DNA, 597 bp, Artificial Sequence
  Description of Artificial Sequence: Synthetic coding sequence
atgaccaccctgaccagacaggacctgaacttcggccagggcagagaggccggccccgccggccccggcgccggcgccagcggccccgccggcttcctggagagagccaccggcctgtgcccccccgccgtggtggccgacgtgctgtgcgagttcctggaggtggccgtgcacctgatcctgtacgtgagagaggtgtaccccgtgggcatcttccagaagagaaagaagtacaacgtgcccgtgcagatgagctgccaccccgagctgaaccagtacatccaggacaccctgcactgcgtgaagcccctgctggagaagaacgacgtggagaaggtggtggtggtgatcctggacaaggagcacagacccgtggagaagttcgtgttcgagatcacccagccccccctgctgagcatcagcagcgacagcctgctgagccacgtggagcagctgctgagagccttcatcctgaagatcagcgtgtgcgacgccgtgctggaccacaacccccccggctgcaccttcaccgtgctggtgcacaccagagaggccgccaccagaaacatggagaagatccaggtgatcaaggtgtag

SEQ ID NO: 11366 - DNA, 504 bp, Artificial Sequence
  Description of Artificial Sequence: Synthetic coding sequence
atgaccaccctgaccagacaggacctgaacttcggccaggtggtggccgacgtgctgtgcgagttcctggaggtggccgtgcacctgatcctgtacgtgagagaggtgtaccccgtgggcatcttccagaagagaaagaagtacaacgtgcccgtgcagatgagctgccaccccgagctgaaccagtacatccaggacaccctgcactgcgtgaagcccctgctggagaagaacgacgtggagaaggtggtggtggtgatcctggacaaggagcacagacccgtggagaagttcgtgttcgagatcacccagccccccctgctgagcatcagcagcgacagcctgctgagccacgtggagcagctgctgagagccttcatcctgaagatcagcgtgtgcgacgccgtgctggaccacaacccccccggctgcaccttcaccgtgctggtgcacaccagagaggccgccaccagaaacatggagaagatccaggtgatcaagtag

SEQ ID NO: 11367 - DNA, 3159 bp, Artificial Sequence
  Description of Artificial Sequence: Synthetic coding sequence
atggccggcatggacagcggcaacctgaagaccgccagactgtggagagacgccgccctgagagccagaaagctgagaagcaacctgagacagctgaccctgaccgccgccggcgcctgccccggcgccggcgccgacgccctggagagccccgccagcccccagctggtgctgcccgccaacctgggcgacatcgaggccctgaacctgggcaacaacggcctggaggaggtgcccgagggcctgggcagcgccctgggcagcctgagagtgctggtgctgagaagaaacagattcgccagactgccccccgccgtggccgagctgggccaccacctgaccgagctggacgtgagccacaacagactgaccgccctgggcgccgaggtggtgagcgccctgagagagctgagaaagctgaacctgagccacaaccagctgcccgccctgcccgcccagctgggcgccctggcccacctggaggagctggacgtgagcttcaacagactggcccacctgcccgacagcctgagctgcctgagcagactgagaaccctggacgtggaccacaaccagctgaccgccttccccagacagctgctgcagctggtggccctggaggagctggacgtgagcagcaacagactgagaggcctgcccgaggacatcagcgccctgagagccctgaagatcctgtggctgagcggcgccgagctgggcaccctgcccgccggcttctgcgagctggccagcctggagagcctgatgctggacaacaacggcctgcaggccctgcccgcccagttcagctgcctgcagagactgaagatgctgaacctgagcagcaacctgttcgaggagttccccgccgccctgctgcccctggccggcctggaggagctgtacctgagcagaaaccagctgaccagcgtgcccagcctgatcagcggcctgggcagactgctgaccctgtggctggacaacaacagaatcagatacctgcccgacagcatcgtggagctgaccggcctggaggagctggtgctgcagggcaaccagatcgccgtgctgcccgaccacttcggccagctgagcagagtgggcctgtggaagatcaaggacaaccccctgatccagcccccctacgaggtgtgcatgaagggcatcccctacatcgccgcctaccagaaggagctggcccacagccagcccgccgtgcagcccagactgaagctgctgctgatgggccacaaggccgccggcaagaccctgctgagacactgcctgaccgaggagagagtggagggctgccccggcggcggcgacaaggagaagtgctacccccccagccccccccccgtgagcaagggcatcgaggtgaccagctggaccgccgacgccagcagaggcctgagattcatcgtgtacgacctggccggcgacgagagctacgaggtgatccagcccttcttcctgagccccggcgccctgtacgtgctggtggtgaacctggccacctacgagcccagacacttccccaccaccgtgggcagcttcctgcacagagtgggcgccagagtgccccacgccgtggtgtgcatcgtgggcacccacgccgacctgtgcggcgagagagagctggaggagaagtgcctggacatccacagacagatcgccctgcaggagaagcacgacgccgagggcctgagcagactggccaaggtggtggacgaggccctggccagagacttcgagctgagaagcgccagcccccacgccgcctactacggcgtgagcgacaagaacctgagaagaagaaaggcccacttccagtacctgctgaaccacagactgcagatcctgagccccgtgctgcccgtgagctgcagagaccccagacacctgagaagactgagagacaagctgctgagcgtggccgagcacagagagatcttccccaacctgcacagagtgctgcccagaagctggcaggtgctggaggagctgcacttccagcccccccaggcccagagactgtggctgagctggtgggacagcgccagactgggcctgcaggccggcctgaccgaggacagactgcagagcgccctgagctacctgcacgagagcggcaagctgctgtacttcgaggacagccccgccctgaaggagcacgtgttccacaacctgaccagactgatcgacatcctgaacgtgttcttccagagagaccccagcctgctgctgcacaagctgctgctgggcaccagcggcgagggcaaggccgagggcgagagcagcccccccatggccagaagcacccccagccaggagctgctgagagccacccagctgcaccagtacgtggagggcttcctgctgcacggcctgctgcccgcccacgtgatcagactgctgctgaagccccacgtgcaggcccagcaggacctgcagctgctgctggagctgctggagaagatgggcctgtgctactgcctgaacaagcccaagggcaagcccctgaacggcagcaccgcctggtacaagttcccctgctacgtgcagaacgaggtgccccacgccgaggcctggatcaacggcaccaacctggccggccagagcttcgtggccgagcagctgcagatcgagtacagcttccccttcaccttccccctgggcctgttcgccagatacagcgtgcagatcaacagccacgtggtgcacagaagcgacggcaagttccagatcttcgcctacagaggcaaggtgcccgtggtggtgagctacagacccgccagaggcgtgctgcagcccgacaccctgagcatcgccagccacgccagcctgcccaacatctggaccgcctggcaggccatcacccccctggtggaggagctgaacgtgctgctgcaggagtggcccggcctgcactacaccgtgcacatcctgtgcagcaagtgcctgaagagaggcagccccaacccccacgccttccccggcgagctgctgagccagcccagacccgagggcgtggccgagatcatctgccccaagaacggcagcgagagagtgaacgtggccctggtgtacccccccacccccaccgtgatcagcccctgcagcaagaagaacgtgggcgagaagcacagaaaccagtag

SEQ ID NO: 11368 - DNA, 549 bp, Artificial Sequence
  Description of Artificial Sequence: Synthetic coding sequence
atgggcaagggcagattcgacgagaaggagaacgtgagcaactgcatccagctgaagaccagcgtgatcaagggcatcaagaaccagctgatcgagcagttccccggcatcgagccctggctgaaccagatcatgcccaagaaggaccccgtgaagatcgtgagatgccacgagcacatcgagatcctgaccgtgaacggcgagctgctgttcttcagacagagagagggccccttctaccccaccctgagactgctgcacaagtaccccttcatcctgccccaccagcaggtggacaagggcgccatcaagttcgtgctgagcggcgccaacatcatgtgccccggcctgaccagccccggcgccaagctgtaccccgccgccgtggacaccatcgtggccatcatggccgagggcaagcagcacgccctgtgcgtgggcgtgatgaagatgagcgccgaggacatcgagaaggtgaacaagggcatcggcatcgagaacatccactacctgaacgacggcctgtggcacatgaagacctacaagtag

SEQ ID NO: 11369 - DNA, 546 bp, Artificial Sequence
  Description of Artificial Sequence: Synthetic coding sequence
atgttcaagaagttcgacgagaaggagaacgtgagcaactgcatccagctgaagaccagcgtgatcaagggcatcaagaaccagctgatcgagcagttccccggcatcgagccctggctgaaccagatcatgcccaagaaggaccccgtgaagatcgtgagatgccacgagcacatcgagatcctgaccgtgaacggcgagctgctgttcttcagacagagagagggccccttctaccccaccctgagactgctgcacaagtaccccttcatcctgccccaccagcaggtggacaagggcgccatcaagttcgtgctgagcggcgccaacatcatgtgccccggcctgaccagccccggcgccaagctgtaccccgccgccgtggacaccatcgtggccatcatggccgagggcaagcagcacgccctgtgcgtgggcgtgatgaagatgagcgccgaggacatcgagaaggtgaacaagggcatcggcatcgagaacatccactacctgaacgacggcctgtggcacatgaagacctacaagtag

SEQ ID NO: 11370 - DNA, 2226 bp, Artificial Sequence
  Description of Artificial Sequence: Synthetic coding sequence
atggccctgttcaccccctggaagctgagcagccagaagctgggcttcttcctggtgaccttcggcttcatctggggcatgatgctgctgcacttcaccatccagcagagaacccagcccgagagcagcagcatgctgagagagcagatcctggacctgagcaagagatacatcaaggccctggccgaggagaacagaaacgtggtggacggcccctacgccggcgtgatgaccgcctacgacctgaagaagaccctggccgtgctgctggacaacatcctgcagagaatcggcaagctggagagcaaggtggacaacctggtggtgaacggcaccggcaccaacagcaccaacagcaccaccgccgtgcccagcctggtggccctggagaagatcaacgtggccgacatcatcaacggcgcccaggagaagtgcgtgctgccccccatggacggctacccccactgcgagggcaagatcaagtggatgaaggacatgtggagaagcgacccctgctacgccgactacggcgtggacggcagcacctgcagcttcttcatctacctgagcgaggtggagaactggtgcccccacctgccctggagagccaagaacccctacgaggaggccgaccacaacagcctggccgagatcagaaccgacttcaacatcctgtacagcatgatgaagaagcacgaggagttcagatggatgagactgagaatcagaagaatggccgacgcctggatccaggccatcaagagcctggccgagaagcagaacctggagaagagaaagagaaagaaggtgctggtgcacctgggcctgctgaccaaggagagcggcttcaagatcgccgagaccgccttcagcggcggccccctgggcgagctggtgcagtggagcgacctgatcaccagcctgtacctgctgggccacgacatcagaatcagcgccagcctggccgagctgaaggagatcatgaagaaggtggtgggcaacagaagcggctgccccaccgtgggcgacagaatcgtggagctgatctacatcgacatcgtgggcctggcccagttcaagaagaccctgggccccagctgggtgcactaccagtgcatgctgagagtgctggacagcttcggcaccgagcccgagttcaaccacgccaactacgcccagagcaagggccacaagaccccctggggcaagtggaacctgaacccccagcagttctacaccatgttcccccacacccccgacaacagcttcctgggcttcgtggtggagcagcacctgaacagcagcgacatccaccacatcaacgagatcaagagacagaaccagagcctggtgtacggcaaggtggacagcttctggaagaacaagaagatctacctggacatcatccacacctacatggaggtgcacgccaccgtgtacggcagcagcaccaagaacatccccagctacgtgaagaaccacggcatcctgagcggcagagacctgcagttcctgctgagagagaccaagctgttcgtgggcctgggcttcccctacgagggccccgcccccctggaggccatcgccaacggctgcgccttcctgaaccccaagttcaacccccccaagagcagcaagaacaccgacttcttcatcggcaagcccaccctgagagagctgaccagccagcacccctacgccgaggtgttcatcggcagaccccacgtgtggaccgtggacctgaacaaccaggaggaggtggaggacgccgtgaaggccatcctgaaccagaagatcgagccctacatgccctacgagttcacctgcgagggcatgctgcagagaatcaacgccttcatcgagaagcaggacttctgccacggccaggtgatgtggccccccctgagcgccctgcaggtgaagctggccgagcccggccagagctgcaagcaggtgtgccaggagagccagctgatctgcgagcccagcttcttccagcacctgaacaaggacaaggacatgctgaagtacaaggtgacctgccagagcagcgagctggccaaggacatcctggtgcccagcttcgaccccaagaacaagcactgcgtgttccagggcgacctgctgctgttcagctgcgccggcgcccaccccagacaccagagagtgtgcccctgcagagacttcatcaagggccaggtggccctgtgcaaggactgcctgtag

SEQ ID NO: 11371 - DNA, 2226 bp, Artificial Sequence; identical to SEQ ID NO: 11370
  Description of Artificial Sequence: Synthetic coding sequence

SEQ ID NO: 11372 - DNA, 1410 bp, Artificial Sequence
  Description of Artificial Sequence: Synthetic coding sequence
atgcacagcttcccccccctgctgctgctgctgttctggggcgtggtgagccacagcttccccgccaccctggagacccaggagcaggacgtggacctggtgcagaagtacctggagaagtactacaacctgaagaacgacggcagacaggtggagaagagaagaaacagcggccccgtggtggagaagctgaagcagatgcaggagttcttcggcctgaaggtgaccggcaagcccgacgccgagaccctgaaggtgatgaagcagcccagatgcggcgtgcccgacgtggcccagttcgtgctgaccgagggcaaccccagatgggagcagacccacctgacctacagaatcgagaactacacccccgacctgcccagagccgacgtggaccacgccatcgagaaggccttccagctgtggagcaacgtgacccccctgaccttcaccaaggtgagcgagggccaggccgacatcatgatcagcttcgtgagaggcgaccacagagacaacagccccttcgacggccccggcggcaacctggcccacgccttccagcccggccccggcatcggcggcgacgcccacttcgacgaggacgagagatggaccaacaacttcagagagtacaacctgcacagagtggccgcccacgagctgggccacagcctgggcctgagccacagcaccgacatcggcgccctgatgtaccccagctacaccttcagcggcgacgtgcagctggcccaggacgacatcgacggcatccaggccatctacggcagaagccagaaccccgtgcagcccatcggcccccagacccccaaggcctgcgacagcaagctgaccttcgacgccatcaccaccatcagaggcgaggtgatgttcttcaaggacagattctacatgagaaccaaccccttctaccccgaggtggagctgaacttcatcagcgtgttctggccccagctgcccaacggcctggaggccgcctacgagttcgccgacagagacgaggtgagattcttcaagggcaacaagtactgggccgtgcagggccagaacgtgctgcacggctaccccaaggacatctacagcagcttcggcttccccagaaccgtgaagcacatcgacgccgccctgagcgaggagaacaccggcaagacctacttcttcgtggccaacaagtactggagatacgacgagtacaagagaagcatggaccccggctaccccaagatgatcgcccacgacttccccggcatcggccacaaggtggacgccgtgttcatgaaggacggcttcttctacttcttccacggcaccagacagtacaagttcgaccccaagaccaagagaatcctgaccctgcagaaggccaacagctggttcaactgcagaaagaactag

SEQ ID NO: 11373 - DNA, 1431 bp, Artificial Sequence
  Description of Artificial Sequence: Synthetic coding sequence
atgatgcacctggccttcctggtgctgctgtgcctgcccgtgtgcagcgcctaccccctgagcggcgccgccaaggaggaggacagcaacaaggacctggcccagcagtacctggagaagtactacaacctggagaaggacgtgaagcagttcagaagaaaggacagcaacctgatcgtgaagaagatccagggcatgcagaagttcctgggcctggaggtgaccggcaagctggacaccgacaccctggaggtgatgagaaagcccagatgcggcgtgcccgacgtgggccacttcagcagcttccccggcatgcccaagtggagaaagacccacctgacctacagaatcgtgaactacacccccgacctgcccagagacgccgtggacagcgccatcgagaaggccctgaaggtgtgggaggaggtgacccccctgaccttcagcagactgtacgagggcgaggccgacatcatgatcagcttcgccgtgaaggagcacggcgacttctacagcttcgacggccccggccacagcctggcccacgcctacccccccggccccggcctgtacggcgacatccacttcgacgacgacgagaagtggaccgaggacgccagcggcaccaacctgttcctggtggccgcccacgagctgggccacagcctgggcctgttccacagcgccaacaccgaggccctgatgtaccccctgtacaacagcttcaccgagctggcccagttcagactgagccaggacgacgtgaacggcatccagagcctgtacggccccccccccgccagcaccgaggagcccctggtgcccaccaagagcgtgcccagcggcagcgagatgcccgccaagtgcgaccccgccctgagcttcgacgccatcagcaccctgagaggcgagtacctgttcttcaaggacagatacttctggagaagaagccactggaaccccgagcccgagttccacctgatcagcgccttctggcccagcctgcccagctacctggacgccgcctacgaggtgaacagcagagacaccgtgttcatcttcaagggcaacgagttctgggccatcagaggcaacgaggtgcaggccggctaccccagaggcatccacaccctgggcttcccccccaccatcagaaagatcgacgccgccgtgagcgacaaggagaagaagaagacctacttcttcgccgccgacaagtactggagattcgacgagaacagccagagcatggagcagggcttccccagactgatcgccgacgacttccccggcgtggagcccaaggtggacgccgtgctgcaggccttcggcttcttctacttcttcagcggcagcagccagttcgagttcgaccccaacgccagaatggtgacccacatcctgaagagcaacagctggctgcactgctag

SEQ ID NO: 11374 - DNA, 930 bp, Artificial Sequence
  Description of Artificial Sequence: Synthetic coding sequence
atgcccagacactgcagcgccgccggctgctgcaccagagacaccagagagaccagaaacagaggcatcagcttccacagactgcccaagaaggacaaccccagaagaggcctgtggctggccaactgccagagactggaccccagcggccagggcctgtgggaccccgccagcgagtacatctacttctgcagcaagcacttcgaggaggactgcttcgagctggtgggcatcagcggctaccacagactgaaggagggcgccgtgcccaccatcttcgagagcttcagcaagctgagaagaaccaccaagaccaagggccacagctacccccccggccccgccgaggtgagcagactgagaagatgcagaaagagatgcagcgagggcagaggccccaccacccccttcagcccccccccccccgccgacgtgacctgcttccccgtggaggaggccagcgcccccgccaccctgcccgccagccccgccggcagactggagcccggcctgagcagccccttcagcgacctgctgggccccctgggcgcccaggccgacgaggccggctgcagcgcccagcccagccccgagagacagcccagccccctggagcccagacccgtgagccccagcgcctacatgctgagactgcccccccccgccggcgcctacatccagaacgagcacagctaccaggtgggcagcgccctgctgtggaagagaagagccgaggccgccctggacgccctggacaaggcccagagacagctgcaggcctgcaagagaagagagcagagactgagactgagactgaccaagctgcagcaggagagagccagagagaagagagcccaggccgacgccagacagaccctgaaggagcacgtgcaggacttcgccatgcagctgagcagcagcatggcctag

SEQ ID NO: 11375 - DNA, 1416 bp, Artificial Sequence
  Description of Artificial Sequence: Synthetic coding sequence
atgcaccccggcgtgctggccgccttcctgttcctgagctggacccactgcagagccctgcccctgcccagcggcggcgacgaggacgacctgagcgaggaggacctgcagttcgccgagagatacctgagaagctactaccaccccaccaacctggccggcatcctgaaggagaacgccgccagcagcatgaccgagagactgagagagatgcagagcttcttcggcctggaggtgaccggcaagctggacgacaacaccctggacgtgatgaagaagcccagatgcggcgtgcccgacgtgggcgagtacaacgtgttccccagaaccctgaagtggagcaagatgaacctgacctacagaatcgtgaactacacccccgacatgacccacagcgaggtggagaaggccttcaagaaggccttcaaggtgtggagcgacgtgacccccctgaacttcaccagactgcacgacggcatcgccgacatcatgatcagcttcggcatcaaggagcacggcgacttctaccccttcgacggccccagcggcctgctggcccacgccttcccccccggccccaactacggcggcgacgcccacttcgacgacgacgagacctggaccagcagcagcaagggctacaacctgttcctggtggccgcccacgagttcggccacagcctgggcctggaccacagcaaggaccccggcgccctgatgttccccatctacacctacaccggcaagagccacttcatgctgcccgacgacgacgtgcagggcatccagagcctgtacggccccggcgacgaggaccccaaccccaagcaccccaagacccccgacaagtgcgaccccagcctgagcctggacgccatcaccagcctgagaggcgagaccatgatcttcaaggacagattcttctggagactgcacccccagcaggtggacgccgagctgttcctgaccaagagcttctggcccgagctgcccaacagaatcgacgccgcctacgagcaccccagccacgacctgatcttcatcttcagaggcagaaagttctgggccctgaacggctacgacatcctggagggctaccccaagaagatcagcgagctgggcctgcccaaggaggtgaagaagatcagcgccgccgtgcacttcgaggacaccggcaagaccctgctgttcagcggcaaccaggtgtggagatacgacgacaccaaccacatcatggacaaggactaccccagactgatcgaggaggacttccccggcatcggcgacaaggtggacgccgtgtacgagaagaacggctacatctacttcttcaacggccccatccagttcgagtacagcatctggagcaacagaatcgtgagagtgatgcccgccaacagcatcctgtggtgctag

SEQ ID NO: 11376 - DNA, 1470 bp, Artificial Sequence
  Description of Artificial Sequence: Synthetic coding sequence
atgcaccccggcgtgctggccgccttcctgttcctgagctggacccactgcagagccctgcccctgcccagcggcggcgacgaggacgacctgagcgaggaggacctgcagttcgccgagagatacctgagaagctactaccaccccaccaacctggccggcatcctgaaggagaacgccgccagcagcatgaccgagagactgagagagatgcagagcttcttcggcctggaggtgaccggcaagctggacgacaacaccctggacgtgatgaagaagcccagatgcggcgtgcccgacgtgggcgagtacaacgtgttccccagaaccctgaagtggagcaagatgaacctgacctacagaatcgtgaactacacccccgacatgacccacagcgaggtggagaaggccttcaagaaggccttcaaggtgtggagcgacgtgacccccctgaacttcaccagactgcacgacggcatcgccgacatcatgatcagcttcggcatcaaggagcacggcgacttctaccccttcgacggccccagcggcctgctggcccacgccttcccccccggccccaactacggcggcgacgcccacttcgacgacgacgagacctggaccagcagcagcaagggctacaacctgttcctggtggccgcccacgagttcggccacagcctgggcctggaccacagcaaggaccccggcgccctgatgttccccatctacacctacaccggcaagagccacttcatgctgcccgacgacgacgtgcagggcatccagagcctgtacggccccggcgacgaggaccccaaccccaagcaccccaagacccccgacaagtgcgaccccagcctgagcctggacgccatcaccagcctgagaggcgagaccatgatcttcaaggacagattcttctggagactgcacccccagcaggtggacgccgagctgttcctgaccaagagcttctggcccgagctgcccaacagaatcgacgccgcctacgagcaccccagccacgacctgatcttcatcttcagaggcagaaagttctgggccctgaacggctacgacatcctggagggctaccccaagaagatcagcgagctgggcctgcccaaggaggtgaagaagatcagcgccgccgtgcacttcgaggacaccggcaagaccctgctgttcagcggcaaccaggtgtggagatacgacgacaccaaccacatcatggacaaggactaccccagactgatcgaggaggacttccccggcatcggcgacaaggtggacgccgtgtacgagaagaacgagagccacagcgtgacccaggccggcgtgcactgcagaaacctgagcagcctgcagccccccccccccggcttcaagagattcagctgcctgagcctgtggagcagctgggactacagactgtacctgttcttccagagaacccacaccgtgtag

SEQ ID NO: 11377 - DNA, 1152 bp, Artificial Sequence
  Description of Artificial Sequence: Synthetic coding sequence
atgcaccccggcgtgctggccgccttcctgttcctgagctggacccactgcagagccctgcccctgcccagcggcggcgacgaggacgacctgagcgaggaggacctgcagttcgccgagagatacctgagaagctactaccaccccaccaacctggccggcatcctgaaggagaacgccgccagcagcatgaccgagagactgagagagatgcagagcttcttcggcctggaggtgaccggcaagctggacgacaacaccctggacgtgatgaagaagcccagatgcggcgtgcccgacgtgggcgagtacaacgtgttccccagaaccctgaagtggagcaagatgaacctgacctacagaatcgtgaactacacccccgacatgacccacagcgaggtggagaaggccttcaagaaggccttcaaggtgtggagcgacgtgacccccctgaacttcaccagactgcacgacggcatcgccgacatcatgatcagcttcggcatcaaggagcacggcgacttctaccccttcgacggccccagcggcctgctggcccacgccttcccccccggccccaactacggcggcgacgcccacttcgacgacgacgagacctggaccagcagcagcaagggctacaacctgttcctggtggccgcccacgagttcggccacagcctgggcctggaccacagcaaggaccccggcgccctgatgttccccatctacacctacaccggcaagagccacttcatgctgcccgacgacgacgtgcagggcatccagagcctgtacggccccggcgacgaggaccccaaccccaagcaccccaagacccccgacaagtgcgaccccagcctgagcctggacgccatcaccagcctgagaggcgagaccatgatcttcaaggacagattcttctggagactgcacccccagcaggtggacgccgagctgttcctgaccaagagcttctggcccgagctgcccaacagaatcgacgccgcctacgagcaccccagccacgacctgatcttcatcttcagaggcagaaagttctgggccctgaacggctacgacatcctggagggctaccccaagaagatcagcgagctgggcctgcccaaggaggtgaacaagctgcagtag

SEQ ID NO: 11378 - DNA, 1749 bp, Artificial Sequence
  Description of Artificial Sequence: Synthetic coding sequence
atgagccccgcccccagaccccccagatgcctgctgctgcccctgctgaccctgggcaccgccctggccagcctgggcagcgcccagagcagcagcttcagccccgaggcctggctgcagcagtacggctacctgccccccggcgacctgagaacccacacccagagaagcccccagagcctgagcgccgccatcgccgccatgcagaagttctacggcctgcaggtgaccggcaaggccgacgccgacaccatgaaggccatgagaagacccagatgcggcgtgcccgacaagttcggcgccgagatcaaggccaacgtgagaagaaagagatacgccatccagggcctgaagtggcagcacaacgagatcaccttctgcatccagaactacacccccaaggtgggcgagtacgccacctacgaggccatcagaaaggccttcagagtgtgggagagcgccacccccctgagattcagagaggtgccctacgcctacatcagagagggccacgagaagcaggccgacatcatgatcttcttcgccgagggcttccacggcgacagcacccccttcgacggcgagggcggcttcctggcccacgcctacttccccggccccaacatcggcggcgacacccacttcgacagcgccgagccctggaccgtgagaaacgaggacctgaacggcaacgacatcttcctggtggccgtgcacgagctgggccacgccctgggcctggagcacagcagcgaccccagcgccatcatggcccccttctaccagtggatggacaccgagaacttcgtgctgcccgacgacgacagaagaggcatccagcagctgtacggcggcgagagcggcttccccaccaagatgcccccccagcccagaaccaccagcagacccagcgtgcccgacaagcccaagaaccccacctacggccccaacatctgcgacggcaacttcgacaccgtggccatgctgagaggcgagatgttcgtgttcaaggagagatggttctggagagtgagaaacaaccaggtgatggacggctaccccatgcccatcggccagttctggagaggcctgcccgccagcatcaacaccgcctacgagagaaaggacggcaagttcgtgttcttcaagggcgacaagcactgggtgttcgacgaggccagcctggagcccggctaccccaagcacatcaaggagctgggcagaggcctgcccaccgacaagatcgacgccgccctgttctggatgcccaacggcaagacctacttcttcagaggcaacaagtactacagattcaacgaggagctgagagccgtggacagcgagtaccccaagaacatcaaggtgtgggagggcatccccgagagccccagaggcagcttcatgggcagcgacgaggtgttcacctacttctacaagggcaacaagtactggaagttcaacaaccagaagctgaaggtggagcccggctaccccaagagcgccctgagagactggatgggctgccccagcggcggcagacccgacgagggcaccgaggaggagaccgaggtgatcatcatcgaggtggacgaggagggcggcggcgccgtgagcgccgccgccgtggtgctgcccgtgctgctgctgctgctggtgctggccgtgggcctggccgtgttcttcttcagaagacacggcacccccagaagactgctgtactgccagagaagcctgctggacaaggtgtag

SEQ ID NO: 11379 - DNA, 2052 bp, Artificial Sequence
  Description of Artificial Sequence: Synthetic coding sequence
atggccagcggccccggcagccaggagagagagggcctgctgatcgtgaagctggaggaggactgcgcctggagccaggagctgcccccccccgaccccggccccagccccgaggccagccacctgagattcagaagattcagattccaggaggccgccggccccagagaggccctgagcagactgcaggagctgtgccacggctggctgagacccgagatgagaaccaaggagcagatcctggagctgctggtgctggagcagttcctgaccatcctgccccaggagatccagagcagagtgcaggagctgcaccccgagagcggcgaggaggccgtgaccctggtggaggacatgcagagagagctgggcagactgagacagcaggtgaccaaccacggcagaggcaccgaggtgctgctggaggagcccctgcccctggagaccgccagagagagccccagcttcaagctggagcccatggagaccgagagaagccccggccccagactgcaggagctgctgggccccagcccccagagagacccccaggccgtgaaggagagagccctgagcgccccctggctgagcctgttcccccccgagggcaacatggaggacaaggagatgaccggcccccagctgcccgagagcctggaggacgtggccatgtacatcagccaggaggagtggggccaccaggaccccagcaagagagccctgagcagagacaccgtgcaggagagctacgagaacgtggacagcctggagagccacatccccagccaggaggtgcccggcacccaggtgggccagggcggcaagctgtgggaccccagcgtgcagagctgcaaggagggcctgagccccagaggccccgcccccggcgaggagaagttcgagaacctggagggcgtgcccagcgtgtgcagcgagaacatccacccccaggtgctgctgcccgaccaggccagaggcgaggtgccctggagccccgagctgggcagaccccacgacagaagccagggcgactgggcccccccccccgagggcggcatggagcaggccctggccggcgccagcagcggcagagagctgggcagacccaaggagctgcagcccaagaagctgcacctgtgccccctgtgcggcaagaacttcagcaacaacagcaacctgatcagacaccagagaatccacgccgccgagagactgtgcatgggcgtggactgcaccgagatcttcggcggcaaccccagattcctgagcctgcacagagcccacctgggcgaggaggcccacaagtgcctggagtgcggcaagtgcttcagccagaacacccacctgaccagacaccagagaacccacaccggcgagaagccctaccagtgcaacatctgcggcaagtgcttcagctgcaacagcaacctgcacagacaccagagaacccacaccggcgagaagccctacaagtgccccgagtgcggcgagatcttcgcccacagcagcaacctgctgagacaccagagaatccacaccggcgagagaccctacaagtgccccgagtgcggcaagagcttcagcagaagcagccacctggtgatccacgagagaacccacgagagagagagactgtaccccttcagcgagtgcggcgaggccgtgagcgacagcacccccttcctgaccaaccacggcgcccacaaggccgagaagaagctgttcgagtgcctgacctgcggcaagagcttcagacagggcatgcacctgaccagacaccagagaacccacaccggcgagaagccctacaagtgcaccctgtgcggcgagaacttcagccacagaagcaacctgatcagacaccagagaatccacaccggcgagaagccctacacctgccacgagtgcggcgacagcttcagccacagcagcaacagaatcagacacctgagaacccacaccggcgagagaccctacaagtgcagcgagtgcggcgagagcttcagcagaagcagcagactgatgagccaccagagaacccacaccggctag

SEQ ID NO: 11380 - DNA, 1755 bp, Artificial Sequence
  Description of Artificial Sequence: Synthetic coding sequence
atgcagaagttcttcggcctgccccagaccggcgacctggaccagaacaccatcgagaccatgagaaagcccagatgcggcaaccccgacgtggccaactacaacttcttccccagaaagcccaagtgggacaagaaccagatcacctacagaatcatcggctacacccccgacctggaccccgagaccgtggacgacgccttcgccagagccttccaggtgtggagcgacgtgacccccctgagattcagcagaatccacgacggcgaggccgacatcatgatcaacttcggcagatgggagcacggcgacggctaccccttcgacggcaaggacggcctgctggcccacgccttcgcccccggcaccggcgtgggcggcgacagccacttcgacgacgacgagctgtggaccctgggcgagggccaggtggtgagagtgaagtacggcaacgccgacggcgagtactgcaagttccccttcctgttcaacggcaaggagtacaacagctgcaccgacaccggcagaagcgacggcttcctgtggtgcagcaccacctacaacttcgagaaggacggcaagtacggcttctgcccccacgaggccctgttcaccatgggcggcaacgccgagggccagccctgcaagttccccttcagattccagggcaccagctacgacagctgcaccaccgagggcagaaccgacggctacagatggtgcggcaccaccgaggactacgacagagacaagaagtacggcttctgccccgagaccgccatgagcaccgtgggcggcaacagcgagggcgccccctgcgtgttccccttcaccttcctgggcaacaagtacgagagctgcaccagcgccggcagaagcgacggcaagatgtggtgcgccaccaccgccaactacgacgacgacagaaagtggggcttctgccccgaccagggctacagcctgttcctggtggccgcccacgagttcggccacgccatgggcctggagcacagccaggaccccggcgccctgatggcccccatctacacctacaccaagaacttcagactgagccaggacgacatcaagggcatccaggagctgtacggcgccagccccgacatcgacctgggcaccggccccacccccaccctgggccccgtgacccccgagatctgcaagcaggacatcgtgttcgacggcatcgcccagatcagaggcgagatcttcttcttcaaggacagattcatctggagaaccgtgacccccagagacaagcccatgggccccctgctggtggccaccttctggcccgagctgcccgagaagatcgacgccgtgtacgaggccccccaggaggagaaggccgtgttcttcgccggcaacgagtactggatctacagcgccagcaccctggagagaggctaccccaagcccctgaccagcctgggcctgccccccgacgtgcagagagtggacgccgccttcaactggagcaagaacaagaagacctacatcttcgccggcgacaagttctggagatacaacgaggtgaagaagaagatggaccccggcttccccaagctgatcgccgacgcctggaacgccatccccgacaacctggacgccgtggtggacctgcagggcggcggccacagctacttcttcaagggcgcctactacctgaagctggagaaccagagcctgaagagcgtgaagttcggcagcatcaagagcgactggctgggctgctag

SEQ ID NO: 11381 - DNA, 1434 bp, Artificial Sequence
  Description of Artificial Sequence: Synthetic coding sequence
atgaagagcctgcccatcctgctgctgctgtgcgtggccgtgtgcagcgcctaccccctggacggcgccgccagaggcgaggacaccagcatgaacctggtgcagaagtacctggagaactactacgacctgaagaaggacgtgaagcagttcgtgagaagaaaggacagcggccccgtggtgaagaagatcagagagatgcagaagttcctgggcctggaggtgaccggcaagctggacagcgacaccctggaggtgatgagaaagcccagatgcggcgtgcccgacgtgggccacttcagaaccttccccggcatccccaagtggagaaagacccacctgacctacagaatcgtgaactacacccccgacctgcccaaggacgccgtggacagcgccgtggagaaggccctgaaggtgtgggaggaggtgacccccctgaccttcagcagactgtacgagggcgaggccgacatcatgatcagcttcgccgtgagagagcacggcgacttctaccccttcgacggccccggcaacgtgctggcccacgcctacgcccccggccccggcatcaacggcgacgcccacttcgacgacgacgagcagtggaccaaggacaccaccggcaccaacctgttcctggtggccgcccacgagatcggccacagcctgggcctgttccacagcgccaacaccgaggccctgatgtaccccctgtaccacagcctgaccgacctgaccagattcagactgagccaggacgacatcaacggcatccagagcctgtacggccccccccccgacagccccgagacccccctggtgcccaccgagcccgtgccccccgagcccggcacccccgccaactgcgaccccgccctgagcttcgacgccgtgagcaccctgagaggcgagatcctgatcttcaaggacagacacttctggagaaagagcctgagaaagctggagcccgagctgcacctgatcagcagcttctggcccagcctgcccagcggcgtggacgccgcctacgaggtgaccagcaaggacctggtgttcatcttcaagggcaaccagttctgggccatcagaggcaacgaggtgagagccggctaccccagaggcatccacaccctgggcttcccccccaccgtgagaaagatcgacgccgccatcagcgacaaggagaagaacaagacctacttcttcgtggaggacaagtactggagattcgacgagaagagaaacagcatggagcccggcttccccaagcagatcgccgaggacttccccggcatcgacagcaagatcgacgccgtgttcgaggagttcggcttcttctacttcttcaccggcagcagccagctggagttcgaccccaacgccaagaaggtgacccacaccctgaagagcaacagctggctgaactgctag

SEQ ID NO: 11382 - DNA, 804 bp, Artificial Sequence
  Description of Artificial Sequence: Synthetic coding sequence
atgagactgaccgtgctgtgcgccgtgtgcctgctgcccggcagcctggccctgcccctgccccaggaggccggcggcatgagcgagctgcagtgggagcaggcccaggactacctgaagagattctacctgtacgacagcgagaccaagaacgccaacagcctggaggccaagctgaaggagatgcagaagttcttcggcctgcccatcaccggcatgctgaacagcagagtgatcgagatcatgcagaagcccagatgcggcgtgcccgacgtggccgagtacagcctgttccccaacagccccaagtggaccagcaaggtggtgacctacagaatcgtgagctacaccagagacctgccccacatcaccgtggacagactggtgagcaaggccctgaacatgtggggcaaggagatccccctgcacttcagaaaggtggtgtggggcaccgccgacatcatgatcggcttcgccagaggcgcccacggcgacagctaccccttcgacggccccggcaacaccctggcccacgccttcgcccccggcaccggcctgggcggcgacgcccacttcgacgaggacgagagatggaccgacggcagcagcctgggcatcaacttcctgtacgccgccacccacgagctgggccacagcctgggcatgggccacagcagcgaccccaacgccgtgatgtaccccacctacggcaacggcgacccccagaacttcaagctgagccaggacgacatcaagggcatccagaagctgtacggcaagagaagcaacagcagaaagaagtag

SEQ ID NO: 11383 - DNA, 2124 bp, Artificial Sequence
  Description of Artificial Sequence: Synthetic coding sequence
atgagcctgtggcagcccctggtgctggtgctgctggtgctgggctgctgcttcgccgcccccagacagagacagagcaccctggtgctgttccccggcgacctgagaaccaacctgaccgacagacagctggccgaggagtacctgtacagatacggctacaccagagtggccgagatgagaggcgagagcaagagcctgggccccgccctgctgctgctgcagaagcagctgagcctgcccgagaccggcgagctggacagcgccaccctgaaggccatgagaacccccagatgcggcgtgcccgacctgggcagattccagaccttcgagggcgacctgaagtggcaccaccacaacatcacctactggatccagaactacagcgaggacctgcccagagccgtgatcgacgacgccttcgccagagccttcgccctgtggagcgccgtgacccccctgaccttcaccagagtgtacagcagagacgccgacatcgtgatccagttcggcgtggccgagcacggcgacggctaccccttcgacggcaaggacggcctgctggcccacgccttcccccccggccccggcatccagggcgacgcccacttcgacgacgacgagctgtggagcctgggcaagggcgtggtggtgcccaccagattcggcaacgccgacggcgccgcctgccacttccccttcatcttcgagggcagaagctacagcgcctgcaccaccgacggcagaagcgacggcctgccctggtgcagcaccaccgccaactacgacaccgacgacagattcggcttctgccccagcgagagactgtacacccaggacggcaacgccgacggcaagccctgccagttccccttcatcttccagggccagagctacagcgcctgcaccaccgacggcagaagcgacggctacagatggtgcgccaccaccgccaactacgacagagacaagctgttcggcttctgccccaccagagccgacagcaccgtgatgggcggcaacagcgccggcgagctgtgcgtgttccccttcaccttcctgggcaaggagtacagcacctgcaccagcgagggcagaggcgacggcagactgtggtgcgccaccaccagcaacttcgacagcgacaagaagtggggcttctgccccgaccagggctacagcctgttcctggtggccgcccacgagttcggccacgccctgggcctggaccacagcagcgtgcccgaggccctgatgtaccccatgtacagattcaccgagggcccccccctgcacaaggacgacgtgaacggcatcagacacctgtacggccccagacccgagcccgagcccagaccccccaccaccaccaccccccagcccaccgccccccccaccgtgtgccccaccggcccccccaccgtgcaccccagcgagagacccaccgccggccccaccggcccccccagcgccggccccaccggcccccccaccgccggccccagcaccgccaccaccgtgcccctgagccccgtggacgacgcctgcaacgtgaacatcttcgacgccatcgccgagatcggcaaccagctgtacctgttcaaggacggcaagtactggagattcagcgagggcagaggcagcagaccccagggccccttcctgatcgccgacaagtggcccgccctgcccagaaagctggacagcgtgttcgaggagagactgagcaagaagctgttcttcttcagcggcagacaggtgtgggtgtacaccggcgccagcgtgctgggccccagaagactggacaagctgggcctgggcgccgacgtggcccaggtgaccggcgccctgagaagcggcagaggcaagatgctgctgttcagcggcagaagactgtggagattcgacgtgaaggcccagatggtggaccccagaagcgccagcgaggtggacagaatgttccccggcgtgcccctggacacccacgacgtgttccagtacagagagaaggcctacttctgccaggacagattctactggagagtgagcagcagaagcgagctgaaccaggtggaccaggtgggctacgtgacctacgacatcctgcagtgccccgaggactag

SEQ ID NO: 11384 - DNA, 834 bp, Artificial Sequence
  Description of Artificial Sequence: Synthetic coding sequence
atgggcggcaacagcgccggcgagctgtgcgtgttccccttcaccttcctgggcaaggagtacagcaacttcgacagcgacaagaagtggggcttctgccccgaccagggctacagcctgttcctggtggccgcccacgagttcggccacgccctgggcctggaccacagcagcgtgcccgaggccctgatgtaccccatgtacagattcaccgagggcccccccctgcacaaggacgacgtgaacggcatcagacacctgtacggccccagacccgagcccgagcccagaccccccaccaccaccaccccccagcccaccgccccccccaccgtgtgccccaccggcccccccaccgtgcacccccccttcctgatcgccgacaagtggcccgccctgcccagaaagctggacagcgtgttcgaggagagactgagcaagaagctgttcttcttcagcggcagacaggtgtgggtgtacaccggcgccagcgtgctgggccccagaagactggacaagctgggcctgggcgccgacgtggcccaggtgaccggcgccctgagaagcggcagaggcaagatgctgctgttcagcggcagaagactgtggagattcgacgtgaaggcccagatggtggaccccagaagcgccagcgaggtggacagaatgttccccggcgtgcccctggacacccacgacgtgttccagtacagagagaaggcctacttctgccaggacagattctactggagagtgagcagcagaagcgagctgaaccaggtggaccaggtgggctacgtgacctacgacatcctgcagtgccccgaggactag

SEQ ID NO: 11385 - DNA, 324 bp, Artificial Sequence
  Description of Artificial Sequence: Synthetic coding sequence
atggccggcgaggacgtgggcgccccccccgaccacctgtgggtgcaccaggagggcatctacagagacgagtaccagagaacctgggtggccgtggtggaggaggagaccagcttcctgagagccagagtgcagcagatccaggtgcccctgggcgacgccgccagacccagccacctgctgaccagccagctgcccctgatgtggcagctgtaccccgaggagagatacatggacaacaacagcagactgtggcagatccagcaccacctgatggtgagaggcgtgcaggagctgctgctgaagctgctgcccgacgactag

SEQ ID NO: 11386 - DNA, 324 bp, Artificial Sequence; identical to SEQ ID NO: 11385
  Description of Artificial Sequence: Synthetic coding sequence

SEQ ID NO: 11387 - DNA, 1329 bp, Artificial Sequence
  Description of Artificial Sequence: Synthetic coding sequence
atggtgagaagcagacagatgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11388 - DNA, 1311 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11389 - DNA, 966 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11390 - DNA, 1359 bp, Artificial Sequence
  Description of Artificial Sequence: Synthetic coding sequence
atggtgagaagcagacagatgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggagaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11391 - DNA, 771 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctgctgctgggcgtgtaccaggtgaccgtgtaccaggccggcgagagcgacaccgacagcttcgaggaggaccccgagatcagcctggcccactacctgtag

SEQ ID NO: 11392 - DNA, 798 bp, Artificial Sequence
  Description of Artificial Sequence: Synthetic coding sequence
atgagcgtgcccaccgacggcgccgtgaccaccagccagatccccgccagcgagcaggagaccctggacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11393 - DNA, 1401 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11394 - DNA, 966 bp, Artificial Sequence; identical to SEQ ID NO: 11389
  Description of Artificial Sequence: Synthetic coding sequence

SEQ ID NO: 11395 - DNA, 480 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcctgaagaagagaaacaagccctgccccgtgtgcagacagcccatccagatgatcgtgctgacctacttcccctag

SEQ ID NO: 11396 - DNA, 891 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11397 - DNA, 732 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11398 - DNA, 657 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11399 - DNA, 657 bp, Artificial Sequence; identical to SEQ ID NO: 11398
  Description of Artificial Sequence: Synthetic coding sequence

SEQ ID NO: 11400 - DNA, 771 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgtaccaggtgaccgtgtaccaggccggcgagagcgacaccgacagcttcgaggaggaccccgagatcagcctggccgactactggtag

SEQ ID NO: 11401 - DNA, 813 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11402 - DNA, 1494 bp, Artificial Sequence
  Description of Artificial Sequence: Synthetic coding sequence
atggtgagaagcagacagatgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11403 - DNA, 393 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11404 - DNA, 774 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggaggtgctgttctacctgggccagtacatcatgaccaagagactgtacgacgagaagcagcagcacatcgtgtactgcagcaacgacctgctgggcgacctgttcggcgtgcccagcttcagcgtgaaggagcacagaaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgagtag

SEQ ID NO: 11405 - DNA, 891 bp, Artificial Sequence; identical to SEQ ID NO: 11396
  Description of Artificial Sequence: Synthetic coding sequence

SEQ ID NO: 11406 - DNA, 1341 bp, Artificial Sequence
  Description of Artificial Sequence: Synthetic coding sequence
atgtgcaacaccaacatgagcgtgcccaccgacggcgccgtgaccaccagccagatccccgccagcgagcaggagaccctggtgagacccaagcccctgctgctgaagctgctgaagagcgtgggcgcccagaaggacacctacaccatgaaggagaagatctacaccatgatctacagaaacctggtggtggtgaaccagcaggagagcagcgacagcggcaccagcgtgagcgagaacagatgccacctggagggcggcagcgaccagaaggacctggtgcaggagctgcaggaggagaagcccagcagcagccacctggtgagcagacccagcaccagcagcagaagaagagccatcagcgagaccgaggagaacagcgacgagctgagcggcgagagacagagaaagagacacaagagcgacagcatcagcctgagcttcgacgagagcctggccctgtgcgtgatcagagagatctgctgcgagagaagcagcagcagcgagagcaccggcacccccagcaaccccgacctggacgccggcgtgagcgagcacagcggcgactggctggaccaggacagcgtgagcgaccagttcagcgtggagttcgaggtggagagcctggacagcgaggactacagcctgagcgaggagggccaggagctgagcgacgaggacgacgaggtgtaccaggtgaccgtgtaccaggccggcgagagcgacaccgacagcttcgaggaggaccccgagatcagcctggccgactactggaagtgcaccagctgcaacgagatgaacccccccctgcccagccactgcaacagatgctgggccctgagagagaactggctgcccgaggacaagggcaaggacaagggcgagatcagcgagaaggccaagctggagaacagcacccaggccgaggagggcttcgacgtgcccgactgcaagaagaccatcgtgaacgacagcagagagagctgcgtggaggagaacgacgacaagatcacccaggccagccagagccaggagagcgaggactacagccagcccagcaccagcagcagcatcatctacagcagccaggaggacgtgaaggagttcgagagagaggagacccaggacaaggaggagagcgtggagagcagcctgcccctgaacgccatcgagccctgcgtgatctgccagggcagacccaagaacggctgcatcgtgcacggcaagaccggccacctgatggcctgcttcacctgcgccaagaagctgaagaagagaaacaagccctgccccgtgtgcagacagcccatccagatgatcgtgctgacctacttcccctag

SEQ ID NO: 11407 - DNA, 642 bp, Artificial Sequence
  Description of Artificial Sequence: Synthetic coding sequence
atgcccaacttcgtggtggactggagagtgtacaccgacagcctgttcctgaccgtggacttcggcctgtgcgccgaggagagcagcaccagcagaaagagaaccaccgaggacgacatccccaccctgcccaccagcgagcacaagtgcatccacagcagagaggacgaggacctgatcgagaacctggcccaggacgagaccagcagactggacctgggcttcgaggagtgggacgtggccggcctgccctggtggttcctgggcaacctgagaagcaactacacccccagaagcaacggcagcaccgacctgcagaccaaccaggacgtgggcaccgccatcgtgagcgacaccaccgacgacctgtggttcctgaacgagagcgtgagcgagcagctgggcgtgggcatcaaggtggaggccgccgacaccgagcagaccagcgaggaggtgggcaaggtgagcgacaagaaggtgatcgaggtgggcaagaacgacgacctggaggacagcaagagcctgagcgacgacaccgacgtggaggtgaccagcgaggacgagtggcagtgcaccgagtgcaagaagttcaacagccccagcaagagatactgcttcagatgctgggccctgagaaagtag

SEQ ID NO: 11408 - DNA, 396 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggtgagacccaagctgcccctgctgaagatcctgcacgccgccggcgcccagggcgagatgttcaccgtgaaggaggtgatgcactacctgggccagtacatcatggtgaagcagctgtacgaccagcaggagcagcacatggtgtactgcggcggcgacctgctgggcgagctgctgggcagacagagcttcagcgtgaaggaccccagccccctgtacgacatgctgagaaagaacctggtgaccctggccaccgccaccaccgagatgggccacctgttctgcagaatcagccacgccctggagctggccgactag

SEQ ID NO: 11409 - DNA, 1473 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggtgagacccaagctgcccctgctgaagatcctgcacgccgccggcgcccagggcgagatgttcaccgtgaaggaggtgatgcactacctgggccagtacatcatggtgaagcagctgtacgaccagcaggagcagcacatggtgtactgcggcggcgacctgctgggcgagctgctgggcagacagagcttcagcgtgaaggaccccagccccctgtacgacatgctgagaaagaacctggtgaccctggccaccgccaccaccgacgccgcccagaccctggccctggcccaggaccacagcatggacatccccagccaggaccagctgaagcagagcgccgaggagagcagcaccagcagaaagagaaccaccgaggacgacatccccaccctgcccaccagcgagcacaagtgcatccacagcagagaggacgaggacctgatcgagaacctggcccaggacgagaccagcagactggacctgggcttcgaggagtgggacgtggccggcctgccctggtggttcctgggcaacctgagaagcaactacacccccagaagcaacggcagcaccgacctgcagaccaaccaggacgtgggcaccgccatcgtgagcgacaccaccgacgacctgtggttcctgaacgagagcgtgagcgagcagctgggcgtgggcatcaaggtggaggccgccgacaccgagcagaccagcgaggaggtgggcaaggtgagcgacaagaaggtgatcgaggtgggcaagaacgacgacctggaggacagcaagagcctgagcgacgacaccgacgtggaggtgaccagcgaggacgagtggcagtgcaccgagtgcaagaagttcaacagccccagcaagagatactgcttcagatgctgggccctgagaaaggactggtacagcgactgcagcaagctgacccacagcctgagcaccagcgacatcaccgccatccccgagaaggagaacgagggcaacgacgtgcccgactgcagaagaaccatcagcgcccccgtggtgagacccaaggacgcctacatcaagaaggagaacagcaagctgttcgacccctgcaacagcgtggagttcctggacctggcccacagcagcgagagccaggagaccatcagcagcatgggcgagcagctggacaacctgagcgagcagagaaccgacaccgagaacatggaggactgccagaacctgctgaagccctgcagcctgtgcgagaagagacccagagacggcaacatcatccacggcagaaccggccacctggtgacctgcttccactgcgccagaagactgaagaaggccggcgccagctgccccatctgcaagaaggagatccagctggtgatcaaggtgttcatcgcctag

SEQ ID NO: 11410 - DNA, 495 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggagaacgagggcaacgacgtgcccgactgcagaagaaccatcagcgcccccgtggtgagacccaaggacgcctacatcaagaaggagaacagcaagctgttcgacccctgcaacagcgtggagttcctggacctggcccacagcagcgagagccaggagaccatcagcagcatgggcgagcagctggacaacctgagcgagcagagaaccgacaccgagaacatggaggactgccagaacctgctgaagccctgcagcctgtgcgagaagagacccagagacggcaacatcatccacggcagaaccggccacctggtgacctgcttccactgcgccagaagactgaagaaggccggcgccagctgccccatctgcaagaaggagatccagctggtgatcaaggtgttcatcgcctag

SEQ ID NO: 11411 - DNA, 423 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggtgagacccaagctgcccctgctgaagatcctgcacgccgccggcgcccagggcgagatgttcaccgtgaaggaggtgatgcactacctgggccagtacatcatggtgaagcagctgtacgaccagcaggagcagcacatggtgtactgcggcggcgacctgctgggcgagctgctgggcagacagagcttcagcgtgaaggaccccagccccctgtacgacatgctgagaaagaacctggtgaccctggccaccgccaccaccgccaagtgcagaggcaagttccacttccagaagaagaactacagaagaagatacccccacaccgcctacctgagagcctag

SEQ ID NO: 11412 - DNA, 516 bp, Artificial Sequence
  Description of Artificial Sequence: Synthetic coding sequence
gacctgatcgagaacctggcccaggacgagaccagcagactggacctgggcttcgaggagtgggacgtggccggcctgccctggtggttcctgggcaacctgagaagcaactacacccccagaagcaacggcagcaccgacctgcagaccaaccaggtgatcgaggtgggcaagaacgacgacctggaggacagcaagagcctgagcgacgacaccgacgtggaggtgaccagcgaggacgagtggcagtgcaccgagtgcaagaagttcaacagccccagcaagagatactgcttcagatgctgggccctgagaaaggactggtacagcgactgcagcaagctgacccacagcctgagcaccagcgacatcaccgccatccccgagaaggagaacgagggcaacgacgtgcccgactgcagaagaaccatcagcgcccccgtggtgagacccaaggacgcctacatcaagaaggagaacagcaagctgttcgacccctgcaacagcgtggagtag

SEQ ID NO: 11413 - DNA, 1323 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggtgagacccaagctgcccctgctgaagatcctgcacgccgccggcgcccagggcgagatgttcaccgtgaaggaggtgatgcactacctgggccagtacatcatggtgaagcagctgtacgaccagcaggagcagcacatggtgtactgcggcggcgacctgctgggcgagctgctgggcagacagagcttcagcgtgaaggaccccagccccctgtacgacatgctgagaaagaacctggtgaccctggccaccgccaccaccgacgccgcccagaccctggccctggcccaggaccacagcatggacatccccagccaggaccagctgaagcagagcgccgaggagagcagcaccagcagaaagagaaccaccgaggacgacatccccaccctgcccaccagcgagcacaagtgcatccacagcagagaggacgaggacctgatcgagaacctggcccaggacgagaccagcagactggacctgggcttcgaggagtgggacgtggccggcctgccctggtggttcctgggcaacctgagaagcaactacacccccagaagcaacggcagcaccgacctgcagaccaaccaggtgatcgaggtgggcaagaacgacgacctggaggacagcaagagcctgagcgacgacaccgacgtggaggtgaccagcgaggacgagtggcagtgcaccgagtgcaagaagttcaacagccccagcaagagatactgcttcagatgctgggccctgagaaaggactggtacagcgactgcagcaagctgacccacagcctgagcaccagcgacatcaccgccatccccgagaaggagaacgagggcaacgacgtgcccgactgcagaagaaccatcagcgcccccgtggtgagacccaaggacgcctacatcaagaaggagaacagcaagctgttcgacccctgcaacagcgtggagttcctggacctggcccacagcagcgagagccaggagaccatcagcagcatgggcgagcagctggacaacctgagcgagcagagaaccgacaccgagaacatggaggactgccagaacctgctgaagccctgcagcctgtgcgagaagagacccagagacggcaacatcatccacggcagaaccggccacctggtgacctgcttccactgcgccagaagactgaagaaggccggcgccagctgccccatctgcaagaaggagatccagctggtgatcaaggtgttcatcgcctag

SEQ ID NO: 11414 - DNA, 384 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggtgagacccaagctgcccctgctgaagatcctgcacgccgccggcgcccagggcgagatgttcaccgtgaaggaggtgatgcactacctgggccagtacatcatggtgaagcagctgtacgaccagcaggagcagcacatggtgtactgcggcggcgacctgctgggcgagctgctgggcagacagagcttcagcgtgaaggaccccagccccctgtacgacatgctgagaaagaacctggtgaccctggccaccgccaccaccggctgccagagaagagtgaacggcccccagagagcctggtag

SEQ ID NO: 11415 - DNA, 462 bp, Artificial Sequence
  Description of Artificial Sequence: Synthetic coding sequence
atgaccagcttcagcaccagcgcccagtgcagcaccagcgacagcgcctgcagaatcagccccggccagatcaaccaggtgagacccaagctgcccctgctgaagatcctgcacgccgccggcgcccagggcgagatgttcaccgtgaaggaggtgatgcactacctgggccagtacatcatggtgaagcagctgtacgaccagcaggagcagcacatggtgtactgcggcggcgacctgctgggcgagctgctgggcagacagagcttcagcgtgaaggaccccagccccctgtacgacatgctgagaaagaacctggtgaccctggccaccgccaccaccggcagccagtacggctacagcaagagcagacccaccgaggccaagtgcagaggcaagttccacttccagaagaagaactacagaagaagatacccccacaccgcctacctgagagcctag

SEQ ID NO: 11416 - DNA, 7650 bp, Artificial Sequence
  Description of Artificial Sequence: Synthetic coding sequence
atgctgggcaccggccccgccgccgccaccaccgccgccaccaccagcagcaacgtgagcgtgctgcagcagttcgccagcggcctgaagagcagaaacgaggagaccagagccaaggccgccaaggagctgcagcactacgtgaccatggagctgagagagatgagccaggaggagagcaccagattctacgaccagctgaaccaccacatcttcgagctggtgagcagcagcgacgccaacgagagaaagggcggcatcctggccatcgccagcctgatcggcgtggagggcggcaacgccaccagaatcggcagattcgccaactacctgagaaacctgctgcccagcaacgaccccgtggtgatggagatggccagcaaggccatcggcagactggccatggccggcgacaccttcaccgccgagtacgtggagttcgaggtgaagagagccctggagtggctgggcgccgacagaaacgagggcagaagacacgccgccgtgctggtgctgagagagctggccatcagcgtgcccaccttcttcttccagcaggtgcagcccttcttcgacaacatcttcgtggccgtgtgggaccccaagcaggccatcagagagggcgccgtggccgccctgagagcctgcctgatcctgaccacccagagagagcccaaggagatgcagaagccccagtggtacagacacaccttcgaggaggccgagaagggcttcgacgagaccctggccaaggagaagggcatgaacagagacgacagaatccacggcgccctgctgatcctgaacgagctggtgagaatcagcagcatggagggcgagagactgagagaggagatggaggagatcacccagcagcagctggtgcacgacaagtactgcaaggacctgatgggcttcggcaccaagcccagacacatcacccccttcaccagcttccaggccgtgcagccccagcagagcaacgccctggtgggcctgctgggctacagcagccaccagggcctgatgggcttcggcaccagccccagccccgccaagagcaccctggtggagagcagatgctgcagagacctgatggaggagaagttcgaccaggtgtgccagtgggtgctgaagtgcagaaacagcaagaacagcctgatccagatgaccatcctgaacctgctgcccagactggccgccttcagacccagcgccttcaccgacacccagtacctgcaggacaccatgaaccacgtgctgagctgcgtgaagaaggagaaggagagaaccgccgccttccaggccctgggcctgctgagcgtggccgtgagaagcgagttcaaggtgtacctgcccagagtgctggacatcatcagagccgccctgccccccaaggacttcgcccacaagagacagaaggccatgcaggtggacgccaccgtgttcacctgcatcagcatgctggccagagccatgggccccggcatccagcaggacatcaaggagctgctggagcccatgctggccgtgggcctgagccccgccctgaccgccgtgctgtacgacctgagcagacagatcccccagctgaagaaggacatccaggacggcctgctgaagatgctgagcctggtgctgatgcacaagcccctgagacaccccggcatgcccaagggcctggcccaccagctggccagccccggcctgaccaccctgcccgaggccagcgacgtgggcagcatcaccctggccctgagaaccctgggcagcttcgagttcgagggccacagcctgacccagttcgtgagacactgcgccgaccacttcctgaacagcgagcacaaggagatcagaatggaggccgccagaacctgcagcagactgctgacccccagcatccacctgatcagcggccacgcccacgtggtgagccagaccgccgtgcaggtggtggccgacgtgctgagcaagctgctggtggtgggcatcaccgaccccgaccccgacatcagatactgcgtgctggccagcctggacgagagattcgacgcccacctggcccaggccgagaacctgcaggccctgttcgtggccctgaacgaccaggtgttcgagatcagagagctggccatctgcaccgtgggcagactgagcagcatgaaccccgccttcgtgatgcccttcctgagaaagatgctgatccagatcctgaccgagctggagcacagcggcatcggcagaatcaaggagcagagcgccagaatgctgggccacctggtgagcaacgcccccagactgatcagaccctacatggagcccatcctgaaggccctgatcctgaagctgaaggaccccgaccccgaccccaaccccggcgtgatcaacaacgtgctggccaccatcggcgagctggcccaggtgagcggcctggagatgagaaagtgggtggacgagctgttcatcatcatcatggacatgctgcaggacagcagcctgctggccaagagacaggtggccctgtggaccctgggccagctggtggccagcaccggctacgtggtggagccctacagaaagtaccccaccctgctggaggtgctgctgaacttcctgaagaccgagcagaaccagggcaccagaagagaggccatcagagtgctgggcctgctgggcgccctggacccctacaagcacaaggtgaacatcggcatgatcgaccagagcagagacgccagcgccgtgagcctgagcgagagcaagagcagccaggacagcagcgactacagcaccagcgagatgctggtgaacatgggcaacctgcccctggacgagttctaccccgccgtgagcatggtggccctgatgagaatcttcagagaccagagcctgagccaccaccacaccatggtggtgcaggccatcaccttcatcttcaagagcctgggcctgaagtgcgtgcagttcctgccccaggtgatgcccaccttcctgaacgtgatcagagtgtgcgacggcgccatcagagagttcctgttccagcagctgggcatgctggtgagcttcgtgaagagccacatcagaccctacatggacgagatcgtgaccctgatgagagagttctgggtgatgaacaccagcatccagagcaccatcatcctgctgatcgagcagatcgtggtggccctgggcggcgagttcaagctgtacctgccccagctgatcccccacatgctgagagtgttcatgcacgacaacagccccggcagaatcgtgagcatcaagctgctggccgccatccagctgttcggcgccaacctggacgactacctgcacctgctgctgccccccatcgtgaagctgttcgacgcccccgaggcccccctgcccagcagaaaggccgccctggagaccgtggacagactgaccgagagcctggacttcaccgactacgccagcagaatcatccaccccatcgtgagaaccctggaccagagccccgagctgagaagcaccgccatggacaccctgagcagcctggtgttccagctgggcaagaagtaccagatcttcatccccatggtgaacaaggtgctggtgagacacagaatcaaccaccagagatacgacgtgctgatctgcagaatcgtgaagggctacaccctggccgacgaggaggaggaccccctgatctaccagcacagaatgctgagaagcggccagggcgacgccctggccagcggccccgtggagaccggccccatgaagaagctgcacgtgagcaccatcaacctgcagaaggcctggggcgccgccagaagagtgagcaaggacgactggctggagtggctgagaagactgagcctggagctgctgaaggacagcagcagccccagcctgagaagctgctgggccctggcccaggcctacaaccccatggccagagacctgttcaacgccgccttcgtgagctgctggagcgagctgaacgaggaccagcaggacgagctgatcagaagcatcgagctggccctgaccagccaggacatcgccgaggtgacccagaccctgctgaacctggccgagttcatggagcacagcgacaagggccccctgcccctgagagacgacaacggcatcgtgctgctgggcgagagagccgccaagtgcagagcctacgccaaggccctgcactacaaggagctggagttccagaagggccccacccccgccatcctggagagcctgatcagcatcaacaacaagctgcagcagcccgaggccgccgccggcgtgctggagtacgccatgaagcacttcggcgagctggagatccaggccacctggtacgagaagctgcacgagtgggaggacgccctggtggcctacgacaagaagatggacaccaacaaggacgaccccgagctgatgctgggcagaatgagatgcctggaggccctgggcgagtggggccagctgcaccagcagtgctgcgagaagtggaccctggtgaacgacgagacccaggccaagatggccagaatggccgccgccgccgcctggggcctgggccagtgggacagcatggaggagtacacctgcatgatccccagagacacccacgacggcgccttctacagagccgtgctggccctgcaccaggacctgttcagcctggcccagcagtgcatcgacaaggccagagacctgctggacgccgagctgaccgccatggccggcgagagctacagcagagcctacggcgccatggtgagctgccacatgctgagcgagctggaggaggtgatccagtacaagctggtgcccgagagaagagagatcatcagacagatctggtgggagagactgcagggctgccagagaatcgtggaggactggcagaagatcctgatggtgagaagcctggtggtgagcccccacgaggacatgagaacctggctgaagtacgccagcctgtgcggcaagagcggcagactggccctggcccacaagaccctggtgctgctgctgggcgtggaccccagcagacagctggaccaccccctgcccaccgtgcacccccaggtgacctacgcctacatgaagaacatgtggaagagcgccagaaagatcgacgccttccagcacatgcagcacttcgtgcagaccatgcagcagcaggcccagcacgccatcgccaccgaggaccagcagcacaagcaggagctgcacaagctgatggccagatgcttcctgaagctgggcgagtggcagctgaacctgcagggcatcaacgagagcaccatccccaaggtgctgcagtactacagcgccgccaccgagcacgacagaagctggtacaaggcctggcacgcctgggccgtgatgaacttcgaggccgtgctgcactacaagcaccagaaccaggccagagacgagaagaagaagctgagacacgccagcggcgccaacatcaccaacgccaccaccgccgccaccaccgccgccaccgccaccaccaccgccagcaccgagggcagcaacagcgagagcgaggccgagagcaccgagaacagccccacccccagccccctgcagaagaaggtgaccgaggacctgagcaagaccctgctgatgtacaccgtgcccgccgtgcagggcttcttcagaagcatcagcctgagcagaggcaacaacctgcaggacaccctgagagtgctgaccctgtggttcgactacggccactggcccgacgtgaacgaggccctggtggagggcgtgaaggccatccagatcgacacctggctgcaggtgatcccccagctgatcgccagaatcgacacccccagacccctggtgggcagactgatccaccagctgctgaccgacatcggcagataccacccccaggccctgatctaccccctgaccgtggccagcaagagcaccaccaccgccagacacaacgccgccaacaagatcctgaagaacatgtgcgagcacagcaacaccctggtgcagcaggccatgatggtgagcgaggagctgatcagagtggccatcctgtggcacgagatgtggcacgagggcctggaggaggccagcagactgtacttcggcgagagaaacgtgaagggcatgttcgaggtgctggagcccctgcacgccatgatggagagaggcccccagaccctgaaggagaccagcttcaaccaggcctacggcagagacctgatggaggcccaggagtggtgcagaaagtacatgaagagcggcaacgtgaaggacctgacccaggcctgggacctgtactaccacgtgttcagaagaatcagcaagcagctgccccagctgaccagcctggagctgcagtacgtgagccccaagctgctgatgtgcagagacctggagctggccgtgcccggcacctacgaccccaaccagcccatcatcagaatccagagcatcgcccccagcctgcaggtgatcaccagcaagcagagacccagaaagctgaccctgatgggcagcaacggccacgagttcgtgttcctgctgaagggccacgaggacctgagacaggacgagagagtgatgcagctgttcggcctggtgaacaccctgctggccaacgaccccaccagcctgagaaagaacctgagcatccagagatacgccgtgatccccctgagcaccaacagcggcctgatcggctgggtgccccactgcgacaccctgcacgccctgatcagagactacagagagaagaagaagatcctgctgaacatcgagcacagaatcatgctgagaatggcccccgactacgaccacctgaccctgatgcagaaggtggaggtgttcgagcacgccgtgaacaacaccgccggcgacgacctggccaagctgctgtggctgaagagccccagcagcgaggtgtggttcgacagaagaaccaactacaccagaagcctggccgtgatgagcatggtgggctacatcctgggcctgggcgacagacaccccagcaacctgatgctggacagactgagcggcaagatcctgcacatcgacttcggcgactgcttcgaggtggccatgaccagagagaagttccccgagaagatccccttcagactgaccagaatgctgaccaacgccatggaggtgaccggcctggacggcaactacagaatcacctgccacaccgtgatggaggtgctgagagagcacaaggacagcgtgatggccgtgctggaggccttcgtgtacgaccccctgctgaactggagactgatggacaccaacaccaagggcaacaagagaagcagaaccagaaccgacagctacagcgccggccagagcgtggagatcctggacggcgtggagctgggcgagcccgcccacaagaagaccggcaccaccgtgcccgagagcatccacagcttcatcggcgacggcctggtgaagcccgaggccctgaacaagaaggccatccagatcatcaacagagtgagagacaagctgaccggcagagacttcagccacgacgacaccctggacgtgcccacccaggtggagctgctgatcaagcaggccaccagccacgagaacctgtgccagtgctacatcggctggtgccccttctggtag

SEQ ID NO: 11417 - DNA, 2265 bp, Artificial Sequence
  Description of Artificial Sequence: Synthetic coding sequence
atgaacttcgaggccgtgctgcactacaagcaccagaaccaggccagagacgagaagaagaagctgagacacgccagcggcgccaacatcaccaacgccaccaccgccgccaccaccgccgccaccgccaccaccaccgccagcaccgagggcagcaacagcgagagcgaggccgagagcaccgagaacagccccacccccagccccctgcagaagaaggtgaccgaggacctgagcaagaccctgctgatgtacaccgtgcccgccgtgcagggcttcttcagaagcatcagcctgagcagaggcaacaacctgcaggacaccctgagagtgctgaccctgtggttcgactacggccactggcccgacgtgaacgaggccctggtggagggcgtgaaggccatccagatcgacacctggctgcaggtgatcccccagctgatcgccagaatcgacacccccagacccctggtgggcagactgatccaccagctgctgaccgacatcggcagataccacccccaggccctgatctaccccctgaccgtggccagcaagagcaccaccaccgccagacacaacgccgccaacaagatcctgaagaacatgtgcgagcacagcaacaccctggtgcagcaggccatgatggtgagcgaggagctgatcagagtggccatcctgtggcacgagatgtggcacgagggcctggaggaggccagcagactgtacttcggcgagagaaacgtgaagggcatgttcgaggtgctggagcccctgcacgccatgatggagagaggcccccagaccctgaaggagaccagcttcaaccaggcctacggcagagacctgatggaggcccaggagtggtgcagaaagtacatgaagagcggcaacgtgaaggacctgacccaggcctgggacctgtactaccacgtgttcagaagaatcagcaagcagctgccccagctgaccagcctggagctgcagtacgtgagccccaagctgctgatgtgcagagacctggagctggccgtgcccggcacctacgaccccaaccagcccatcatcagaatccagagcatcgcccccagcctgcaggtgatcaccagcaagcagagacccagaaagctgaccctgatgggcagcaacggccacgagttcgtgttcctgctgaagggccacgaggacctgagacaggacgagagagtgatgcagctgttcggcctggtgaacaccctgctggccaacgaccccaccagcctgagaaagaacctgagcatccagagatacgccgtgatccccctgagcaccaacagcggcctgatcggctgggtgccccactgcgacaccctgcacgccctgatcagagactacagagagaagaagaagatcctgctgaacatcgagcacagaatcatgctgagaatggcccccgactacgaccacctgaccctgatgcagaaggtggaggtgttcgagcacgccgtgaacaacaccgccggcgacgacctggccaagctgctgtggctgaagagccccagcagcgaggtgtggttcgacagaagaaccaactacaccagaagcctggccgtgatgagcatggtgggctacatcctgggcctgggcgacagacaccccagcaacctgatgctggacagactgagcggcaagatcctgcacatcgacttcggcgactgcttcgaggtggccatgaccagagagaagttccccgagaagatccccttcagactgaccagaatgctgaccaacgccatggaggtgaccggcctggacggcaactacagaatcacctgccacaccgtgatggaggtgctgagagagcacaaggacagcgtgatggccgtgctggaggccttcgtgtacgaccccctgctgaactggagactgatggacaccaacaccaagggcaacaagagaagcagaaccagaaccgacagctacagcgccggccagagcgtggagatcctggacggcgtggagctgggcgagcccgcccacaagaagaccggcaccaccgtgcccgagagcatccacagcttcatcggcgacggcctggtgaagcccgaggccctgaacaagaaggccatccagatcatcaacagagtgagagacaagctgaccggcagagacttcagccacgacgacaccctggacgtgcccacccaggtggagctgctgatcaagcaggccaccagccacgagaacctgtgccagtgctacatcggctggtgccccttctggtag

SEQ ID NO: 11418 - DNA, 486 bp, Artificial Sequence
  Description of Artificial Sequence: Synthetic coding sequence
atgctggacagactgagcggcaagatcctgcacatcgacttcggcgactgcttcgaggtggccatgaccagagagaagttccccgagaagatccccttcagactgaccagaatgctgaccaacgccatggaggtgaccggcctggacggcaactacagaatcacctgccacaccgtgatggaggtgctgagagagcacaaggacagcgtgatggccgtgctggaggccttcgtgtacgaccccctgctgaactggagactgatggacaccaacaccaagggcaacaagagaagcagaaccagaaccgacagctacagcgccggccagagcgtggagatcctggacggcgtggagctgggcgagcccgcccacaagaagaccggcaccaccgtgcccgagagcatccacagcttcatcggcgacggcctggtgaagcccgaggccctgaacaagaaggccatccagatcatcaacagagtgagatag

SEQ ID NO: 11419 - DNA, 5187 bp, Artificial Sequence
  Description of Artificial Sequence: Synthetic coding sequence
atgctgggcaccggccccgccgccgccaccaccgccgccaccaccagcagcaacgtgagcgtgctgcagcagttcgccagcggcctgaagagcagaaacgaggagaccagagccaaggccgccaaggagctgcagcactacgtgaccatggagctgagagagatgagccaggaggagagcaccagattctacgaccagctgaaccaccacatcttcgagctggtgagcagcagcgacgccaacgagagaaagggcggcatcctggccatcgccagcctgatcggcgtggagggcggcaacgccaccagaatcggcagattcgccaactacctgagaaacctgctgcccagcaacgaccccgtggtgatggagatggccagcaaggccatcggcagactggccatggccggcgacaccttcaccgccgagtacgtggagttcgaggtgaagagagccctggagtggctgggcgccgacagaaacgagggcagaagacacgccgccgtgctggtgctgagagagctggccatcagcgtgcccaccttcttcttccagcaggtgcagcccttcttcgacaacatcttcgtggccgtgtgggaccccaagcaggccatcagagagggcgccgtggccgccctgagagcctgcctgatcctgaccacccagagagagcccaaggagatgcagaagccccagtggtacagacacaccttcgaggaggccgagaagggcttcgacgagaccctggccaaggagaagggcatgaacagagacgacagaatccacggcgccctgctgatcctgaacgagctggtgagaatcagcagcatggagggcgagagactgagagaggagatggaggagatcacccagcagcagctggtgcacgacaagtactgcaaggacctgatgggcttcggcaccaagcccagacacatcacccccttcaccagcttccaggccgtgcagccccagcagagcaacgccctggtgggcctgctgggctacagcagccaccagggcctgatgggcttcggcaccagccccagccccgccaagagcaccctggtggagagcagatgctgcagagacctgatggaggagaagttcgaccaggtgtgccagtgggtgctgaagtgcagaaacagcaagaacagcctgatccagatgaccatcctgaacctgctgcccagactggccgccttcagacccagcgccttcaccgacacccagtacctgcaggacaccatgaaccacgtgctgagctgcgtgaagaaggagaaggagagaaccgccgccttccaggccctgggcctgctgagcgtggccgtgagaagcgagttcaaggtgtacctgcccagagtgctggacatcatcagagccgccctgccccccaaggacttcgcccacaagagacagaaggccatgcaggtggacgccaccgtgttcacctgcatcagcatgctggccagagccatgggccccggcatccagcaggacatcaaggagctgctggagcccatgctggccgtgggcctgagccccgccctgaccgccgtgctgtacgacctgagcagacagatcccccagctgaagaaggacatccaggacggcctgctgaagatgctgagcctggtgctgatgcacaagcccctgagacaccccggcatgcccaagggcctggcccaccagctggccagccccggcctgaccaccctgcccgaggccagcgacgtgggcagcatcaccctggccctgagaaccctgggcagcttcgagttcgagggccacagcctgacccagttcgtgagacactgcgccgaccacttcctgaacagcgagcacaaggagatcagaatggaggccgccagaacctgcagcagactgctgacccccagcatccacctgatcagcggccacgcccacgtggtgagccagaccgccgtgcaggtggtggccgacgtgctgagcaagctgctggtggtgggcatcaccgaccccgaccccgacatcagatactgcgtgctggccagcctggacgagagattcgacgcccacctggcccaggccgagaacctgcaggccctgttcgtggccctgaacgaccaggtgttcgagatcagagagctggccatctgcaccgtgggcagactgagcagcatgaaccccgccttcgtgatgcccttcctgagaaagatgctgatccagatcctgaccgagctggagcacagcggcatcggcagaatcaaggagcagagcgccagaatgctgggccacctggtgagcaacgcccccagactgatcagaccctacatggagcccatcctgaaggccctgatcctgaagctgaaggaccccgaccccgaccccaaccccggcgtgatcaacaacgtgctggccaccatcggcgagctggcccaggtgagcggcctggagatgagaaagtgggtggacgagctgttcatcatcatcatggacatgctgcaggacagcagcctgctggccaagagacaggtggccctgtggaccctgggccagctggtggccagcaccggctacgtggtggagccctacagaaagtaccccaccctgctggaggtgctgctgaacttcctgaagaccgagcagaaccagggcaccagaagagaggccatcagagtgctgggcctgctgggcgccctggacccctacaagcacaaggtgaacatcggcatgatcgaccagagcagagacgccagcgccgtgagcctgagcgagagcaagagcagccaggacagcagcgactacagcaccagcgagatgctggtgaacatgggcaacctgcccctggacgagttctaccccgccgtgagcatggtggccctgatgagaatcttcagagaccagagcctgagccaccaccacaccatggtggtgcaggccatcaccttcatcttcaagagcctgggcctgaagtgcgtgcagttcctgccccaggtgatgcccaccttcctgaacgtgatcagagtgtgcgacggcgccatcagagagttcctgttccagcagctgggcatgctggtgagcttcgtgaagagccacatcagaccctacatggacgagatcgtgaccctgatgagagagttctgggtgatgaacaccagcatccagagcaccatcatcctgctgatcgagcagatcgtggtggccctgggcggcgagttcaagctgtacctgccccagctgatcccccacatgctgagagtgttcatgcacgacaacagccccggcagaatcgtgagcatcaagctgctggccgccatccagctgttcggcgccaacctggacgactacctgcacctgctgctgccccccatcgtgaagctgttcgacgcccccgaggcccccctgcccagcagaaaggccgccctggagaccgtggacagactgaccgagagcctggacttcaccgactacgccagcagaatcatccaccccatcgtgagaaccctggaccagagccccgagctgagaagcaccgccatggacaccctgagcagcctggtgttccagctgggcaagaagtaccagatcttcatccccatggtgaacaaggtgctggtgagacacagaatcaaccaccagagatacgacgtgctgatctgcagaatcgtgaagggctacaccctggccgacgaggaggaggaccccctgatctaccagcacagaatgctgagaagcggccagggcgacgccctggccagcggccccgtggagaccggccccatgaagaagctgcacgtgagcaccatcaacctgcagaaggcctggggcgccgccagaagagtgagcaaggacgactggctggagtggctgagaagactgagcctggagctgctgaaggacagcagcagccccagcctgagaagctgctgggccctggcccaggcctacaaccccatggccagagacctgttcaacgccgccttcgtgagctgctggagcgagctgaacgaggaccagcaggacgagctgatcagaagcatcgagctggccctgaccagccaggacatcgccgaggtgacccagaccctgctgaacctggccgagttcatggagcacagcgacaagggccccctgcccctgagagacgacaacggcatcgtgctgctgggcgagagagccgccaagtgcagagcctacgccaaggccctgcactacaaggagctggagttccagaagggccccacccccgccatcctggagagcctgatcagcatcaacaacaagctgcagcagcccgaggccgccgccggcgtgctggagtacgccatgaagcacttcggcgagctggagatccaggccacctggtacgagaagctgcacgagtgggaggacgccctggtggcctacgacaagaagatggacaccaacaaggacgaccccgagctgatgctgggcagaatgagatgcctggaggccctgggcgagtggggccagctgcaccagcagtgctgcgagaagtggaccctggtgaacgacgagacccaggccaagatggccagaatggccgccgccgccgcctggggcctgggccagtgggacagcatggaggagtacacctgcatgatccccagagacacccacgacggcgccttctacagagccgtgctggccctgcaccaggacctgttcagcctggcccagcagtgcatcgacaaggccagagacctgctggacgccgagctgaccgccatggccggcgagagctacagcagagcctacggcgccatggtgagctgccacatgctgagcgagctggaggaggtgatccagtacaagctggtgcccgagagaagagagatcatcagacagatctggtgggagagactgcagggctgccagagaatcgtggaggactggcagaagatcctgatggtgagaagcctggtggtgagcccccacgaggacatgagaacctggctgaagtacgccagcctgtgcggcaagagcggcagactggccatcgcccccctgaacatgggcaccgccaacagcgcccagcccagaagcctgagaagctggagaacctggatcagaatcctggactgcaaggacaccgaggacgccgacctgacccccgccacctaccccaagaccagcctggtgtgcggccagcagcagaagtgcctgcaggacagacccaagtag

SEQ ID NO: 11420 - DNA, 6270 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagaaggacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcaccctggacgagccctgggaggtgctggccacccagcccttctgcctgagagagagcgaggacagcgagacccagcccttcgacacccacctggaggcctacggcccctgcctgagcccccccagagccatccccggcgaccagcaccccgagagccccgtgcacaccgagcccatgggcatccagggcagaggcagacagaccgtggacaaggtgatgggcatccccaaggagaccgccgagagagtgggccccgagagaggccccctggagagagagaccgagaagctgctgcccgagagacagaccgacgtgaccggcgaggaggagctgaccaagggcaagcaggacagagagcagaagcagctgctggccagagacacccagagacaggagagcgacaagaacggcgagagcgccagccccgagagagacagagagagcctgaaggtggagatcgagaccagcgaggagatccaggagaagcaggtgcagaagcagaccctgcccagcaaggccttcgagagagaggtggagagacccgtggccaacagagagtgcgaccccgccgagctggaggagaaggtgcccaaggtgatcctggagagagacacccagagaggcgagcccgagggcggcagccaggaccagaagggccaggccagcagccccacccccgagcccggcgtgggcgccggcgacctgcccggccccaccagcgcccccgtgcccagcggcagccagagcggcggcagaggcagccccgtgagccccagaagacaccagaagggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagacccccgagaccgtggtgcccaccgcccccgagctgcagatcagcaccagcaccgaccagcccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 11421 - DNA, 489 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgtag

SEQ ID NO: 11422 - DNA, 384 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtag

SEQ ID NO: 11423 - DNA, 921 bp, Artificial Sequence
  Description of Artificial Sequence: Synthetic coding sequence
tgacacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgccctag

SEQ ID NO: 11424 - DNA, 342 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccactag

SEQ ID NO: 11425 - DNA, 5409 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagaaggacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcaccctggacgagccctgggaggtgctggccacccagcccttctgcctgagagagagcgaggacagcgagacccagcccttcgacacccacctggaggcctacggcccctgcctgagcccccccagagccatccccggcgaccagcaccccgagagccccgtgcacaccgagcccatgggcatccagggcagaggcagacagaccgtggacaaggtgatgggcatccccaaggagaccgccgagagagtgggccccgagagaggccccctggagagagagaccgagaagctgctgcccgagagacagaccgacgtgaccggcgaggaggagctgaccaagggcaagcaggacagagagcagaagcagctgctggccagagacacccagagacaggagagcgacaagaacggcgagagcgccagccccgagagagacagagagagcctgaaggtggagatcgagaccagcgaggagatccaggagaagcaggtgcagaagcagaccctgcccagcaaggccttcgagagagaggtggagagacccgtggccaacagagagtgcgaccccgccgagctggaggagaaggtgcccaaggtgatcctggagagagacacccagagaggcgagcccgagggcggcagccaggaccagaagggccaggccagcagccccacccccgagcccggcgtgggcgccggcgacctgcccggccccaccagcgcccccgtgcccagcggcagccagagcggcggcagaggcagccccgtgagccccagaagacaccagaagggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 11426 - DNA, 666 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagcagcagcctgccccccccccagaccagcctgctgcccctgagcctgagactgagactgctgggcgaggagcagatcgaccccctgagcagactgctgaagcagctgagcccccagcccctgagctacagactgccccccccccagaccagcctgagccccctgagcccccacctgggccccctgggcgaggagaagatcggccccctgagcagacccctgaagcagctgtgcccccagcccctgagcagcagcctgccccccccccagaccaacctgagccccctgagcccccacctgggccccctgggcgccggccagatcggccccctgagcagacccctgaaccagctgagcctgtag

SEQ ID NO: 11427 - DNA, 738 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggcctag

SEQ ID NO: 11428 - DNA, 735 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagccccacagaggcggcctgctgagctgccagaagagatgccactgcagaggctag

SEQ ID NO: 11429 - DNA, 5478 bp, Artificial Sequence
  Description of Artificial Sequence: Synthetic coding sequence
atggaggacacccaggccatcgactgggacgtggaggaggaggaggagaccgagcagagcagcgagagcctgagatgcaacgtggagcccgtgggcagactgcacatcttcagcggcgcccacggccccgagaaggacttccccctgcacctgggcaagaacgtggtgggcagaatgcccgactgcagcgtggccctgcccttccccagcatcagcaagcagcacgccgagatcgagatcctggcctgggacaaggcccccatcctgagagactgcggcagcctgaacggcacccagatcctgagaccccccaaggtgctgagccccggcgtgagccacagactgagagaccaggagctgatcctgttcgccgacctgctgtgccagtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagaaggacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggccgtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagacccccgagaccgtggtgcccaccgcccccgagctgcagatcagcaccagcaccgaccagcccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 11430 - DNA, 4968 bp, Artificial Sequence
  Description of Artificial Sequence: Synthetic coding sequence
atgtaccacagactggacgtgagcctgcccttcgtgagcagaggccccctgaccgtggaggagacccccagagtgcagggcgagacccagccccagagactgctgctggccgaggacagcgaggaggaggtggacttcctgagcgagagaagaatggtgaagaagagcagaaccaccagcagcagcgtgatcgtgcccgagagcgacgaggagggccacagccccgtgctgggcggcctgggcccccccttcgccttcaacctgaacagcgacaccgacgtggaggagggccagcagcccgccaccgaggaggccagcagcgccgccagaagaggcgccaccgtggaggccaagcagagcgaggccgaggtggtgaccgagatccagctggagaaggaccagcccctggtgaaggagaaggacaacgacaccaaggtgaagagaggcgccggcaacggcgtggtgcccgccggcgtgatcctggagagaagccagccccccggcgaggacagcgacaccgacgtggacgacgacagcagaccccccggcagacccgccgaggtgcacctggagagagcccagcccttcggcttcatcgacagcgacaccgacgccgaggaggagagaatccccgccacccccgtggtgatccccatgaagaagagaaagatcttccacggcgtgggcaccagaggccccggcgcccccggcctggcccacctgcaggagagccaggccggcagcgacaccgacgtggaggagggcaaggccccccaggccgtgcccctggagaagagccaggccagcatggtgatcaacagcgacaccgacgacgaggaggaggtgagcgccgccctgaccctggcccacctgaaggagagccagcccgccatctggaacagagacgccgaggaggacatgccccagagagtggtgctgctgcagagaagccagaccaccaccgagagagacagcgacaccgacgtggaggaggaggagctgcccgtggagaacagagaggccgtgctgaaggaccacaccaagatcagagccctggtgagagcccacagcgagaaggaccagccccccttcggcgacagcgacgacagcgtggaggccgacaagagcagccccggcatccacctggagagaagccaggccagcaccaccgtggacatcaacacccaggtggagaaggaggtgccccccggcagcgccatcatccacatcaagaagcaccaggtgagcgtggagggcaccaaccagaccgacgtgaaggccgtgggcggccccgccaagctgctggtggtgagcctggaggaggcctggcccctgcacggcgactgcgagaccgacgccgaggagggcaccagcctgaccgccagcgtggtggccgacgtgagaaagagccagctgcccgccgagggcgacgccggcgccgagtgggccgccgccgtgctgaagcaggagagagcccacgaggtgggcgcccagggcggcccccccgtggcccaggtggagcaggacctgcccatcagcagagagaacctgaccgacctggtggtggacaccgacaccctgggcgagagcacccagccccagagagagggcgcccaggtgcccaccggcagagagagagagcagcacgtgggcggcaccaaggacagcgaggacaactacggcgacagcgaggacctggacctgcaggccacccagtgcttcctggagaaccagggcctggaggtgcagagcatggaggacgagcccacccaggccttcatgctgacccccccccaggagctgggccccagccactgcagcttccagaccaccggcctgctgaactgcaagatgccccccgccgagaaggccagcagaatcagagccgccgagaaggtgagcagaggcgaccaggagagccccgacgcctgcctgccccccaccgtgcccgaggcccccgcccccccccagaagcccctgaacagccagagccagaagcacctggcccccccccccctgctgagccccctgctgcccagcatcaagcccaccgtgagaaagaccagacaggacggcagccaggaggcccccgaggcccccctgagcagcgagctggagcccttccaccccaagcccaagatcagaaccagaaagagcagcagaatgacccccttccccgccaccagcgccgcccccgagccccaccccagcaccagcaccgcccagcccgtgacccccaagcccaccagccaggccaccagaagcagaaccaacagaagcagcgtgaagacccccgagcccgtggtgcccaccgcccccgagctgcagcccagcaccagcaccgaccagcccgtgaccagcgagcccaccagccaggtgaccagaggcagaaagagcagaagcagcgtgaagacccccgagaccgtggtgcccaccgccctggagctgcagcccagcaccagcaccgacagacccgtgaccagcgagcccaccagccaggccaccagaggcagaaagaacagaagcagcgtgaagacccccgagcccgtggtgcccaccgcccccgagctgcagcccagcaccagcaccgaccagcccgtgaccagcgagcccacctaccaggccaccagaggcagaaagaacagaagcagcgtgaagacccccgagcccgtggtgcccaccgcccccgagctgagacccagcaccagcaccgacagacccgtgacccccaagcccaccagcagaaccaccagaagcagaaccaacatgagcagcgtgaagaaccccgagagcaccgtgcccatcgcccccgagctgccccccagcaccagcaccgagcagcccgtgacccccgagcccaccagcagagccaccagaggcagaaagaacagaagcagcggcaagacccccgagaccctggtgcccaccgcccccaagctggagcccagcaccagcaccgaccagcccgtgacccccgagcccaccagccaggccaccagaggcagaaccaacagaagcagcgtgaagacccccgagaccgtggtgcccaccgcccccgagctgcagcccagcaccagcaccgaccagcccgtgacccccgagcccaccagccaggccaccagaggcagaaccgacagaagcagcgtgaagacccccgagaccgtggtgcccaccgcccccgagctgcaggccagcgccagcaccgaccagcccgtgaccagcgagcccaccagcagaaccaccagaggcagaaagaacagaagcagcgtgaagacccccgagaccgtggtgcccgccgcccccgagctgcagcccagcaccagcaccgaccagcccgtgacccccgagcccaccagcagagccaccagaggcagaaccaacagaagcagcgtgaagacccccgagagcatcgtgcccatcgcccccgagctgcagcccagcaccagcagaaaccagctggtgacccccgagcccaccagcagagccaccagatgcagaaccaacagaagcagcgtgaagacccccgagcccgtggtgcccaccgcccccgagccccaccccaccaccagcaccgaccagcccgtgacccccaagctgaccagcagagccaccagaagaaagaccaacagaagcagcgtgaagacccccaagcccgtggagcccgccgccagcgacctggagcccttcacccccaccgaccagagcgtgacccccgaggccatcgcccagggcggccagagcaagaccctgagaagcagcaccgtgagagccatgcccgtgcccaccacccccgagttccagagccccgtgaccaccgaccagcccatcagccccgagcccatcacccagcccagctgcatcaagagacagagagccgccggcaaccccggcagcctggccgcccccatcgaccacaagccctgcagcgcccccctggagcccaagagccaggccagcagaaaccagagatggggcgccgtgagagccgccgagagcctgaccgccatccccgagcccgccagcccccagctgctggagacccccatccacgccagccagatccagaaggtggagcccgccggcagaagcagattcacccccgagctgcagcccaaggccagccagagcagaaagagaagcctggccaccatggacagccccccccaccagaagcagccccagagaggcgaggtgagccagaagaccgtgatcatcaaggaggaggaggaggacaccgccgagaagcccggcaaggaggaggacgtggtgacccccaagcccggcaagagaaagagagaccaggccgaggaggagcccaacagaatccccagcagaagcctgagaagaaccaagctgaaccaggagagcaccgcccccaaggtgctgttcaccggcgtggtggacgccagaggcgagagagccgtgctggccctgggcggcagcctggccggcagcgccgccgaggccagccacctggtgaccgacagaatcagaagaaccgtgaagttcctgtgcgccctgggcagaggcatccccatcctgagcctggactggctgcaccagagcagaaaggccggcttcttcctgccccccgacgagtacgtggtgaccgaccccgagcaggagaagaacttcggcttcagcctgcaggacgccctgagcagagccagagagagaagactgctggagggctacgagatctacgtgacccccggcgtgcagcccccccccccccagatgggcgagatcatcagctgctgcggcggcacctacctgcccagcatgcccagaagctacaagccccagagagtggtgatcacctgcccccaggacttcccccactgcagcatccccctgagagtgggcctgcccctgctgagccccgagttcctgctgaccggcgtgctgaagcaggaggccaagcccgaggccttcgtgctgagccccctggagatgagcagcacctag

SEQ ID NO: 11431 - DNA, 1941 bp, Artificial Sequence
  Description of Artificial Sequence: Synthetic coding sequence
atgggcctgcccagactggtgtgcgccttcctgctggccgcctgctgctgctgccccagagtggccggcgtgcccggcgaggccgagcagcccgcccccgagctggtggaggtggaggtgggcagcaccgccctgctgaagtgcggcctgagccagagccagggcaacctgagccacgtggactggttcagcgtgcacaaggagaagagaaccctgatcttcagagtgagacagggccagggccagagcgagcccggcgagtacgagcagagactgagcctgcaggacagaggcgccaccctggccctgacccaggtgaccccccaggacgagagaatcttcctgtgccagggcaagagacccagaagccaggagtacagaatccagctgagagtgtacaaggcccccgaggagcccaacatccaggtgaaccccctgggcatccccgtgaacagcaaggagcccgaggaggtggccacctgcgtgggcagaaacggctaccccatcccccaggtgatctggtacaagaacggcagacccctgaaggaggagaagaacagagtgcacatccagagcagccagaccgtggagagcagcggcctgtacaccctgcagagcatcctgaaggcccagctggtgaaggaggacaaggacgcccagttctactgcgagctgaactacagactgcccagcggcaaccacatgaaggagagcagagaggtgaccgtgcccgtgttctaccccaccgagaaggtgtggctggaggtggagcccgtgggcatgctgaaggagggcgacagagtggagatcagatgcctggccgacggcaacccccccccccacttcagcatcagcaagcagaaccccagcaccagagaggccgaggaggagaccaccaacgacaacggcgtgctggtgctggagcccgccagaaaggagcacagcggcagatacgagtgccagggcctggacctggacaccatgatcagcctgctgagcgagccccaggagctgctggtgaactacgtgagcgacgtgagagtgagccccgccgcccccgagagacaggagggcagcagcctgaccctgacctgcgaggccgagagcagccaggacctggagttccagtggctgagagaggagaccggccaggtgctggagagaggccccgtgctgcagctgcacgacctgaagagagaggccggcggcggctacagatgcgtggccagcgtgcccagcatccccggcctgaacagaacccagctggtgaacgtggccatcttcggccccccctggatggccttcaaggagagaaaggtgtgggtgaaggagaacatggtgctgaacctgagctgcgaggccagcggccaccccagacccaccatcagctggaacgtgaacggcaccgccagcgagcaggaccaggacccccagagagtgctgagcaccctgaacgtgctggtgacccccgagctgctggagaccggcgtggagtgcaccgccagcaacgacctgggcaagaacaccagcatcctgttcctggagctggtgaacctgaccaccctgacccccgacagcaacaccaccaccggcctgagcaccagcaccgccagcccccacaccagagccaacagcaccagcaccgagagaaagctgcccgagcccgagagcagaggcgtggtgatcgtggccgtgatcgtgtgcatcctggtgctggccgtgctgggcgccgtgctgtacttcctgtacaagaagggcaagctgccctgcagaagaagcggcaagcaggagatcaccctgccccccagcagaaagagcgagctggtggtggaggtgaagagcgacaagctgcccgaggagatgggcctgctgcagggcagcagcggcgacaagagagcccccggcgaccagggcgagaagtacatcgacctgagacactag

SEQ ID NO: 11432 - DNA, 1584 bp, Artificial Sequence
  Description of Artificial Sequence: Synthetic coding sequence
atggtgtacatcgtgagacagttcctgctgtacaacgtgagcggcagcgtgtacctggaccagctgatcgtgctgctgaccgccaagttcagcatcctgagaatcgccggcagcagagtgcaccacagccccttcagcggccacctggacggctgcagcttcctgagcctgcagcacagcctgcacaccagcctggacatgagcagacacgagaacgtgttcctgggcctgaccctgagcagcaagagcgccggcctgaagggcttccagctggccttcgtgcccggcctgctgcagggcaccggcggctacctggacggccccctgcccacccccgtggacaaccccagagtgggcctggaggtgggcctgagactgagcctgccccccctgcccccctgccccggcgtgcacatccagagcagccagaccgtggagagcagcggcctgtacaccctgcagagcatcctgaaggcccagctggtgaaggaggacaaggacgcccagttctactgcgagctgaactacagactgcccagcggcaaccacatgaaggagagcagagaggtgaccgtgcccgtgttctaccccaccgagaaggtgtggctggaggtggagcccgtgggcatgctgaaggagggcgacagagtggagatcagatgcctggccgacggcaacccccccccccacttcagcatcagcaagcagaaccccagcaccagagaggccgaggaggagaccaccaacgacaacggcgtgctggtgctggagcccgccagaaaggagcacagcggcagatacgagtgccagggcctggacctggacaccatgatcagcctgctgagcgagccccaggagctgctggtgaactacgtgagcgacgtgagagtgagccccgccgcccccgagagacaggagggcagcagcctgaccctgacctgcgaggccgagagcagccaggacctggagttccagtggctgagagaggagaccggccaggtgctggagagaggccccgtgctgcagctgcacgacctgaagagagaggccggcggcggctacagatgcgtggccagcgtgcccagcatccccggcctgaacagaacccagctggtgaacgtggccatcttcggccccccctggatggccttcaaggagagaaaggtgtgggtgaaggagaacatggtgctgaacctgagctgcgaggccagcggccaccccagacccaccatcagctggaacgtgaacggcaccgccagcgagcaggaccaggacccccagagagtgctgagcaccctgaacgtgctggtgacccccgagctgctggagaccggcgtggagtgcaccgccagcaacgacctgggcaagaacaccagcatcctgttcctggagctggtgaacctgaccaccctgacccccgacagcaacaccaccaccggcctgagcaccagcaccgccagcccccacaccagagccaacagcaccagcaccggcaagcccggcctggccagagagcagggctgcgccagagccagcttcctgccctgccccagccccgagagccccgtgcagaagggcgagtag

SEQ ID NO: 11433 - DNA, 141 bp, Artificial Sequence
  Description of Artificial Sequence: Synthetic coding sequence
ggcgtggtgatcgtggccgtgatcgtgtgcatcctggtgctggccgtgctgggcgccgtgctgtacttcctgtacaagaagggcaagctgccctgcagaagaagcggcaagcaggagatggagagaaacaccagcatctag

SEQ ID NO: 11434 - DNA, 2253 bp, Artificial Sequence
  Description of Artificial Sequence: Synthetic coding sequence
atgggcaagagcgagagccagatggacatcaccgacatcaacacccccaagcccaagaagaagcagagatggacccccctggagatcagcctgagcgtgctggtgctgctgctgaccatcatcgccgtgaccatgatcgccctgtacgccacctacgacgacggcatctgcaagagcagcgactgcatcaagagcgccgccagactgatccagaacatggacgccaccaccgagccctgcaccgacttcttcaagtacgcctgcggcggctggctgaagagaaacgtgatccccgagaccagcagcagatacggcaacttcgacatcctgagagacgagctggaggtggtgctgaaggacgtgctgcaggagcccaagaccgaggacatcgtggccgtgcagaaggccaaggccctgtacagaagctgcatcaacgagagcgccatcgacagcagaggcggcgagcccctgctgaagctgctgcccgacatctacggctggcccgtggccaccgagaactgggagcagaagtacggcgccagctggaccgccgagaaggccatcgcccagctgaacagcaagtacggcaagaaggtgctgatcaacctgttcgtgggcaccgacgacaagaacagcgtgaaccacgtgatccacatcgaccagcccagactgggcctgcccagcagagactactacgagtgcaccggcatctacaaggaggcctgcaccgcctacgtggacttcatgatcagcgtggccagactgatcagacaggaggagagactgcccatcgacgagaaccagctggccctggagatgaacaaggtgatggagctggagaaggagatcgccaacgccaccgccaagcccgaggacagaaacgaccccatgctgctgtacaacaagatgaccctggcccagatccagaacaacttcagcctggagatcaacggcaagcccttcagctggctgaacttcaccaacgagatcatgagcaccgtgaacatcagcatcaccaacgaggaggacgtggtggtgtacgcccccgagtacctgaccaagctgaagcccatcctgaccaagtacagcgccagagacctgcagaacctgatgagctggagattcatcatggacctggtgagcagcctgagcagaacctacaaggagagcagaaacgccttcagaaaggccctgtacggcaccaccagcgagaccgccacctggagaagatgcgccaactacgtgaacggcaacatggagaacgccgtgggcagactgtacgtggaggccgccttcgccggcgagagcaagcacgtggtggaggacctgatcgcccagatcagagaggtgttcatccagaccctggacgacctgacctggatggacgccgagaccaagaagagagccgaggagaaggccctggccatcaaggagagaatcggctaccccgacgacatcgtgagcaacgacaacaagctgaacaacgagtacctggagctgaactacaaggaggacgagtacttcgagaacatcatccagaacctgaagttcagccagagcaagcagctgaagaagctgagagagaaggtggacaaggacgagtggatcagcggcgccgccgtggtgaacgccttctacagcagcggcagaaaccagatcgtgttccccgccggcatcctgcagccccccttcttcagcgcccagcagagcaacagcctgaactacggcggcatcggcatggtgatcggccacgagatcacccacggcttcgacgacaacggcagaaacttcaacaaggacggcgacctggtggactggtggacccagcagagcgccagcaacttcaaggagcagagccagtgcatggtgtaccagtacggcaacttcagctgggacctggccggcggccagcacctgaacggcatcaacaccctgggcgagaacatcgccgacaacggcggcctgggccaggcctacagagcctaccagaactacatcaagaagaacggcgaggagaagctgctgcccggcctggacctgaaccacaagcagctgttcttcctgaacttcgcccaggtgtggtgcggcacctacagacccgagtacgccgtgaacagcatcaagaccgacgtgcacagccccggcaacttcagaatcatcggcaccctgcagaacagcgccgagttcagcgaggccttccactgcagaaagaacagctacatgaaccccgagaagaagtgcagagtgtggtag

SEQ ID NO: 11435 - DNA, 2253 bp, Artificial Sequence; identical to SEQ ID NO: 11434
  Description of Artificial Sequence: Synthetic coding sequence

SEQ ID NO: 11436 - DNA, 2253 bp, Artificial Sequence; identical to SEQ ID NO: 11434
  Description of Artificial Sequence: Synthetic coding sequence

SEQ ID NO: 11437 - DNA, 486 bp, Artificial Sequence
  Description of Artificial Sequence: Synthetic coding sequence
atgggcaagagcgagagccagatggacatcaccgacatcaacacccccaagcccaagaagaagcagagatggacccccctggagatcagcctgagcgtgctggtgctgctgctgaccatcatcgccgtgaccatgatcgccctgtacgccacctacgacgacggcatctgcaagagcagcgactgcatcaagagcgccgccagactgatccagaacatggacgccaccaccgagccctgcaccgacttcttcaagtacgcctgcggcggctggctgaagagaaacgtgatccccgagaccagcagcagatacggcaacttcgacatcctgagagacgagctggaggtggtgctgaaggacgtgctgcaggagcccaagaccgaggacatcgtggccgtgcagaaggccaaggccctgtacagaagctgcatcaacgagagcgccatcgacagcagaggcggcgagcccctgctgaagctgctgtag

SEQ ID NO: 11438 - DNA, 282 bp, Artificial Sequence
  Description of Artificial Sequence: Synthetic coding sequence
atgggcaagagcgagagccagatggacatcaccgacatcaacacccccaagcccaagaagaagcagagatggacccccctggagatcagcctgagcgtgctggtgctgctgctgaccatcatcgccgtgaccatgatcgccctgtacgccacctacgacgacggcatctgcaagagcagcgactgcatcaagagcgccgccagactgatccagaacatggacgccaccaccgagccctgcaccgacttcttcaagtacgcctgcggcggctggctgaagtag

SEQ ID NO: 11439 - DNA, 702 bp, Artificial Sequence
  Description of Artificial Sequence: Synthetic coding sequence
atgggcaagagcgagagccagatggacatcaccgacatcaacacccccaagcccaagaagaagcagagatggacccccctggagatcagcctgagcgtgctggtgctgctgctgaccatcatcgccgtgaccatgatcgccctgtacgccacctacgacgacggcatctgcaagagcagcgactgcatcaagagcgccgccagactgatccagaacatggacgccaccaccgagccctgcaccgacttcttcaagtacgcctgcggcggctggctgaagagaaacgtgatccccgagaccagcagcagatacggcaacttcgacatcctgagagacgagctggaggtggtgctgaaggacgtgctgcaggagcccaagaccgaggacatcgtggccgtgcagaaggccaaggccctgtacagaagctgcatcaacgagagcgccatcgacagcagaggcggcgagcccctgctgaagctgctgcccgacatctacggctggcccgtggccaccgagaactgggagcagaagtacggcgccagctggaccgccgagaaggccatcgcccagctgaacagcaagtacggcaagaaggtgctgatcaacctgttcgtgggcaccgacgacaagaacagcgtgaaccacgtgatccacatcgaccagcccagactgggcctgcccagcagagactactacgagtag

SEQ ID NO: 11440 - DNA, 360 bp, Artificial Sequence
  Description of Artificial Sequence: Synthetic coding sequence
atgggcaagagcgagagccagatggacatcaccgacatcaacacccccaagcccaagaagaagcagagatggacccccctggagatcagcctgagcgtgctggtgctgctgctgaccatcatcgccgtgaccatgatcgccctgtacgccacctacgacgacggcatctgcaagagcagcgactgcatcaagagcgccgccagactgatccagaacatggacgccaccaccgagccctgcaccgacttcttcaagtacgcctgcggcggctggctgaagagaaacgtgatccccgagaccagcagcagatacggcaacttcgacatcctgagagacgagctggaggtggtgctgaagtag

SEQ ID NO: 11441 - DNA, 2253 bp, Artificial Sequence; identical to SEQ ID NO: 11434
  Description of Artificial Sequence: Synthetic coding sequence

SEQ ID NO: 11442 - DNA, 2253 bp, Artificial Sequence; identical to SEQ ID NO: 11434
  Description of Artificial Sequence: Synthetic coding sequence

SEQ ID NO: 11443 - DNA, 48 bp, Artificial Sequence
  Description of Artificial Sequence: Synthetic coding sequence
atgggcaagagcgagagccagatggacatcaccgacatcaacacctag

SEQ ID NO: 11444 - DNA, 894 bp, Artificial Sequence
  Description of Artificial Sequence: Synthetic coding sequence
atgaccacccccagaaacagcgtgaacggcaccttccccgccgagcccatgaagggccccatcgccatgcagagcggccccaagcccctgttcagaagaatgagcagcctggtgggccccacccagagcttcttcatgagagagagcaagaccctgggcgccgtgcagatcatgaacggcctgttccacatcgccctgggcggcctgctgatgatccccgccggcatctacgcccccatctgcgtgaccgtgtggtaccccctgtggggcggcatcatgtacatcatcagcggcagcctgctggccgccaccgagaagaacagcagaaagtgcctggtgaagggcaagatgatcatgaacagcctgagcctgttcgccgccatcagcggcatgatcctgagcatcatggacatcctgaacatcaagatcagccacttcctgaagatggagagcctgaacttcatcagagcccacaccccctacatcaacatctacaactgcgagcccgccaaccccagcgagaagaacagccccagcacccagtactgctacagcatccagagcctgttcctgggcatcctgagcgtgatgctgatcttcgccttcttccaggagctggtgatcgccggcatcgtggagaacgagtggaagagaacctgcagcagacccaagagcaacatcgtgctgctgagcgccgaggagaagaaggagcagaccatcgagatcaaggaggaggtggtgggcctgaccgagaccagcagccagcccaagaacgaggaggacatcgagatcatccccatccaggaggaggaggaggaggagaccgagaccaacttccccgagcccccccaggaccaggagagcagccccatcgagaacgacagcagcccctag

SEQ ID NO: 11445 - DNA, 894 bp, Artificial Sequence; identical to SEQ ID NO: 11444
  Description of Artificial Sequence: Synthetic coding sequence

SEQ ID NO: 11446 - DNA, 24 bp, Artificial Sequence
  Description of Artificial Sequence: Synthetic coding sequence
atgaccacccccagaaacagctag

SEQ ID NO: 11447 - DNA, 855 bp, Artificial Sequence
  Description of Artificial Sequence: Synthetic coding sequence
atgaccacccccagaaacagcgtgaacggcaccttccccgccgagcccatgaagggccccatcgccatgcagagcggccccaagcccctgttcagaagaatgagcagcctggtgggccccacccagagcttcttcatgagagagagcaagaccctgggcgccgtgcagatcatgaacggcctgttccacatcgccctgggcggcctgctgatgatccccgccggcatctacgcccccatctgcgtgaccgtgtggtaccccctgtggggcggcatcatgtacatcatcagcggcagcctgctggccgccaccgagaagaacagcagaaagtgcctggtgaagggcaagatgatcatgaacagcctgagcctgttcgccgccatcagcggcatgatcctgagcatcatggacatcctgaacatcaagatcagccacttcctgaagatggagagcctgaacttcatcagagcccacaccccctacatcaacatctacaactgcgagcccgccaaccccagcgagaagaacagccccagcacccagtactgctacagcatccagagcctgttcctggagctggtgatcgccggcatcgtggagaacgagtggaagagaacctgcagcagacccaagagcaacatcgtgctgctgagcgccgaggagaagaaggagcagaccatcgagatcaaggaggaggtggtgggcctgaccgagaccagcagccagcccaagaacgaggaggacatcgagatcatccccatccaggaggaggaggaggaggagaccgagaccaacttccccgagcccccccaggaccaggagagcagccccatcgagaacgacagcagcccctag

SEQ ID NO: 11448 - DNA, 21 bp, Artificial Sequence
  Description of Artificial Sequence: Synthetic coding sequence
atgaccacccccagaaactag

SEQ ID NO: 11449 - DNA, 894 bp, Artificial Sequence; identical to SEQ ID NO: 11444
  Description of Artificial Sequence: Synthetic coding sequence

SEQ ID NO: 11450 - DNA, 930 bp, Artificial Sequence
  Description of Artificial Sequence: Synthetic coding sequence
atggacgaccagggctgccccagatgcaagaccaccaagtacagaaaccccagcctgaagctgatggtgaacgtgtgcggccacaccctgtgcgagagctgcgtggacctgctgttcgtgagaggcgccggcaactgccccgagtgcggcacccccctgagaaagagcaacttcagagtgcagctgttcgaggaccccaccgtggacaaggaggtggagatcagaaagaaggtgctgaagatctacaacaagagagaggaggacttccccagcctgagagagtacaacgacttcctggaggaggtggaggagatcgtgttcaacctgaccaacaacgtggacctggacaacaccaagaagaagatggagatctaccagaaggagaacaaggacgtgatccagaagaacaagctgaagctgaccagagagcaggaggagctggaggaggccctggaggtggagagacaggagaacgagcagagaagactgttcatccagaaggaggagcagctgcagcagatcctgaagagaaagaacaagcaggccttcctggacgagctggagagcagcgacctgcccgtggccctgctgctggcccagcacaaggacagaagcacccagctggagatgcagctggagaagcccaagcccgtgaagcccgtgaccttcagcaccggcatcaagatgggccagcacatcagcctggcccccatccacaagctggaggaggccctgtacgagtaccagcccctgcagatcgagacctacggcccccacgtgcccgagctggagatgctgggcagactgggctacctgaaccacgtgagagccgccagcccccaggacctggccggcggctacaccagcagcctggcctgccacagagccctgcaggacgccttcagcggcctgttctggcagcccagctag

SEQ ID NO: 11451 - DNA, 804 bp, Artificial Sequence
  Description of Artificial Sequence: Synthetic coding sequence
atggacgaccagggctgccccagatgcaagaccaccaagtacagaaaccccagcctgaagctgatggtgaacgtgtgcggccacaccctgtgcgagagctgcgtggacctgctgttcgtgagaggcgccggcaactgccccgagtgcggcacccccctgagaaagagcaacttcagagtgcagctgttcgaggaccccaccgtggacaaggaggtggagatcagaaagaaggtgctgaagatctacaacaagagagaggaggacttccccagcctgagagagtacaacgacttcctggaggaggtggaggagatcgtgttcaacctgaccaacaacgtggacctggacaacaccaagaagaagatggagatctaccagaaggagaacaaggacgtgatccagaagaacaagctgaagctgaccagagagcaggaggagctggaggaggccctggaggtggagagacaggagaacgagcagagaagactgttcatccagaaggaggagcagctgcagcagatcctgaagagaaagaacaagcaggccttcctggacgagctgggccagcacatcagcctggcccccatccacaagctggaggaggccctgtacgagtaccagcccctgcagatcgagacctacggcccccacgtgcccgagctggagatgctgggcagactgggctacctgaaccacgtgagagccgccagcccccaggacctggccggcggctacaccagcagcctggcctgccacagagccctgcaggacgccttcagcggcctgttctggcagcccagctag

SEQ ID NO: 11452 - DNA, 510 bp, Artificial Sequence
  Description of Artificial Sequence: Synthetic coding sequence
accagagagcaggaggagctggaggaggccctggaggtggagagacaggagaacgagcagagaagactgttcatccagaaggaggagcagctgcagcagatcctgaagagaaagaacaagcaggccttcctggacgagctggagagcagcgacctgcccgtggccctgctgctggcccagcacaaggacagaagcacccagctggagatgcagctggagaagcccaagcccgtgaagcccgtgaccttcagcaccggcatcaagatgggccagcacatcagcctggcccccatccacaagctggaggaggccctgtacgagtaccagcccctgcagatcgagacctacggcccccacgtgcccgagctggagatgctgggcagactgggctacctgaaccacgtgagagccgccagcccccaggacctggccggcggctacaccagcagcctggcctgccacagagccctgcaggacgccttcagcggcctgttctggcagcccagctag

SEQ ID NO: 11453 - DNA, 3963 bp, Artificial Sequence
  Description of Artificial Sequence: Synthetic coding sequence
atgttcggcctggaccagttcgagccccaggtgaacagcagaaacgccggccagggcgagagaaacttcaacgagaccggcctgagcatgaacacccacttcaaggcccccgccttccacaccggcggcccccccggccccgtggaccccgccatgagcgccctgggcgagccccccatcctgggcatgaacatggagccctacggcttccacgccagaggccacagcgagctgcacgccggcggcctgcaggcccagcccgtgcacggcttcttcggcggccagcagccccaccacggccaccccggcagccaccacccccaccagcaccacccccacttcggcggcaacttcggcggccccgaccccggcgccagctgcctgcacggcggcagactgctgggctacggcggcgccgccggcggcctgggcagccagccccccttcgccgagggctacgagcacatggccgagagccagggccccgagagcttcggcccccagagacccggcaacctgcccgacttccacagcagcggcgccagcagccacgccgtgcccgccccctgcctgcccctggaccagagccccaacagagccgccagcttccacggcctgcccagcagcagcggcagcgacagccacagcctggagcccagaagagtgaccaaccagggcgccgtggacagcctggagtacaactaccccggcgaggcccccagcggccacttcgacatgttcagccccagcgacagcgagggccagctgccccactacgccgccggcagacaggtgcccggcggcgccttccccggcgccagcgccatgcccagagccgccggcatggtgggcctgagcaagatgcacgcccagcccccccagcagcagccccagcagcagcagcagccccagcagcagcagcagcagcacggcgtgttcttcgagagattcagcggcgccagaaagatgcccgtgggcctggagcccagcgtgggcagcagacaccccctgatgcagcccccccagcaggcccccccccccccccagcagcagcccccccagcagcccccccagcagcagcccccccccccccccggcctgctggtgagacagaacagctgcccccccgccctgcccagaccccagcagggcgaggccggcacccccagcggcggcctgcaggacggcggccccatgctgcccagccagcacgcccagttcgagtaccccatccacagactggagaacagaagcatgcacccctacagcgagcccgtgttcagcatgcagcacccccccccccagcaggcccccaaccagagactgcagcacttcgacgcccccccctacatgaacgtggccaagagacccagattcgacttccccggcagcgccggcgtggacagatgcgccagctggaacggcagcatgcacaacggcgccctggacaaccacctgagccccagcgcctaccccggcctgcccggcgagttcaccccccccgtgcccgacagcttccccagcggcccccccctgcagcaccccgcccccgaccaccagagcctgcagcagcagcagcagcagcagcagcagcagcagcagcagcagcagcagcagcagcagcagcagcagcagcagcagcagcagcagagacagaacgccgccctgatgatcaagcagatggccagcagaaaccagcagcagagactgagacagcccaacctggcccagctgggccaccccggcgacgtgggccagggcggcctggtgcacggcggccccgtgggcggcctggcccagcccaacttcgagagagagggcggcagcaccggcgccggcagactgggcaccttcgagcagcaggccccccacctggcccaggagagcgcctggttcagcggcccccaccccccccccggcgacctgctgcccagaagaatgggcggcagcggcctgcccgccgactgcggcccccacgaccccagcctggcccccccccccccccccggcggcagcggcgtgctgttcagaggccccctgcaggagcccatgagaatgcccggcgagggccacgtgcccgccctgcccagccccggcctgcagttcggcggcagcctgggcggcctgggccagctgcagagccccggcgccggcgtgggcctgcccagcgccgccagcgagagaagaccccccccccccgacttcgccaccagcgccctgggcggccagcccggcttccccttcggcgccgccggcagacagagcaccccccacagcggccccggcgtgaacagcccccccagcgccggcggcggcggcggcagcagcggcggcggcggcggcggcggcgcctaccccccccagcccgacttccagcccagccagagaaccagcgccagcaagctgggcgccctgagcctgggcagcttcaacaagcccagcagcaaggacaacctgttcggccagagctgcctggccgccctgagcaccgcctgccagaacatgatcgccagcctgggcgcccccaacctgaacgtgaccttcaacaagaagaacccccccgagggcaagagaaagctgagccagaacgagaccgacggcgccgccgtggccggcaaccccggcagcgactacttccccggcggcaccgcccccggcgcccccggccccggcggccccagcggcaccagcagcagcggcagcaaggccagcggcccccccaacccccccgcccagggcgacggcaccagcctgagccccaactacaccctggagagcaccagcggcaacgacggcaagcccgtgagcggcggcggcggcagaggcagaggcagaagaaagagagacagcggccacgtgagccccggcaccttcttcgacaagtacagcgccgcccccgacagcggcggcgcccccggcgtgagccccggccagcagcaggccagcggcgccgccgtgggcggcagcagcgccggcgagaccagaggcgcccccaccccccacgagaaggccctgaccagccccagctggggcaagggcgccgagctgctgctgggcgaccagcccgacctgatcggcagcctggacggcggcgccaagagcgacagcagcagccccaacgtgggcgagttcgccagcgacgaggtgagcaccagctacgccaacgaggacgaggtgagcagcagcagcgacaacccccaggccctggtgaaggccagcagaagccccctggtgaccggcagccccaagctgccccccagaggcgtgggcgccggcgagcacggccccaaggcccccccccccgccctgggcctgggcatcatgagcaacagcaccagcacccccgacagctacggcggcggcggcggccccggccaccccggcacccccggcctggagcaggtgagaacccccaccagcagcagcggcgcccccccccccgacgagatccaccccctggagatcctgcaggcccagatccagctgcagagacagcagttcagcatcagcgaggaccagcccctgggcctgaagggcggcaagaagggcgagtgcgccgtgggcgccagcggcgcccagaacggcgacagcgagctgggcagctgctgcagcgaggccgtgaagagcgccatgagcaccatcgacctggacagcctgatggccgagcacagcgccgcctggtacatgcccgccgacaaggccctggtggacagcgccgacgacgacaagaccctggccccctgggagaaggccaagccccagaaccccaacagcaaggaggcccacgacctgcccgccaacaaggccagcgccagccagcccggcagccacctgcagtgcctgagcgtgcactgcaccgacgacgtgggcgacgccaaggccagagccagcgtgcccacctggagaagcctgcacagcgacatcagcaacagattcggcaccttcgtggccgccctgacctag

SEQ ID NO: 11454 - DNA, 4227 bp, Artificial Sequence
  Description of Artificial Sequence: Synthetic coding sequence
atgaaggcccccgccgtgctggcccccggcatcctggtgctgctgttcaccctggtgcagagaagcaacggcgagtgcaaggaggccctggccaagagcgagatgaacgtgaacatgaagtaccagctgcccaacttcaccgccgagacccccatccagaacgtgatcctgcacgagcaccacatcttcctgggcgccaccaactacatctacgtgctgaacgaggaggacctgcagaaggtggccgagtacaagaccggccccgtgctggagcaccccgactgcttcccctgccaggactgcagcagcaaggccaacctgagcggcggcgtgtggaaggacaacatcaacatggccctggtggtggacacctactacgacgaccagctgatcagctgcggcagcgtgaacagaggcacctgccagagacacgtgttcccccacaaccacaccgccgacatccagagcgaggtgcactgcatcttcagcccccagatcgaggagcccagccagtgccccgactgcgtggtgagcgccctgggcgccaaggtgctgagcagcgtgaaggacagattcatcaacttcttcgtgggcaacaccatcaacagcagctacttccccgaccaccccctgcacagcatcagcgtgagaagactgaaggagaccaaggacggcttcatgttcctgaccgaccagagctacatcgacgtgctgcccgagttcagagacagctaccccatcaagtacgtgcacgccttcgagagcaacaacttcatctacttcctgaccgtgcagagagagaccctggacgcccagaccttccacaccagaatcatcagattctgcagcatcaacagcggcctgcacagctacatggagatgcccctggagtgcatcctgaccgagaagagaaagaagagaagcaccaagaaggaggtgttcaacatcctgcaggccgcctacgtgagcaagcccggcgcccagctggccagacagatcggcgccagcctgaacgacgacatcctgttcggcgtgttcgcccagagcaagcccgacagcgccgagcccatggacagaagcgccatgtgcgccttccccatcaagtacgtgaacgacttcttcaacaagatcgtgaacaagaacaacgtgagatgcctgcagcacttctacggccccaaccacgagcactgcttcaacagaaccctgctgagaaacagcagcggctgcgaggccagaagagacgagtacagaaccgagttcaccaccgccctgcagagagtggacctgttcatgggccagttcagcgaggtgctgctgaccagcatcagcaccttcatcaagggcgacctgaccatcgccaacctgggcaccagcgagggcagattcatgcaggtggtggtgagcagaagcggccccagcaccccccacgtgaacttcctgctggacagccaccccgtgagccccgaggtgatcgtggagcacaccctgaaccagaacggctacaccctggtgatcaccggcaagaagatcaccaagatccccctgaacggcctgggctgcagacacttccagagctgcagccagtgcctgagcgccccccccttcgtgcagtgcggctggtgccacgacaagtgcgtgagaagcgaggagtgcctgagcggcacctggacccagcagatctgcctgcccgccatctacaaggtgttccccaacagcgcccccctggagggcggcaccagactgaccatctgcggctgggacttcggcttcagaagaaacaacaagttcgacctgaagaagaccagagtgctgctgggcaacgagagctgcaccctgaccctgagcgagagcaccatgaacaccctgaagtgcaccgtgggccccgccatgaacaagcacttcaacatgagcatcatcatcagcaacggccacggcaccacccagtacagcaccttcagctacgtggaccccgtgatcaccagcatcagccccaagtacggccccatggccggcggcaccctgctgaccctgaccggcaactacctgaacagcggcaacagcagacacatcagcatcggcggcaagacctgcaccctgaagagcgtgagcaacagcatcctggagtgctacacccccgcccagaccatcagcaccgagttcgccgtgaagctgaagatcgacctggccaacagagagaccagcatcttcagctacagagaggaccccatcgtgtacgagatccaccccaccaagagcttcatcagcacctggtggaaggagcccctgaacatcgtgagcttcctgttctgcttcgccagcggcggcagcaccatcaccggcgtgggcaagaacctgaacagcgtgagcgtgcccagaatggtgatcaacgtgcacgaggccggcagaaacttcaccgtggcctgccagcacagaagcaacagcgagatcatctgctgcaccacccccagcctgcagcagctgaacctgcagctgcccctgaagaccaaggccttcttcatgctggacggcatcctgagcaagtacttcgacctgatctacgtgcacaaccccgtgttcaagcccttcgagaagcccgtgatgatcagcatgggcaacgagaacgtgctggagatcaagggcaacgacatcgaccccgaggccgtgaagggcgaggtgctgaaggtgggcaacaagagctgcgagaacatccacctgcacagcgaggccgtgctgtgcaccgtgcccaacgacctgctgaagctgaacagcgagctgaacatcgagtggaagcaggccatcagcagcaccgtgctgggcaaggtgatcgtgcagcccgaccagaacttcaccggcctgatcgccggcgtggtgagcatcagcaccgccctgctgctgctgctgggcttcttcctgtggctgaagaagagaaagcagatcaaggacctgggcagcgagctggtgagatacgacgccagagtgcacaccccccacctggacagactggtgagcgccagaagcgtgagccccaccaccgagatggtgagcaacgagagcgtggactacagagccaccttccccgaggaccagttccccaacagcagccagaacggcagctgcagacaggtgcagtaccccctgaccgacatgagccccatcctgaccagcggcgacagcgacatcagcagccccctgctgcagaacaccgtgcacatcgacctgagcgccctgaaccccgagctggtgcaggccgtgcagcacgtggtgatcggccccagcagcctgatcgtgcacttcaacgaggtgatcggcagaggccacttcggctgcgtgtaccacggcaccctgctggacaacgacggcaagaagatccactgcgccgtgaagagcctgaacagaatcaccgacatcggcgaggtgagccagttcctgaccgagggcatcatcatgaaggacttcagccaccccaacgtgctgagcctgctgggcatctgcctgagaagcgagggcagccccctggtggtgctgccctacatgaagcacggcgacctgagaaacttcatcagaaacgagacccacaaccccaccgtgaaggacctgatcggcttcggcctgcaggtggccaagggcatgaagtacctggccagcaagaagttcgtgcacagagacctggccgccagaaactgcatgctggacgagaagttcaccgtgaaggtggccgacttcggcctggccagagacatgtacgacaaggagtactacagcgtgcacaacaagaccggcgccaagctgcccgtgaagtggatggccctggagagcctgcagacccagaagttcaccaccaagagcgacgtgtggagcttcggcgtgctgctgtgggagctgatgaccagaggcgcccccccctaccccgacgtgaacaccttcgacatcaccgtgtacctgctgcagggcagaagactgctgcagcccgagtactgccccgaccccctgtacgaggtgatgctgaagtgctggcaccccaaggccgagatgagacccagcttcagcgagctggtgagcagaatcagcgccatcttcagcaccttcatcggcgagcactacgtgcacgtgaacgccacctacgtgaacgtgaagtgcgtggccccctaccccagcctgctgagcagcgaggacaacgccgacgacgaggtggacaccagacccgccagcttctgggagaccagctag

SEQ ID NO: 11455 - DNA, 4173 bp, Artificial Sequence
  Description of Artificial Sequence: Synthetic coding sequence
atgaaggcccccgccgtgctggcccccggcatcctggtgctgctgttcaccctggtgcagagaagcaacggcgagtgcaaggaggccctggccaagagcgagatgaacgtgaacatgaagtaccagctgcccaacttcaccgccgagacccccatccagaacgtgatcctgcacgagcaccacatcttcctgggcgccaccaactacatctacgtgctgaacgaggaggacctgcagaaggtggccgagtacaagaccggccccgtgctggagcaccccgactgcttcccctgccaggactgcagcagcaaggccaacctgagcggcggcgtgtggaaggacaacatcaacatggccctggtggtggacacctactacgacgaccagctgatcagctgcggcagcgtgaacagaggcacctgccagagacacgtgttcccccacaaccacaccgccgacatccagagcgaggtgcactgcatcttcagcccccagatcgaggagcccagccagtgccccgactgcgtggtgagcgccctgggcgccaaggtgctgagcagcgtgaaggacagattcatcaacttcttcgtgggcaacaccatcaacagcagctacttccccgaccaccccctgcacagcatcagcgtgagaagactgaaggagaccaaggacggcttcatgttcctgaccgaccagagctacatcgacgtgctgcccgagttcagagacagctaccccatcaagtacgtgcacgccttcgagagcaacaacttcatctacttcctgaccgtgcagagagagaccctggacgcccagaccttccacaccagaatcatcagattctgcagcatcaacagcggcctgcacagctacatggagatgcccctggagtgcatcctgaccgagaagagaaagaagagaagcaccaagaaggaggtgttcaacatcctgcaggccgcctacgtgagcaagcccggcgcccagctggccagacagatcggcgccagcctgaacgacgacatcctgttcggcgtgttcgcccagagcaagcccgacagcgccgagcccatggacagaagcgccatgtgcgccttccccatcaagtacgtgaacgacttcttcaacaagatcgtgaacaagaacaacgtgagatgcctgcagcacttctacggccccaaccacgagcactgcttcaacagaaccctgctgagaaacagcagcggctgcgaggccagaagagacgagtacagaaccgagttcaccaccgccctgcagagagtggacctgttcatgggccagttcagcgaggtgctgctgaccagcatcagcaccttcatcaagggcgacctgaccatcgccaacctgggcaccagcgagggcagattcatgcaggtggtggtgagcagaagcggccccagcaccccccacgtgaacttcctgctggacagccaccccgtgagccccgaggtgatcgtggagcacaccctgaaccagaacggctacaccctggtgatcaccggcaagaagatcaccaagatccccctgaacggcctgggctgcagacacttccagagctgcagccagtgcctgagcgccccccccttcgtgcagtgcggctggtgccacgacaagtgcgtgagaagcgaggagtgcctgagcggcacctggacccagcagatctgcctgcccgccatctacaaggtgttccccaacagcgcccccctggagggcggcaccagactgaccatctgcggctgggacttcggcttcagaagaaacaacaagttcgacctgaagaagaccagagtgctgctgggcaacgagagctgcaccctgaccctgagcgagagcaccatgaacaccctgaagtgcaccgtgggccccgccatgaacaagcacttcaacatgagcatcatcatcagcaacggccacggcaccacccagtacagcaccttcagctacgtggaccccgtgatcaccagcatcagccccaagtacggccccatggccggcggcaccctgctgaccctgaccggcaactacctgaacagcggcaacagcagacacatcagcatcggcggcaagacctgcaccctgaagagcgtgagcaacagcatcctggagtgctacacccccgcccagaccatcagcaccgagttcgccgtgaagctgaagatcgacctggccaacagagagaccagcatcttcagctacagagaggaccccatcgtgtacgagatccaccccaccaagagcttcatcagcggcggcagcaccatcaccggcgtgggcaagaacctgaacagcgtgagcgtgcccagaatggtgatcaacgtgcacgaggccggcagaaacttcaccgtggcctgccagcacagaagcaacagcgagatcatctgctgcaccacccccagcctgcagcagctgaacctgcagctgcccctgaagaccaaggccttcttcatgctggacggcatcctgagcaagtacttcgacctgatctacgtgcacaaccccgtgttcaagcccttcgagaagcccgtgatgatcagcatgggcaacgagaacgtgctggagatcaagggcaacgacatcgaccccgaggccgtgaagggcgaggtgctgaaggtgggcaacaagagctgcgagaacatccacctgcacagcgaggccgtgctgtgcaccgtgcccaacgacctgctgaagctgaacagcgagctgaacatcgagtggaagcaggccatcagcagcaccgtgctgggcaaggtgatcgtgcagcccgaccagaacttcaccggcctgatcgccggcgtggtgagcatcagcaccgccctgctgctgctgctgggcttcttcctgtggctgaagaagagaaagcagatcaaggacctgggcagcgagctggtgagatacgacgccagagtgcacaccccccacctggacagactggtgagcgccagaagcgtgagccccaccaccgagatggtgagcaacgagagcgtggactacagagccaccttccccgaggaccagttccccaacagcagccagaacggcagctgcagacaggtgcagtaccccctgaccgacatgagccccatcctgaccagcggcgacagcgacatcagcagccccctgctgcagaacaccgtgcacatcgacctgagcgccctgaaccccgagctggtgcaggccgtgcagcacgtggtgatcggccccagcagcctgatcgtgcacttcaacgaggtgatcggcagaggccacttcggctgcgtgtaccacggcaccctgctggacaacgacggcaagaagatccactgcgccgtgaagagcctgaacagaatcaccgacatcggcgaggtgagccagttcctgaccgagggcatcatcatgaaggacttcagccaccccaacgtgctgagcctgctgggcatctgcctgagaagcgagggcagccccctggtggtgctgccctacatgaagcacggcgacctgagaaacttcatcagaaacgagacccacaaccccaccgtgaaggacctgatcggcttcggcctgcaggtggccaagggcatgaagtacctggccagcaagaagttcgtgcacagagacctggccgccagaaactgcatgctggacgagaagttcaccgtgaaggtggccgacttcggcctggccagagacatgtacgacaaggagtactacagcgtgcacaacaagaccggcgccaagctgcccgtgaagtggatggccctggagagcctgcagacccagaagttcaccaccaagagcgacgtgtggagcttcggcgtgctgctgtgggagctgatgaccagaggcgcccccccctaccccgacgtgaacaccttcgacatcaccgtgtacctgctgcagggcagaagactgctgcagcccgagtactgccccgaccccctgtacgaggtgatgctgaagtgctggcaccccaaggccgagatgagacccagcttcagcgagctggtgagcagaatcagcgccatcttcagcaccttcatcggcgagcactacgtgcacgtgaacgccacctacgtgaacgtgaagtgcgtggccccctaccccagcctgctgagcagcgaggacaacgccgacgacgaggtggacaccagacccgccagcttctgggagaccagctag

SEQ ID NO: 11456 - DNA, 2295 bp, Artificial Sequence
  Description of Artificial Sequence: Synthetic coding sequence
atgaaggcccccgccgtgctggcccccggcatcctggtgctgctgttcaccctggtgcagagaagcaacggcgagtgcaaggaggccctggccaagagcgagatgaacgtgaacatgaagtaccagctgcccaacttcaccgccgagacccccatccagaacgtgatcctgcacgagcaccacatcttcctgggcgccaccaactacatctacgtgctgaacgaggaggacctgcagaaggtggccgagtacaagaccggccccgtgctggagcaccccgactgcttcccctgccaggactgcagcagcaaggccaacctgagcggcggcgtgtggaaggacaacatcaacatggccctggtggtggacacctactacgacgaccagctgatcagctgcggcagcgtgaacagaggcacctgccagagacacgtgttcccccacaaccacaccgccgacatccagagcgaggtgcactgcatcttcagcccccagatcgaggagcccagccagtgccccgactgcgtggtgagcgccctgggcgccaaggtgctgagcagcgtgaaggacagattcatcaacttcttcgtgggcaacaccatcaacagcagctacttccccgaccaccccctgcacagcatcagcgtgagaagactgaaggagaccaaggacggcttcatgttcctgaccgaccagagctacatcgacgtgctgcccgagttcagagacagctaccccatcaagtacgtgcacgccttcgagagcaacaacttcatctacttcctgaccgtgcagagagagaccctggacgcccagaccttccacaccagaatcatcagattctgcagcatcaacagcggcctgcacagctacatggagatgcccctggagtgcatcctgaccgagaagagaaagaagagaagcaccaagaaggaggtgttcaacatcctgcaggccgcctacgtgagcaagcccggcgcccagctggccagacagatcggcgccagcctgaacgacgacatcctgttcggcgtgttcgcccagagcaagcccgacagcgccgagcccatggacagaagcgccatgtgcgccttccccatcaagtacgtgaacgacttcttcaacaagatcgtgaacaagaacaacgtgagatgcctgcagcacttctacggccccaaccacgagcactgcttcaacagaaccctgctgagaaacagcagcggctgcgaggccagaagagacgagtacagaaccgagttcaccaccgccctgcagagagtggacctgttcatgggccagttcagcgaggtgctgctgaccagcatcagcaccttcatcaagggcgacctgaccatcgccaacctgggcaccagcgagggcagattcatgcaggtggtggtgagcagaagcggccccagcaccccccacgtgaacttcctgctggacagccaccccgtgagccccgaggtgatcgtggagcacaccctgaaccagaacggctacaccctggtgatcaccggcaagaagatcaccaagatccccctgaacggcctgggctgcagacacttccagagctgcagccagtgcctgagcgccccccccttcgtgcagtgcggctggtgccacgacaagtgcgtgagaagcgaggagtgcctgagcggcacctggacccagcagatctgcctgcccgccatctacaaggtgttccccaacagcgcccccctggagggcggcaccagactgaccatctgcggctgggacttcggcttcagaagaaacaacaagttcgacctgaagaagaccagagtgctgctgggcaacgagagctgcaccctgaccctgagcgagagcaccatgaacaccctgaagtgcaccgtgggccccgccatgaacaagcacttcaacatgagcatcatcatcagcaacggccacggcaccacccagtacagcaccttcagctacgtggaccccgtgatcaccagcatcagccccaagtacggccccatggccggcggcaccctgctgaccctgaccggcaactacctgaacagcggcaacagcagacacatcagcatcggcggcaagacctgcaccctgaagagcgtgagcaacagcatcctggagtgctacacccccgcccagaccatcagcaccgagttcgccgtgaagctgaagatcgacctggccaacagagagaccagcatcttcagctacagagaggaccccatcgtgtacgagatccaccccaccaagagcttcatcagacacgtgaacatcgccctgatccagagatag

SEQ ID NO: 11457 - DNA, 783 bp, Artificial Sequence
  Description of Artificial Sequence: Synthetic coding sequence
atgaaggacttcagccaccccaacgtgctgagcctgctgggcatctgcctgagaagcgagggcagccccctggtggtgctgccctacatgaagcacggcgacctgagaaacttcatcagaaacgagacccacaaccccaccgtgaaggacctgatcggcttcggcctgcaggtggccaagggcatgaagtacctggccagcaagaagttcgtgcacagagacctggccgccagaaactgcatgctggacgagaagttcaccgtgaaggtggccgacttcggcctggccagagacatgtacgacaaggagtactacagcgtgcacaacaagaccggcgccaagctgcccgtgaagtggatggccctggagagcctgcagacccagaagttcaccaccaagagcgacgtgtggagcttcggcgtgctgctgtgggagctgatgaccagaggcgcccccccctaccccgacgtgaacaccttcgacatcaccgtgtacctgctgcagggcagaagactgctgcagcccgagtactgccccgaccccctgtacgaggtgatgctgaagtgctggcaccccaaggccgagatgagacccagcttcagcgagctggtgagcagaatcagcgccatcttcagcaccttcatcggcgagcactacgtgcacgtgaacgccacctacgtgaacgtgaagtgcgtggccccctaccccagcctgctgagcagcgaggacaacgccgacgacgaggtggacaccagacccgccagcttctgggagaccagctag

SEQ ID NO: 11458 - DNA, 1749 bp, Artificial Sequence
  Description of Artificial Sequence: Synthetic coding sequence
atggccgccagaagctggcaggacgagctggcccagcaggccgaggagggcagcgccagactgagagagatgctgagcgtgggcctgggcttcctgagaaccgagctgggcctggacctgggcctggagcccaagagataccccggctgggtgatcctggtgggcaccggcgccctgggcctgctgctgctgttcctgctgggctacggctgggccgccgcctgcgccggcgccagaaagaagagaagaagcccccccagaaagagagaggaggccgccgccgtgcccgccgccgcccccgacgacctggccctgctgaagaacctgagaagcgaggagcagaagaagaagaacagaaagaagctgagcgagaagcccaagcccaacggcagaaccgtggaggtggccgagggcgaggccgtgagaaccccccagagcgtgaccgccaagcagccccccgagatcgacaagaagaacgagaagagcaagaagaacaagaagaagagcaagagcgacgccaaggccgtgcagaacagcagcagacacgacggcaaggaggtggacgagggcgcctgggagaccaagatcagccacagagagaagagacagcagagaaagagagacaaggtgctgaccgacagcggcagcctggacagcaccatccccggcatcgagaacaccatcaccgtgaccaccgagcagctgaccaccgccagcttccccgtgggcagcaagaagaacaagggcgacagccacctgaacgtgcaggtgagcaacttcaagagcggcaagggcgacagcaccctgcaggtgagcagcggcctgaacgagaacctgaccgtgaacggcggcggctggaacgagaagagcgtgaagctgagcagccagatcagcgccggcgaggagaagtggaacagcgtgagccccgccagcgccggcaagagaaagaccgagcccagcgcctggagccaggacaccggcgacgccaacaccaacggcaaggactggggcagaagctggagcgacagaagcatcttcagcggcatcggcagcaccgccgagcccgtgagccagagcaccaccagcgactaccagtgggacgtgagcagaaaccagccctacatcgacgacgagtggagcggcctgaacggcctgagcagcgccgaccccaacagcgactggaacgcccccgccgaggagtggggcaactgggtggacgaggagagagccagcctgctgaagagccaggagcccatccccgacgaccagaaggtgagcgacgacgacaaggagaagggcgagggcgccctgcccaccggcaagagcaagaagaagaagaagaagaagaagaagcagggcgaggacaacagcaccgcccaggacaccgaggagctggagaaggagatcagagaggacctgcccgtgaacaccagcaagaccagacccaagcaggagaaggccttcagcctgaagaccatcagcaccagcgaccccgccgaggtgctggtgaagaacagccagcccatcaagaccctgccccccgccaccagcaccgagcccagcgtgatcctgagcaagagcgacagcgacaagagcagcagccaggtgccccccatcctgcaggagaccgacaagagcaagagcaacaccaagcagaacagcgtgccccccagccagaccaagagcgagaccagctgggagagccccaagcagatcaagaagaagaagaaggccagaagagagacctag

SEQ ID NO: 11459 - DNA, 2148 bp, Artificial Sequence
  Description of Artificial Sequence: Synthetic coding sequence
atggccgccaacatgtacagagtgggcgactacgtgtacttcgagaacagcagcagcaacccctacctgatcagaagaatcgaggagctgaacaagaccgccaacggcaacgtggaggccaaggtggtgtgcttctacagaagaagagacatcagcagcaccctgatcgccctggccgacaagcacgccaccctgagcgtgtgctacaaggccggccccggcgccgacaacggcgaggagggcgagatcgaggaggagatggagaaccccgagatggtggacctgcccgagaagctgaagcaccagctgagacacagagagctgttcctgagcagacagctggagagcctgcccgccacccacatcagaggcaagtgcagcgtgaccctgctgaacgagaccgagagcctgaagagctacctggagagagaggacttcttcttctacagcctggtgtacgacccccagcagaagaccctgctggccgacaagggcgagatcagagtgggcaacagataccaggccgacatcaccgacctgctgaaggagggcgaggaggacggcagagaccagagcagactggagacccaggtgtgggaggcccacaaccccctgaccgacaagcagatcgaccagttcctggtggtggccagaagcgtgggcaccttcgccagagccctggactgcagcagcagcgtgagacagcccagcctgcacatgagcgccgccgccgccagcagagacatcaccctgttccacgccatggacaccctgcacaagaacatctacgacatcagcaaggccatcagcgccctggtgccccagggcggccccgtgctgtgcagagacgagatggaggagtggagcgccagcgaggccaacctgttcgaggaggccctggagaagtacggcaaggacttcaccgacatccagcaggacttcctgccctggaagagcctgaccagcatcatcgagtactactacatgtggaagaccaccgacagatacgtgcagcagaagagactgaaggccgccgaggccgagagcaagctgaagcaggtgtacatccccaactacaacaagcccaaccccaaccagatcagcgtgaacaacgtgaaggccggcgtggtgaacggcaccggcgcccccggccagagccccggcgccggcagagcctgcgagagctgctacaccacccagagctaccagtggtacagctggggcccccccaacatgcagtgcagactgtgcgccagctgctggacctactggaagaagtacggcggcctgaagatgcccaccagactggacggcgagagacccggccccaacagaagcaacatgagcccccacggcctgcccgccagaagcagcggcagccccaagttcgccatgaagaccagacaggccttctacctgcacaccaccaagctgaccagaatcgccagaagactgtgcagagagatcctgagaccctggcacgccgccagacacccctacctgcccatcaacagcgccgccatcaaggccgagtgcaccgccagactgcccgaggccagccagagccccctggtgctgaagcaggccgtgagaaagcccctggaggccgtgctgagatacctggagacccaccccagaccccccaagcccgaccccgtgaagagcgtgagcagcgtgctgagcagcctgacccccgccaaggtggcccccgtgatcaacaacggcagccccaccatcctgggcaagagaagctacgagcagcacaacggcgtggacggcaacatgaagaagagactgctgatgcccagcagaggcctggccaaccacggccaggccagacacatgggccccagcagaaacctgctgctgaacggcaagagctaccccaccaaggtgagactgatcagaggcggcagcctgccccccgtgaagagaagaagaatgaactggatcgacgcccccgacgacgtgttctacatggccaccgaggagaccagaaagatcagaaagctgctgagcagcagcgagaccaagagagccgccagaagaccctacaagcccatcgccctgagacagagccaggccctgccccccagaccccccccccccgcccccgtgaacgacgagcccatcgtgatcgaggactag

SEQ ID NO: 11460 - DNA, 1887 bp, Artificial Sequence
  Description of Artificial Sequence: Synthetic coding sequence
atggtggacctgcccgagaagctgaagcaccagctgagacacagagagctgttcctgagcagacagctggagagcctgcccgccacccacatcagaggcaagtgcagcgtgaccctgctgaacgagaccgagagcctgaagagctacctggagagagaggacttcttcttctacagcctggtgtacgacccccagcagaagaccctgctggccgacaagggcgagatcagagtgggcaacagataccaggccgacatcaccgacctgctgaaggagggcgaggaggacggcagagaccagagcagactggagacccaggtgtgggaggcccacaaccccctgaccgacaagcagatcgaccagttcctggtggtggccagaagcgtgggcaccttcgccagagccctggactgcagcagcagcgtgagacagcccagcctgcacatgagcgccgccgccgccagcagagacatcaccctgttccacgccatggacaccctgcacaagaacatctacgacatcagcaaggccatcagcgccctggtgccccagggcggccccgtgctgtgcagagacgagatggaggagtggagcgccagcgaggccaacctgttcgaggaggccctggagaagtacggcaaggacttcaccgacatccagcaggacttcctgccctggaagagcctgaccagcatcatcgagtactactacatgtggaagaccaccgacagatacgtgcagcagaagagactgaaggccgccgaggccgagagcaagctgaagcaggtgtacatccccaactacaacaagcccaaccccaaccagatcagcgtgaacaacgtgaaggccggcgtggtgaacggcaccggcgcccccggccagagccccggcgccggcagagcctgcgagagctgctacaccacccagagctaccagtggtacagctggggcccccccaacatgcagtgcagactgtgcgccagctgctggacctactggaagaagtacggcggcctgaagatgcccaccagactggacggcgagagacccggccccaacagaagcaacatgagcccccacggcctgcccgccagaagcagcggcagccccaagttcgccatgaagaccagacaggccttctacctgcacaccaccaagctgaccagaatcgccagaagactgtgcagagagatcctgagaccctggcacgccgccagacacccctacctgcccatcaacagcgccgccatcaaggccgagtgcaccgccagactgcccgaggccagccagagccccctggtgctgaagcaggccgtgagaaagcccctggaggccgtgctgagatacctggagacccaccccagaccccccaagcccgaccccgtgaagagcgtgagcagcgtgctgagcagcctgacccccgccaaggtggcccccgtgatcaacaacggcagccccaccatcctgggcaagagaagctacgagcagcacaacggcgtggacggcaacatgaagaagagactgctgatgcccagcagaggcaccagcagcggcctggccaaccacggccaggccagacacatgggccccagcagaaacctgctgctgaacggcaagagctaccccaccaaggtgagactgatcagaggcggcagcctgccccccgtgaagagaagaagaatgaactggatcgacgcccccgacgacgtgttctacatggccaccgaggagaccagaaagatcagaaagctgctgagcagcagcgagaccaagagagccgccagaagaccctacaagcccatcgccctgagacagagccaggccctgccccccagaccccccccccccgcccccgtgaacgacgagcccatcgtgatcgaggactag

SEQ ID NO: 11461 - DNA, 768 bp, Artificial Sequence
  Description of Artificial Sequence: Synthetic coding sequence
atgaagaccagacaggccttctacctgcacaccaccaagctgaccagaatcgccagaagactgtgcagagagatcctgagaccctggcacgccgccagacacccctacctgcccatcaacagcgccgccatcaaggccgagtgcaccgccagactgcccgaggccagccagagccccctggtgctgaagcaggccgtgagaaagcccctggaggccgtgctgagatacctggagacccaccccagaccccccaagcccgaccccgtgaagagcgtgagcagcgtgctgagcagcctgacccccgccaaggtggcccccgtgatcaacaacggcagccccaccatcctgggcaagagaagctacgagcagcacaacggcgtggacggcaacatgaagaagagactgctgatgcccagcagaggcacctacctgggcctggccaaccacggccaggccagacacatgggccccagcagaaacctgctgctgaacggcaagagctaccccaccaaggtgagactgatcagaggcggcagcctgccccccgtgaagagaagaagaatgaactggatcgacgcccccgacgacgtgttctacatggccaccgaggagaccagaaagatcagaaagctgctgagcagcagcgagaccaagagagccgccagaagaccctacaagcccatcgccctgagacagagccaggccctgccccccagaccccccccccccgcccccgtgaacgacgagcccatcgtgatcgaggactag

SEQ ID NO: 11462 - DNA, 1293 bp, Artificial Sequence
  Description of Artificial Sequence: Synthetic coding sequence
atggccgccaacatgtacagagtgggcgactacgtgtacttcgagaacagcagcagcaacccctacctgatcagaagaatcgaggagctgaacaagaccgccaacggcaacgtggaggccaaggtggtgtgcttctacagaagaagagacatcagcagcaccctgatcgccctggccgacaagcacgccaccctgagcgtgtgctacaaggccggccccggcgccgacaacggcgaggagggcgagatcgaggaggagatggagaaccccgagatggtggacctgcccgagaagctgaagcaccagctgagacacagagagctgttcctgagcagacagctggagagcctgcccgccacccacatcagaggcaagtgcagcgtgaccctgctgaacgagaccgagagcctgaagagctacctggagagagaggacttcttcttctacagcctggtgtacgacccccagcagaagaccctgctggccgacaagggcgagatcagagtgggcaacagataccaggccgacatcaccgacctgctgaaggagggcgaggaggacggcagagaccagagcagactggagacccaggtgtgggaggcccacaaccccctgaccgacaagcagatcgaccagttcctggtggtggccagaagcgtgggcaccttcgccagagccctggactgcagcagcagcgtgagacagcccagcctgcacatgagcgccgccgccgccagcagagacatcaccctgttccacgccatggacaccctgcacaagaacatctacgacatcagcaaggccatcagcgccctggtgccccagggcggccccgtgctgtgcagagacgagatggaggagtggagcgccagcgaggccaacctgttcgaggaggccctggagaagtacggcaaggacttcaccgacatccagcaggacttcctgccctggaagagcctgaccagcatcatcgagtactactacatgtggaagaccaccgacagatacgtgcagcagaagagactgaaggccgccgaggccgagagcaagctgaagcaggtgtacatccccaactacaacaagcccaaccccaaccagatcagcgtgaacaacgtgaaggccggcgtggtgaacggcaccggcgcccccggccagagccccggcgccggcagagcctgcgagagctgctacatgagcagcctgagaatcctgctggacatcctggaggagatctggtggctggagaacgccaaccccgtgagatggagagaggccagaaccaagccccagtag

SEQ ID NO: 11463 - DNA, 1422 bp, Artificial Sequence
  Description of Artificial Sequence: Synthetic coding sequence
atgctgagacccgtgatcgaggaggagatcagcatgctgggcgagatcacccacctgcagaccatcagcgaggacctgaagagcctgaccatggacccccacaagctgcccagcagcagcgagcaggtgatcctggacctgaagggcagcgactacagctggagctaccagaccccccccagcagccccagcaccaccatgagcagaaagagcagcgtgtgcagcagcctgaacagcgtgaacagcagcgacagcagaagcagcggcagccacagccacagccccagcagccactacagatacagaagcagcaacctggcccagcaggcccccgtgagactgagcagcgtgagcagccacgacagcggcttcatcagccaggacgccttccagagcaagagccccagccccatgccccccgaggcccccaaccagagaagaaaggagaagagagagcccgaccccaacggcggcggccccaccaccgccagcggcccccccgccgccgccgaggaggcccagagacccagaagcatgaccgtgagcgccgccaccagacccggcgaggagatggaggcctgcgaggagctggccctggccctgagcagaggcctgcagctggacacccagagaagcagcagagacagcctgcagtgcagcagcggctacagcacccagaccaccaccccctgctgcagcgaggacaccatccccagccaggtgagcgactacgactacttcagcgtgagcggcgaccaggaggccgaccagcaggagttcgacaagagcagcaccatccccagaaacagcgacatcagccagagctacagaagaatgttccaggccaagagacccgccagcaccgccggcctgcccaccaccctgggccccgccatggtgacccccggcgtggccaccatcagaagaacccccagcaccaagcccagcgtgagaagaggcaccatcggcgccggccccatccccatcaagacccccgtgatccccgtgaagacccccaccgtgcccgacctgcccggcgtgctgcccgccccccccgacggccccgaggagagaggcgagcacagccccgagagccccagcgtgggcgagggcccccagggcgtgaccagcatgcccagcagcatgtggagcggccaggccagcgtgaacccccccctgcccggccccaagcccagcatccccgaggagcacagacaggccatccccgagagcgaggccgaggaccaggagagagagccccccagcgccaccgtgagccccggccagatccccgagagcgaccccgccgacctgagccccagagacaccccccagggcgaggacatgctgaacgccatcagaagaggcgtgaagctgaagaagaccaccaccaacgacagaagcgcccccagattcagctag

SEQ ID NO: 11464 - DNA, 2193 bp, Artificial Sequence
  Description of Artificial Sequence: Synthetic coding sequence
atggaggccgtgatcgagaaggagtgcagcgccctgggcggcctgttccagaccatcatcagcgacatgaagggcagctaccccgtgtgggaggacttcatcaacaaggccggcaagctgcagagccagctgagaaccaccgtggtggccgccgccgccttcctggacgccttccagaaggtggccgacatggccaccaacaccagaggcggcaccagagagatcggcagcgccctgaccagaatgtgcatgagacacagaagcatcgaggccaagctgagacagttcagcagcgccctgatcgactgcctgatcaaccccctgcaggagcagatggaggagtggaagaaggtggccaaccagctggacaaggaccacgccaaggagtacaagaaggccagacaggagatcaagaagaagagcagcgacaccctgaagctgcagaagaaggccaagaagggcagaggcgacatccagccccagctggacagcgccctgcaggacgtgaacgacaagtacctgctgctggaggagaccgagaagcaggccgtgagaaaggccctgatcgaggagagaggcagattctgcaccttcatcagcatgctgagacccgtgatcgaggaggagatcagcatgctgggcgagatcacccacctgcagaccatcagcgaggacctgaagagcctgaccatggacccccacaagctgcccagcagcagcgagcaggtgatcctggacctgaagggcagcgactacagctggagctaccagaccccccccagcagccccagcaccaccatgagcagaaagagcagcgtgtgcagcagcctgaacagcgtgaacagcagcgacagcagaagcagcggcagccacagccacagccccagcagccactacagatacagaagcagcaacctggcccagcaggcccccgtgagactgagcagcgtgagcagccacgacagcggcttcatcagccaggacgccttccagagcaagagccccagccccatgccccccgaggcccccaaccagaacagcagcagcagcgccagcagcgaggccagcgagacctgccagagcgtgagcgagtgcagcagccccaccagcgtgagcagcggcagcaccatgggcgcctgggtgagcaccgagaaggactgggccaagcccggcccctacgaccagcccctggtgaacaccctgcagagaagaaaggagaagagagagcccgaccccaacggcggcggccccaccaccgccagcggcccccccgccgccgccgaggaggcccagagacccagaagcatgaccgtgagcgccgccaccagacccggcgaggagatggaggcctgcgaggagctggccctggccctgagcagaggcctgcagctggacacccagagaagcagcagagacagcctgcagtgcagcagcggctacagcacccagaccaccaccccctgctgcagcgaggacaccatccccagccaggtgagcgactacgactacttcagcgtgagcggcgaccaggaggccgaccagcaggagttcgacaagagcagcaccatccccagaaacagcgacatcagccagagctacagaagaatgttccaggccaagagacccgccagcaccgccggcctgcccaccaccctgggccccgccatggtgacccccggcgtggccaccatcagaagaacccccagcaccaagcccagcgtgagaagaggcaccatcggcgccggccccatccccatcaagacccccgtgatccccgtgaagacccccaccgtgcccgacctgcccggcgtgctgcccgccccccccgacggccccgaggagagaggcgagcacagccccgagagccccagcgtgggcgagggcccccagggcgtgaccagcatgcccagcagcatgtggagcggccaggccagcgtgaacccccccctgcccggccccaagcccagcatccccgaggagcacagacaggccatccccgagagcgaggccgaggaccaggagagagagccccccagcgccaccgtgagccccggccagatccccgagagcgaccccgccgacctgagccccagagacaccccccagggcgaggacatgctgaacgccatcagaagaggcgtgaagctgaagaagaccaccaccaacgacagaagcgcccccagattcagctag

SEQ ID NO: 11465 - DNA, 1590 bp, Artificial Sequence
  Description of Artificial Sequence: Synthetic coding sequence
atgagcagaaagagcagcgtgtgcagcagcctgaacagcgtgaacagcagcgacagcagaagcagcggcagccacagccacagccccagcagccactacagatacagaagcagcaacctggcccagcaggcccccgtgagactgagcagcgtgagcagccacgacagcggcttcatcagccaggacgccttccagagcaagagccccagccccatgccccccgaggcccccaaccagaacagcagcagcagcgccagcagcgaggccagcgagacctgccagagcgtgagcgagtgcagcagccccaccagcgtgagcagcggcagcaccatgggcgcctgggtgagcaccgagaagctgagcaacggcttcagccactacagcctgagcagcgagagccacgtgggccccaccggcgccggcctgttcccccactgcctgcccgccagcagactgctgcccagagtgaccagcgtgcacctgcccgactacgcccactactacaccatcggccccggcatgttccccagcagccagatccccagctggaaggactgggccaagcccggcccctacgaccagcccctggtgaacaccctgcagagaagaaaggagaagagagagcccgaccccaacggcggcggccccaccaccgccagcggcccccccgccgccgccgaggaggcccagagacccagaagcatgaccgtgagcgccgccaccagacccggcgaggagatggaggcctgcgaggagctggccctggccctgagcagaggcctgcagctggacacccagagaagcagcagagacagcctgcagtgcagcagcggctacagcacccagaccaccaccccctgctgcagcgaggacaccatccccagccaggtgagcgactacgactacttcagcgtgagcggcgaccaggaggccgaccagcaggagttcgacaagagcagcaccatccccagaaacagcgacatcagccagagctacagaagaatgttccaggccaagagacccgccagcaccgccggcctgcccaccaccctgggccccgccatggtgacccccggcgtggccaccatcagaagaacccccagcaccaagcccagcgtgagaagaggcaccatcggcgccggccccatccccatcaagacccccgtgatccccgtgaagacccccaccgtgcccgacctgcccggcgtgctgcccgccccccccgacggccccgaggagagaggcgagcacagccccgagagccccagcgtgggcgagggcccccagggcgtgaccagcatgcccagcagcatgtggagcggccaggccagcgtgaacccccccctgcccggccccaagcccagcatccccgaggagcacagacaggccatccccgagagcgaggccgaggaccaggagagagagccccccagcgccaccgtgagccccggccagatccccgagagcgaccccgccgacctgagccccagagacaccccccagggcgaggacatgctgaacgccatcagaagaggcgtgaagctgaagaagaccaccaccaacgacagaagcgcccccagattcagctag

SEQ ID NO: 11466 - DNA, 2268 bp, Artificial Sequence
  Description of Artificial Sequence: Synthetic coding sequence
atggaggccgtgatcgagaaggagtgcagcgccctgggcggcctgttccagaccatcatcagcgacatgaagggcagctaccccgtgtgggaggacttcatcaacaaggccggcaagctgcagagccagctgagaaccaccgtggtggccgccgccgccttcctggacgccttccagaaggtggccgacatggccaccaacaccagaggcggcaccagagagatcggcagcgccctgaccagaatgtgcatgagacacagaagcatcgaggccaagctgagacagttcagcagcgccctgatcgactgcctgatcaaccccctgcaggagcagatggaggagtggaagaaggtggccaaccagctggacaaggaccacgccaaggagtacaagaaggccagacaggagatcaagaagaagagcagcgacaccctgaagctgcagaagaaggccaagaagggcagaggcgacatccagccccagctggacagcgccctgcaggacgtgaacgacaagtacctgctgctggaggagaccgagaagcaggccgtgagaaaggccctgatcgaggagagaggcagattctgcaccttcatcagcatgctgagacccgtgatcgaggaggagatcagcatgctgggcgagatcacccacctgcagaccatcagcgaggacctgaagagcctgaccatggacccccacaagctgcccagcagcagcgagcaggtgatcctggacctgaagggcagcgactacagctggagctaccagaccccccccagcagccccagcaccaccatgagcagaaagagcagcgtgtgcagcagcctgaacagcgtgaacagcagcgacagcagaagcagcggcagccacagccacagccccagcagccactacagatacagaagcagcaacctggcccagcaggcccccgtgagactgagcagcgtgagcagccacgacagcggcttcatcagccaggacgccttccagagcaagagccccagccccatgccccccgaggcccccaaccagctgagcaacggcttcagccactacagcctgagcagcgagagccacgtgggccccaccggcgccggcctgttcccccactgcctgcccgccagcagactgctgcccagagtgaccagcgtgcacctgcccgactacgcccactactacaccatcggccccggcatgttccccagcagccagatccccagctggaaggactgggccaagcccggcccctacgaccagcccctggtgaacaccctgcagagaagaaaggagaagagagagcccgaccccaacggcggcggccccaccaccgccagcggcccccccgccgccgccgaggaggcccagagacccagaagcatgaccgtgagcgccgccaccagacccggcgaggagatggaggcctgcgaggagctggccctggccctgagcagaggcctgcagctggacacccagagaagcagcagagacagcctgcagtgcagcagcggctacagcacccagaccaccaccccctgctgcagcgaggacaccatccccagccaggtgagcgactacgactacttcagcgtgagcggcgaccaggaggccgaccagcaggagttcgacaagagcagcaccatccccagaaacagcgacatcagccagagctacagaagaatgttccaggccaagagacccgccagcaccgccggcctgcccaccaccctgggccccgccatggtgacccccggcgtggccaccatcagaagaacccccagcaccaagcccagcgtgagaagaggcaccatcggcgccggccccatccccatcaagacccccgtgatccccgtgaagacccccaccgtgcccgacctgcccggcgtgctgcccgccccccccgacggccccgaggagagaggcgagcacagccccgagagccccagcgtgggcgagggcccccagggcgtgaccagcatgcccagcagcatgtggagcggccaggccagcgtgaacccccccctgcccggccccaagcccagcatccccgaggagcacagacaggccatccccgagagcgaggccgaggaccaggagagagagccccccagcgccaccgtgagccccggccagatccccgagagcgaccccgccgacctgagccccagagacaccccccagggcgaggacatgctgaacgccatcagaagaggcgtgaagctgaagaagaccaccaccaacgacagaagcgcccccagattcagctag

SEQ ID NO: 11467 - DNA, 1437 bp, Artificial Sequence
  Description of Artificial Sequence: Synthetic coding sequence
atggccggcgtggaggaggtggccgccagcggcagccacctgaacggcgacctggaccccgacgacagagaggagggcgccgccagcaccgccgaggaggccgccaagaagaagagaagaaagaagaagaagagcaagggccccagcgccgccggcgagcaggagcccgacaaggagagcggcgccagcgtggacgaggtggccagacagctggagagaagcgccctggaggacaaggagagagacgaggacgacgaggacggcgacggcgacggcgacggcgccaccggcaagaagaagaagaagaagaagaagaagagaggccccaaggtgcagaccgacccccccagcgtgcccatctgcgacctgtaccccaacggcgtgttccccaagggccaggagtgcgagtacccccccacccaggacggcagaaccgccgcctggagaaccaccagcgaggagaagaaggccctggaccaggccagcgaggagatctggaacgacttcagagaggccgccgaggcccacagacaggtgagaaagtacgtgatgagctggatcaagcccggcatgaccatgatcgagatctgcgagaagctggaggactgcagcagaaagctgatcaaggagaacggcctgaacgccggcctggccttccccaccggctgcagcctgaacaactgcgccgcccactacacccccaacgccggcgacaccaccgtgctgcagtacgacgacatctgcaagatcgacttcggcacccacatcagcggcagaatcatcgactgcgccttcaccgtgaccttcaaccccaagtacgacaccctgctgaaggccgtgaaggacgccaccaacaccggcatcaagtgcgccggcatcgacgtgagactgtgcgacgtgggcgaggccatccaggaggtgatggagagctacgaggtggagatcgacggcaagacctaccaggtgaagcccatcagaaacctgaacggccacagcatcggccagtacagaatccacgccggcaagaccgtgcccatcgtgaagggcggcgaggccaccagaatggaggagggcgaggtgtacgccatcgagaccttcggcagcaccggcaagggcgtggtgcacgacgacatggagtgcagccactacatgaagaacttcgacgtgggccacgtgcccatcagactgcccagaaccaagcacctgctgaacgtgatcaacgagaacttcggcaccctggccttctgcagaagatggctggacagactgggcgagagcaagtacctgatggccctgaagaacctgtgcgacctgggcatcgtggacccctacccccccctgtgcgacatcaagggcagctacaccgcccagttcgagcacaccatcctgctgagacccacctgcaaggaggtggtgagcagaggcgacgactactag

SEQ ID NO: 11468 - DNA, 1743 bp, Artificial Sequence
  Description of Artificial Sequence: Synthetic coding sequence
atgggcaccaccggcctggagagcctgagcctgggcgacagaggcgccgcccccaccgtgaccagcagcgagagactggtgcccgacccccccaacgacctgagaaaggaggacgtggccatggagctggagagagtgggcgaggacgaggagcagatgatgatcaagagaagcagcgagtgcaaccccctgctgcaggagcccatcgccagcgcccagttcggcgccaccgccggcaccgagtgcagaaagagcgtgccctgcggctgggagagagtggtgaagcagagactgttcggcaagaccgccggcagattcgacgtgtacttcatcagcccccagggcctgaagttcagaagcaagagcagcctggccaactacctgcacaagaacggcgagaccagcctgaagcccgaggacttcgacttcaccgtgctgagcaagagaggcatcaagagcagatacaaggactgcagcatggccgccctgaccagccacctgcagaaccagagcaacaacagcaactggaacctgagaaccagaagcaagtgcaagaaggacgtgttcatgccccccagcagcagcagcgagctgcaggagagcagaggcctgagcaacttcaccagcacccacctgctgctgaaggaggacgagggcgtggacgacgtgaacttcagaaaggtgagaaagcccaagggcaaggtgaccatcctgaagggcatccccatcaagaagaccaagaagggctgcagaaagagctgcagcggcttcgtgcagagcgacagcaagagagagagcgtgtgcaacaaggccgacgccgagagcgagcccgtggcccagaagagccagctggacagaaccgtgtgcatcagcgacgccggcgcctgcggcgagaccctgagcgtgaccagcgaggagaacagcctggtgaagaagaaggagagaagcctgagcagcggcagcaacttctgcagcgagcagaagaccagcggcatcatcaacaagttctgcagcgccaaggacagcgagcacaacgagaagtacgaggacaccttcctggagagcgaggagatcggcaccaaggtggaggtggtggagagaaaggagcacctgcacaccgacatcctgaagagaggcagcgagatggacaacaactgcagccccaccagaaaggacttcaccggcgagaagatcttccaggaggacaccatccccagaacccagatcgagagaagaaagaccagcctgtacttcagcagcaagtacaacaaggaggccctgagcccccccagaagaaaggccttcaagaagtggaccccccccagaagccccttcaacctggtgcaggagaccctgttccacgacccctggaagctgctgatcgccaccatcttcctgaacagaaccagcggcaagatggccatccccgtgctgtggaagttcctggagaagtaccccagcgccgaggtggccagaaccgccgactggagagacgtgagcgagctgctgaagcccctgggcctgtacgacctgagagccaagaccatcgtgaagttcagcgacgagtacctgaccaagcagtggaagtaccccatcgagctgcacggcatcggcaagtacggcaacgacagctacagaatcttctgcgtgaacgagtggaagcaggtgcaccccgaggaccacaagctgaacaagtaccacgactggctgtgggagaaccacgagaagctgagcctgagctag

SEQ ID NO: 11469 - DNA, 789 bp, Artificial Sequence
  Description of Artificial Sequence: Synthetic coding sequence
atgggcaccaccggcctggagagcctgagcctgggcgacagaggcgccgcccccaccgtgaccagcagcgagagactggtgcccgacccccccaacgacctgagaaaggaggacgtggccatggagctggagagagtgggcgaggacgaggagcagatgatgatcaagagaagcagcgagtgcaaccccctgctgcaggagcccatcgccagcgcccagttcggcgccaccgccggcaccgagtgccaggacaccatccccagaacccagatcgagagaagaaagaccagcctgtacttcagcagcaagtacaacaaggaggccctgagcccccccagaagaaaggccttcaagaagtggaccccccccagaagccccttcaacctggtgcaggagaccctgttccacgacccctggaagctgctgatcgccaccatcttcctgaacagaaccagcggcaagatggccatccccgtgctgtggaagttcctggagaagtaccccagcgccgaggtggccagaaccgccgactggagagacgtgagcgagctgctgaagcccctgggcctgtacgacctgagagccaagaccatcgtgaagttcagcgacgagtacctgaccaagcagtggaagtaccccatcgagctgcacggcatcggcaagtacggcaacgacagctacagaatcttctgcgtgaacgagtggaagcaggtgcaccccgaggaccacaagctgaacaagtaccacgactggctgtgggagaaccacgagaagctgagcctgagctag

SEQ ID NO: 11470 - DNA, 1725 bp, Artificial Sequence
  Description of Artificial Sequence: Synthetic coding sequence
atgggcaccaccggcctggagagcctgagcctgggcgacagaggcgccgcccccaccgtgaccagcagcgagagactggtgcccgacccccccaacgacctgagaaaggaggacgtggccatggagctggagagagtgggcgaggacgaggagcagatgatgatcaagagaagcagcgagtgcaaccccctgctgcaggagcccatcgccagcgcccagttcggcgccaccgccggcaccgagtgcagaaagagcgtgccctgcggctgggagagagtggtgaagcagagactgttcggcaagaccgccggcagattcgacgtgtacttcatcagcccccagggcctgaagttcagaagcaagagcagcctggccaactacctgcacaagaacggcgagaccagcctgaagcccgaggacttcgacttcaccgtgctgagcaagagaggcatcaagagcagatacaaggactgcagcatggccgccctgaccagccacctgcagaaccagagcaacaacagcaactggaacctgagaaccagaagcaagtgcaagaaggacgtgttcatgccccccagcagcagcagcgagctgcaggagagcagaggcctgagcaacttcaccagcacccacctgctgctgaaggaggacgagggcgtggacgacgtgaacttcagaaaggtgagaaagcccaagggcaaggtgaccatcctgaagggcatccccatcaagaagaccaagaagggctgcagaaagagctgcagcggcttcgtgcagagcgacagcaagagagagagcgtgtgcaacaaggccgacgccgagagcgagcccgtggcccagaagagccagctggacagaaccgtgtgcatcagcgacgccggcgcctgcggcgagaccctgagcgtgaccagcgaggagaacagcctggtgaagaagaaggagagaagcctgagcagcggcagcaacttctgcagcgagcagaagaccagcggcatcatcaacaagttctgcagcgccaaggacagcgagcacaacgagaagtacgaggacaccttcctggagagcgaggagatcggcaccaaggtggaggtggtggagagaaaggagcacctgcacaccgacatcctgaagagaggcagcgagatggacaacaactgcagccccaccagaaaggacttcaccgaggacaccatccccagaacccagatcgagagaagaaagaccagcctgtacttcagcagcaagtacaacaaggaggccctgagcccccccagaagaaaggccttcaagaagtggaccccccccagaagccccttcaacctggtgcaggagaccctgttccacgacccctggaagctgctgatcgccaccatcttcctgaacagaaccagcggcaagatggccatccccgtgctgtggaagttcctggagaagtaccccagcgccgaggtggccagaaccgccgactggagagacgtgagcgagctgctgaagcccctgggcctgtacgacctgagagccaagaccatcgtgaagttcagcgacgagtacctgaccaagcagtggaagtaccccatcgagctgcacggcatcggcaagtacggcaacgacagctacagaatcttctgcgtgaacgagtggaagcaggtgcaccccgaggaccacaagctgaacaagtaccacgactggctgtgggagaaccacgagaagctgagcctgagctag

SEQ ID NO: 11471 - DNA, 93 bp, Artificial Sequence
  Description of Artificial Sequence: Synthetic coding sequence
atggtgaacgaggccagaggcaacagcagcctgaacccctgcctggagggcagcgccagcagcggcagcgagagcagcaaggacagcagctag

SEQ ID NO: 11472 - DNA, 2094 bp, Artificial Sequence
  Description of Artificial Sequence: Synthetic coding sequence
atggaccacagaaaggccagagtgctgcccgccggccactactgccccagcctgggcatctgggccagccaggtgggcagcgtgagaagcagcgtgccccccagcatcagcagaaaccccgccatggtgaacgaggccagaggcaacagcagcctgaacccctgcctggagggcagcgccagcagcggcagcgagagcagcaaggacagcagcagatgcagcacccccggcctggaccccgagagacacgagagactgagagagaagatgagaagaagactggagagcggcgacaagtggttcagcctggagttcttcccccccagaaccgccgagggcgccgtgaacctgatcagcagattcgacagaatggccgccggcggccccctgtacatcgacgtgacctggcaccccgccggcgaccccggcagcgacaaggagaccagcagcatgatgatcgccagcaccgccgtgaactactgcggcctggagaccatcctgcacatgacctgctgcagacagagactggaggagatcaccggccacctgcacaaggccaagcagctgggcctgaagaacatcatggccctgagaggcgaccccatcggcgaccagtgggaggaggaggagggcggcttcaactacgccgtggacctggtgaagcacatcagaagcgagttcggcgactacttcgacatctgcgtggccggctaccccaagggccaccccgaggccggcagcttcgaggccgacctgaagcacctgaaggagaaggtgagcgccggcgccgacttcatcatcacccagctgttcttcgaggccgacaccttcttcagattcgtgaaggcctgcaccgacatgggcatcacctgccccatcgtgcccggcatcttccccatccagggctaccacagcctgagacagctggtgaagctgagcaagctggaggtgccccaggagatcaaggacgtgatcgagcccatcaaggacaacgacgccgccatcagaaactacggcatcgagctggccgtgagcctgtgccaggagctgctggccagcggcctggtgcccggcctgcacttctacaccctgaacagagagatggccaccaccgaggtgctgaagagactgggcatgtggaccgaggaccccagaagacccctgccctgggccctgagcgcccaccccaagagaagagaggaggacgtgagacccatcttctgggccagcagacccaagagctacatctacagaacccaggagtgggacgagttccccaacggcagatggggcaacagcagcagccccgccttcggcgagctgaaggactactacctgttctacctgaagagcaagagccccaaggaggagctgctgaagatgtggggcgaggagctgaccagcgaggagagcgtgttcgaggtgttcgtgctgtacctgagcggcgagcccaacagaaacggccacaaggtgacctgcctgccctggaacgacgagcccctggccgccgagaccagcctgctgaaggaggagctgctgagagtgaacagacagggcatcctgaccatcaacagccagcccaacatcaacggcaagcccagcagcgaccccatcgtgggctggggccccagcggcggctacgtgttccagaaggcctacctggagttcttcaccagcagagagaccgccgaggccctgctgcaggtgctgaagaagtacgagctgagagtgaactaccacctggtgaacgtgaagggcgagaacatcaccaacgcccccgagctgcagcccaacgccgtgacctggggcatcttccccggcagagagatcatccagcccaccgtggtggaccccgtgagcttcatgttctggaaggacgaggccttcgccctgtggatcgagagatggggcaagctgtacgaggaggagagccccagcagaaccatcatccagtacatccacgacaactacttcctggtgaacctggtggacaacgacttccccctggacaactgcctgtggcaggtggtggaggacaccctggagctgctgaacagacccacccagaacgccagagagaccgaggccccctag

SEQ ID NO: 11473 - DNA, 2094 bp, Artificial Sequence; identical to SEQ ID NO: 11472
  Description of Artificial Sequence: Synthetic coding sequence

SEQ ID NO: 11474 - DNA, 1971 bp, Artificial Sequence
  Description of Artificial Sequence: Synthetic coding sequence
atggtgaacgaggccagaggcaacagcagcctgaacccctgcctggagggcagcgccagcagcggcagcgagagcagcaaggacagcagcagatgcagcacccccggcctggaccccgagagacacgagagactgagagagaagatgagaagaagactggagagcggcgacaagtggttcagcctggagttcttcccccccagaaccgccgagggcgccgtgaacctgatcagcagattcgacagaatggccgccggcggccccctgtacatcgacgtgacctggcaccccgccggcgaccccggcagcgacaaggagaccagcagcatgatgatcgccagcaccgccgtgaactactgcggcctggagaccatcctgcacatgacctgctgcagacagagactggaggagatcaccggccacctgcacaaggccaagcagctgggcctgaagaacatcatggccctgagaggcgaccccatcggcgaccagtgggaggaggaggagggcggcttcaactacgccgtggacctggtgaagcacatcagaagcgagttcggcgactacttcgacatctgcgtggccggctaccccaagggccaccccgaggccggcagcttcgaggccgacctgaagcacctgaaggagaaggtgagcgccggcgccgacttcatcatcacccagctgttcttcgaggccgacaccttcttcagattcgtgaaggcctgcaccgacatgggcatcacctgccccatcgtgcccggcatcttccccatccagggctaccacagcctgagacagctggtgaagctgagcaagctggaggtgccccaggagatcaaggacgtgatcgagcccatcaaggacaacgacgccgccatcagaaactacggcatcgagctggccgtgagcctgtgccaggagctgctggccagcggcctggtgcccggcctgcacttctacaccctgaacagagagatggccaccaccgaggtgctgaagagactgggcatgtggaccgaggaccccagaagacccctgccctgggccctgagcgcccaccccaagagaagagaggaggacgtgagacccatcttctgggccagcagacccaagagctacatctacagaacccaggagtgggacgagttccccaacggcagatggggcaacagcagcagccccgccttcggcgagctgaaggactactacctgttctacctgaagagcaagagccccaaggaggagctgctgaagatgtggggcgaggagctgaccagcgaggagagcgtgttcgaggtgttcgtgctgtacctgagcggcgagcccaacagaaacggccacaaggtgacctgcctgccctggaacgacgagcccctggccgccgagaccagcctgctgaaggaggagctgctgagagtgaacagacagggcatcctgaccatcaacagccagcccaacatcaacggcaagcccagcagcgaccccatcgtgggctggggccccagcggcggctacgtgttccagaaggcctacctggagttcttcaccagcagagagaccgccgaggccctgctgcaggtgctgaagaagtacgagctgagagtgaactaccacctggtgaacgtgaagggcgagaacatcaccaacgcccccgagctgcagcccaacgccgtgacctggggcatcttccccggcagagagatcatccagcccaccgtggtggaccccgtgagcttcatgttctggaaggacgaggccttcgccctgtggatcgagagatggggcaagctgtacgaggaggagagccccagcagaaccatcatccagtacatccacgacaactacttcctggtgaacctggtggacaacgacttccccctggacaactgcctgtggcaggtggtggaggacaccctggagctgctgaacagacccacccagaacgccagagagaccgaggccccctag

SEQ ID NO: 11475 - DNA, 1971 bp, Artificial Sequence; identical to SEQ ID NO: 11474
  Description of Artificial Sequence: Synthetic coding sequence

SEQ ID NO: 11476 - DNA, 93 bp, Artificial Sequence; identical to SEQ ID NO: 11471
  Description of Artificial Sequence: Synthetic coding sequence

SEQ ID NO: 11477 - DNA, 432 bp, Artificial Sequence
  Description of Artificial Sequence: Synthetic coding sequence
atggtgaacgaggccagaggcaacagcagcctgaacccctgcctggagggcagcgccagcagcggcagcgagagcagcaaggacagcagcagatgcagcacccccggcctggaccccgagagacacgagagactgagagagaagatgagaagaagactggagagcggcgacaagtggttcagcctggagttcttcccccccagaaccgccgagggcgccgtgaacctgatcagcagattcgacagaatggccgccggcggccccctgtacatcgacgtgacctggcaccccgccggcgaccccggcagcgacaaggagaccagcagcatgatgatcgccagcaccgccgtgaactactgcggcctggagaccatcctgcacatgacctgctgcagacagagactggaggagatcaccggccacctgcactag

SEQ ID NO: 11478 - DNA, 162 bp, Artificial Sequence
  Description of Artificial Sequence: Synthetic coding sequence
atgtgcagaggctgcggctgcctgccccccgacgccccctgccccaccctgtgcagcagaaaccccgccatggtgaacgaggccagaggcaacagcagcctgaacccctgcctggagggcagcgccagcagcggcagcgagagcagcaaggacagcagctag

SEQ ID NO: 11479 - DNA, 93 bp, Artificial Sequence; identical to SEQ ID NO: 11471
  Description of Artificial Sequence: Synthetic coding sequence

SEQ ID NO: 11480 - DNA, 2508 bp, Artificial Sequence
  Description of Artificial Sequence: Synthetic coding sequence
atggccgcccccatcctgaaggacgtggtggcctacgtggaggtgtggagcagcaacggcaccgagaactacagcaagaccttcaccacccagctggtggacatgggcgccaaggtgagcaagaccttcaacaagcaggtgacccacgtgatcttcaaggacggctaccagagcacctgggacaaggcccagaagagaggcgtgaagctggtgagcgtgctgtgggtggagaagtgcagaaccgccggcgcccacatcgacgagagcctgttccccgccgccaacatgaacgagcacctgagcagcctgatcaagaagaagagaaagtgcatgcagcccaaggacttcaacttcaagacccccgagaacgacaagagattccagaagaagttcgagaagatggccaaggagctgcagagacagaagaccaacctggacgacgacgtgcccatcctgctgttcgagagcaacggcagcctgatctacacccccaccatcgagatcaacagcagacaccacagcgccatggagaagagactgcaggagatgaaggagaagagagagaacctgagccccaccagcagccagatgatccagcagagccacgacaaccccagcaacagcctgtgcgaggcccccctgaacatcagcagagacaccctgtgcagcgacgagtacttcgccggcggcctgcacagcagcttcgacgacctgtgcggcaacagcggctgcggcaaccaggagagaaagctggagggcagcatcaacgacatcaagagcgacgtgtgcatcagcagcctggtgctgaaggccaacaacatccacagcagccccagcttcacccacctggacaagagcagcccccagaagttcctgagcaacctgagcaaggaggagatcaacctgcagagaaacatcgccggcaaggtggtgacccccgaccagaagcaggccgccggcatgagccaggagaccttcgaggagaagtacagactgagccccaccctgagcagcaccaagggccacctgctgatccacagcagacccagaagcagcagcgtgaagagaaagagagtgagccacggcagccacagcccccccaaggagaagtgcaagagaaagagaagcaccagaagaagcatcatgcccagactgcagctgtgcagaagcgaggacagactgcagcacgtggccggccccgccctggaggccctgagctgcggcgagagcagctacgacgactacttcagccccgacaacctgaaggagagatacagcgagaacctgccccccgagagccagctgcccagcagccccgcccagctgagctgcagaagcctgagcaagaaggagagaaccagcatcttcgagatgagcgacttcagctgcgtgggcaagaagaccagaaccgtggacatcaccaacttcaccgccaagaccatcagcagccccagaaagaccggcaacggcgagggcagagccaccagcagctgcgtgaccagcgcccccgaggaggccctgagatgctgcagacaggccggcaaggaggacgcctgccccgagggcaacggcttcagctacaccatcgaggaccccgccctgcccaagggccacgacgacgacctgacccccctggagggcagcctggaggagatgaaggaggccgtgggcctgaagagcacccagaacaagggcaccaccagcaagatcagcaacagcagcgagggcgaggcccagagcgagcacgagccctgcttcatcgtggactgcaacatggagaccagcaccgaggagaaggagaacctgcccggcggctacagcggcagcgtgaagaacagacccaccagacacgacgtgctggacgacagctgcgacggcttcaaggacctgatcaagccccacgaggagctgaagaagagcggcagaggcaagaagcccaccagaaccctggtgatgaccagcatgcccagcgagaagcagaacgtggtgatccaggtggtggacaagctgaagggcttcagcatcgcccccgacgtgtgcgagaccaccacccacgtgctgagcggcaagcccctgagaaccctgaacgtgctgctgggcatcgccagaggctgctgggtgctgagctacgactgggtgctgtggagcctggagctgggccactggatcagcgaggagcccttcgagctgagccaccacttccccgccgcccccctgtgcagaagcgagtgccacctgagcgccggcccctacagaggcaccctgttcgccgaccagcccgccatgttcgtgagccccgccagcagcccccccgtggccaagctgtgcgagctggtgcacctgtgcggcggcagagtgagccaggtgcccagacaggccagcatcgtgatcggcccctacagcggcaagaagaaggccaccgtgaagtacctgagcgagaagtgggtgctggacagcatcacccagcacaaggtgtgcgcccccgagaactacctgctgagccagtag

SEQ ID NO: 11481 - DNA, 1833 bp, Artificial Sequence
  Description of Artificial Sequence: Synthetic coding sequence
atggccgcccccatcctgaaggacgtggtggcctacgtggaggtgtggagcagcaacggcaccgagaactacagcaagaccttcaccacccagctggtggacatgggcgccaaggtgagcaagaccttcaacaagcaggtgacccacgtgatcttcaaggacggctaccagagcacctgggacaaggcccagaagagaggcgtgaagctggtgagcgtgctgtgggtggagaagtgcagaaccgccggcgcccacatcgacgagagcctgttccccgccgccaacatgaacgagcacctgagcagcctgatcaagaagaagagaaagtgcatgcagcccaaggacttcaacttcaagacccccgagaacgacaagagattccagaagaagttcgagaagatggccaaggagctgcagagacagaagaccaacctggacgacgacgtgcccatcctgctgttcgagagcaacggcagcctgatctacacccccaccatcgagatcaacagcagacaccacagcgccatggagaagagactgcaggagatgaaggagaagagagagaacctgagccccaccagcagccagatgatccagcagagccacgacaaccccagcaacagcctgtgcgaggcccccctgaacatcagcagagacaccctgtgcagcgacgagtacttcgccggcggcctgcacagcagcttcgacgacctgtgcggcaacagcggctgcggcaaccaggagagaaagctggagggcagcatcaacgacatcaagagcgacgtgtgcatcagcagcctggtgctgaaggccaacaacatccacagcagccccagcttcacccacctggacaagagcagcccccagaagttcctgagcaacctgagcaaggaggagatcaacctgcagagaaacatcgccggcaaggtggtgacccccgaccagaagcaggccgccggcatgagccaggagaccttcgaggagaagtacagactgagccccaccctgagcagcaccaagggccacctgctgatccacagcagacccagaagcagcagcgtgaagagaaagagagtgagccacggcagccacagcccccccaaggagaagtgcaagagaaagagaagcaccagaagaagcatcatgcccagactgcagctgtgcagaagcgaggacagactgcagcacgtggccggccccgccctggaggccctgagctgcggcgagagcagctacgacgactacttcagccccgacaacctgaaggagagatacagcgagaacctgccccccgagagccagctgcccagcagccccgcccagctgagctgcagaagcctgagcaagaaggagagaaccagcatcttcgagatgagcgacttcagctgcgtgggcaagaagaccagaaccgtggacatcaccaacttcaccgccaagaccatcagcagccccagaaagaccggcaacggcgagggcagagccaccagcagctgcgtgaccagcgcccccgaggaggccctgagatgctgcagacaggccggcaaggaggacgcctgccccgagggcaacggcttcagctacaccatcgaggaccccgccctgcccaagggccacgacgacgacctgacccccctggagggcagcctggaggagatgaaggaggccgtgggcctgaagagcacccagaacaagggcaccaccagcaagatcagcaacagcagcgagggcgaggcccagagcgagcacgagccctgcttcatcgtggactgcaacatggagaccagcaccgaggagaaggagaacctgcccggcggctacagcggcagcatgtag

SEQ ID NO: 11482 - DNA, 1689 bp, Artificial Sequence
  Description of Artificial Sequence: Synthetic coding sequence
atggccgcccccatcctgaaggacgtggtggcctacgtggaggtgtggagcagcaacggcaccgagaactacagcaagaccttcaccacccagctggtggacatgggcgccaaggtgagcaagaccttcaacaagcaggtgacccacgtgatcttcaaggacggctaccagagcacctgggacaaggcccagaagagaggcgtgaagctggtgagcgtgctgtgggtggagaagtgcagaaccgccggcgcccacatcgacgagagcctgttccccgccgccaacatgaacgagcacctgagcagcctgatcaagaagaagagaaagtgcatgcagcccaaggacttcaacttcaagacccccgagaacgacaagagattccagaagaagttcgagaagatggccaaggagctgcagagacagaagaccaacctggccagccagatgatccagcagagccacgacaaccccagcaacagcctgtgcgaggcccccctgaacatcagcagagacaccctgtgcagcgacgagtacttcgccggcggcctgcacagcagcttcgacgacctgtgcggcaacagcggctgcggcaaccaggagagaaagctggagggcagcatcaacgacatcaagagcgacgtgtgcatcagcagcctggtgctgaaggccaacaacatccacagcagccccagcttcacccacctggacaagagcagcccccagaagttcctgagcaacctgagcaaggaggagatcaacctgcagagaaacatcgccggcaaggtggtgacccccgaccagaagcaggccgccggcatgagccaggagaccttcgaggagaagtacagactgagccccaccctgagcagcaccaagggccacctgctgatccacagcagacccagaagcagcagcgtgaagagaaagagagtgagccacggcagccacagcccccccaaggagaagtgcaagagaaagagaagcaccagaagaagcatcatgcccagactgcagctgtgcagaagcgaggacagactgcagcacgtggccggccccgccctggaggccctgagctgcggcgagagcagctacgacgactacttcagccccgacaacctgaaggagagatacagcgagaacctgccccccgagagccagctgcccagcagccccgcccagctgagctgcagaagcctgagcaagaaggagagaaccagcatcttcgagatgagcgacttcagctgcgtgggcaagaagaccagaaccgtggacatcaccaacttcaccgccaagaccatcagcagccccagaaagaccggcaacggcgagggcagagccaccagcagctgcgtgaccagcgcccccgaggaggccctgagatgctgcagacaggccggcaaggaggacgcctgccccgagggcaacggcttcagctacaccatcgaggaccccgccctgcccaagggccacgacgacgacctgacccccctggagggcagcctggaggagatgaaggaggccgtgggcctgaagagcacccagaacaagggcaccaccagcaagatcagcaacagcagcgagggcgaggcccagagcgagcacgagccctgcttcatcgtggactgcaacatggagaccagcaccgaggagaaggagaacctgcccggcggctacagcggcagcatgtag

SEQ ID NO: 11483 - DNA, 234 bp, Artificial Sequence
  Description of Artificial Sequence: Synthetic coding sequence
atgaacgtgctgctgggcagcgtggtgatcttcgccaccttcgtgaccctgtgcaacgccagctgctacttcatccccaacgagggcgtgcccggcgacagcaccagaatgttcctgcacctgtgggtgatgaccaagaccaccgccaaggagagcagcagaagaagaaccgccagcatcagctggtggagaagaagaacccagaagagacccgtgctgagcgtgaacggctag

SEQ ID NO: 11484 - DNA, 345 bp, Artificial Sequence
  Description of Artificial Sequence: Synthetic coding sequence
atgaacgtgctgctgggcagcgtggtgatcttcgccaccttcgtgaccctgtgcaacgccagctgctacttcatccccaacgagggcgtgcccggcgacagcaccagaaagtgcatggacctgaagggcaacaagcaccccatcaacagcgagtggcagaccgacaactgcgagacctgcacctgctacgagaccgagatcagctgctgcaccctggtgagcacccccgtgggctacgacaaggacaactgccagagaatcttcaagaaggaggactgcaagtacatcgtggtggagaagaaggaccccaagaagacctgcagcgtgagcgagtggatcatctag

SEQ ID NO: 11485 - DNA, 3813 bp, Artificial Sequence
  Description of Artificial Sequence: Synthetic coding sequence
atgaccgacgacaacagcgacgacaagatcgaggacgagctgcagaccttcttcaccagcgacaaggacggcaacacccacgcctacaaccccaagagcccccccacccagaacagcagcgccagcagcgtgaactggaacagcgccaaccccgacgacatggtggtggactacgagaccgaccccgccgtggtgaccggcgagaacatcagcctgagcctgcagggcgtggaggtgttcggccacgagaagagcagcagcgacttcatcagcaagcaggtgctggacatgcacaaggacagcatctgccagtgccccgccctggtgggcaccgagaagcccaagtacctgcagcacagctgccacagcctggaggccgtggagggccagagcgtggagcccagcctgcccttcgtgtggaagcccaacgacaacctgaactgcgccggctactgcgacgccctggagctgaaccagaccttcgacatgaccgtggacaaggtgaactgcaccttcatcagccaccacgccatcggcaagagccagagcttccacaccgccggcagcctgccccccaccggcagaagaagcggcagcaccagcagcctgagctacagcacctggaccagcagccacagcgacaagacccacgccagagagaccacctacgacagagagagcttcgagaacccccaggtgacccccagcgaggcccaggacatgacctacaccgccttcagcgacgtggtgatgcagagcgaggtgttcgtgagcgacatcggcaaccagtgcgcctgcagcagcggcaaggtgaccagcgagtacaccgacggcagccagcagagactggtgggcgagaaggagacccaggccctgacccccgtgagcgacggcatggaggtgcccaacgacagcgccctgcaggagttcttctgcctgagccacgacgagagcaacagcgagccccacagccagagcagctacagacacaaggagatgggccagaacctgagagagaccgtgagctactgcctgatcgacgacgagtgccccctgatggtgcccgccttcgacaagagcgaggcccaggtgctgaaccccgagcacaaggtgaccgagaccgaggacacccagatggtgagcaagggcaaggacctgggcacccagaaccacaccagcgagctgatcctgagcagcccccccggccagaaggtgggcagcagcttcggcctgacctgggacgccaacgacatggtgatcagcaccgacaagaccatgtgcatgagcacccccgtgctggagcccaccaaggtgaccttcagcgtgagccccatcgaggccaccgagaagtgcaagaaggtggagaagggcaacagaggcctgaagaacatccccgacagcaaggaggcccccgtgaacctgtgcaagcccagcctgggcaagagcaccatcaagaccaacacccccatcggctgcaaggtgagaaagaccgagatcatcagctaccccagacccaacttcaagaacgtgaaggccaaggtgatgagcagagccgtgctgcagcccaaggacgccgccctgagcaaggtgacccccagaccccagcagaccagcgccagcagccccagcagcgtgaacagcagacagcagaccgtgctgagcagaacccccagaagcgacctgaacgccgacaagaaggccgagatcctgatcaacaagacccacaagcagcagttcaacaagctgatcaccagccaggccgtgcacgtgaccacccacagcaagaacgccagccacagagtgcccagaaccaccagcgccgtgaagagcaaccaggaggacgtggacaaggccagcagcagcaacagcgcctgcgagaccggcagcgtgagcgccctgttccagaagatcaagggcatcctgcccgtgaagatggagagcgccgagtgcctggagatgacctacgtgcccaacatcgacagaatcagccccgagaagaagggcgagaaggagaacggcaccagcatggagaagcaggagctgaagcaggagatcatgaacgagaccttcgagtacggcagcctgttcctgggcagcgccagcaagaccaccaccaccagcggcagaaacatcagcaagcccgacagctgcggcctgagacagatcgccgcccccaaggccaaggtgggcccccccgtgagctgcctgagaagaaacagcgacaacagaaaccccagcgccgacagagccgtgagcccccagagaatcagaagagtgagcagcagcggcaagcccaccagcctgaagaccgcccagagcagctgggtgaacctgcccagacccctgcccaagagcaaggccagcctgaagagccccgccctgagaagaaccggcagcacccccagcatcgccagcacccacagcgagctgagcacctacagcaacaacagcggcaacgccgccgtgatcaagtacgaggagaagccccccaagcccgccttccagaacggcagcagcggcagcttctacctgaagcccctggtgagcagagcccacgtgcacctgatgaagaccccccccaagggccccagcagaaagaacctgttcaccgccctgaacgccgtggagaagagcagacagaagaaccccagaagcctgtgcatccagccccagaccgcccccgacgccctgccccccgagaagaccctggagctgacccagtacaagaccaagtgcgagaaccagagcggcttcatcctgcagctgaagcagctgctggcctgcggcaacaccaagttcgaggccctgaccgtggtgatccagcacctgctgagcgagagagaggaggccctgaagcagcacaagaccctgagccaggagctggtgaacctgagaggcgagctggtgaccgccagcaccacctgcgagaagctggagaaggccagaaacgagctgcagaccgtgtacgaggccttcgtgcagcagcaccaggccgagaagaccgagagagagaacagactgaaggagttctacaccagagagtacgagaagctgagagacacctacatcgaggaggccgagaagtacaagatgcagctgcaggagcagttcgacaacctgaacgccgcccacgagaccagcaagctggagatcgaggccagccacagcgagaagctggagctgctgaagaaggcctacgaggccagcctgagcgagatcaagaagggccacgagatcgagaagaagagcctggaggacctgctgagcgagaagcaggagagcctggagaagcagatcaacgacctgaagagcgagaacgacgccctgaacgagaagctgaagagcgaggagcagaagagaagagccagagagaaggccaacctgaagaacccccagatcatgtacctggagcaggagctggagagcctgaaggccgtgctggagatcaagaacgagaagctgcaccagcaggacatcaagctgatgaagatggagaagctggtggacaacaacaccgccctggtggacaagctgaagagattccagcaggagaacgaggagctgaaggccagaatggacaagcacatggccatcagcagacagctgagcaccgagcaggccgtgctgcaggagagcctggagaaggagagcaaggtgaacaagagactgagcatggagaacgaggagctgctgtggaagctgcacaacggcgacctgtgcagccccaagagaagccccaccagcagcgccatccccctgcagagccccagaaacagcggcagcttccccagccccagcatcagccccagatag

SEQ ID NO: 11486 - DNA, 1311 bp, Artificial Sequence
  Description of Artificial Sequence: Synthetic coding sequence
atgctgctgagccccaagttcagcctgagcaccatccacatcagactgaccgccaagggcctgctgagaaacctgagactgcccagcggcttcagaagaagcaccgtggtgttccacaccgtggagaagagcagacagaagaaccccagaagcctgtgcatccagccccagaccgcccccgacgccctgccccccgagaagaccctggagctgacccagtacaagaccaagtgcgagaaccagagcggcttcatcctgcagctgaagcagctgctggcctgcggcaacaccaagttcgaggccctgaccgtggtgatccagcacctgctgagcgagagagaggaggccctgaagcagcacaagaccctgagccaggagctggtgaacctgagaggcgagctggtgaccgccagcaccacctgcgagaagctggagaaggccagaaacgagctgcagaccgtgtacgaggccttcgtgcagcagcaccaggccgagaagaccgagagagagaacagactgaaggagttctacaccagagagtacgagaagctgagagacacctacatcgaggaggccgagaagtacaagatgcagctgcaggagcagttcgacaacctgaacgccgcccacgagaccagcaagctggagatcgaggccagccacagcgagaagctggagctgctgaagaaggcctacgaggccagcctgagcgagatcaagaagggccacgagatcgagaagaagagcctggaggacctgctgagcgagaagcaggagagcctggagaagcagatcaacgacctgaagagcgagaacgacgccctgaacgagaagctgaagagcgaggagcagaagagaagagccagagagaaggccaacctgaagaacccccagatcatgtacctggagcaggagctggagagcctgaaggccgtgctggagatcaagaacgagaagctgcaccagcaggacatcaagctgatgaagatggagaagctggtggacaacaacaccgccctggtggacaagctgaagagattccagcaggagaacgaggagctgaaggccagaatggacaagcacatggccatcagcagacagctgagcaccgagcaggccgtgctgcaggagagcctggagaaggagagcaaggtgaacaagagactgagcatggagaacgaggagctgctgtggaagctgcacaacggcgacctgtgcagccccaagagaagccccaccagcagcgccatccccctgcagagccccagaaacagcggcagcttccccagccccagcatcagccccagatag

SEQ ID NO: 11487 - DNA, 1554 bp, Artificial Sequence
  Description of Artificial Sequence: Synthetic coding sequence
atgaccgtgcccggcggcttcagaagctgcaccgagaccgacatcagcagcaagatcttcatcaacagcaccctgaccccccccgccggcagcgagagacactacgacgccaccctgctgaccctgctggtggtgggcagctacagcctgtgcatcatccccctgctggccaccttcaccggcaagaagaccggcaacgccgccgtgatcaagtacgaggagaagccccccaagcccgccttccagaacggcagcagcggcagcttctacctgaagcccctggtgagcagagcccacgtgcacctgatgaagaccccccccaagggccccagcagaaagaacctgttcaccgccctgaacgccgtggagaagagcagacagaagaaccccagaagcctgtgcatccagccccagaccgcccccgacgccctgccccccgagaagaccctggagctgacccagtacaagaccaagtgcgagaaccagagcggcttcatcctgcagctgaagcagctgctggcctgcggcaacaccaagttcgaggccctgaccgtggtgatccagcacctgctgagcgagagagaggaggccctgaagcagcacaagaccctgagccaggagctggtgaacctgagaggcgagctggtgaccgccagcaccacctgcgagaagctggagaaggccagaaacgagctgcagaccgtgtacgaggccttcgtgcagcagcaccaggccgagaagaccgagagagagaacagactgaaggagttctacaccagagagtacgagaagctgagagacacctacatcgaggaggccgagaagtacaagatgcagctgcaggagcagttcgacaacctgaacgccgcccacgagaccagcaagctggagatcgaggccagccacagcgagaagctggagctgctgaagaaggcctacgaggccagcctgagcgagatcaagaagggccacgagatcgagaagaagagcctggaggacctgctgagcgagaagcaggagagcctggagaagcagatcaacgacctgaagagcgagaacgacgccctgaacgagaagctgaagagcgaggagcagaagagaagagccagagagaaggccaacctgaagaacccccagatcatgtacctggagcaggagctggagagcctgaaggccgtgctggagatcaagaacgagaagctgcaccagcaggacatcaagctgatgaagatggagaagctggtggacaacaacaccgccctggtggacaagctgaagagattccagcaggagaacgaggagctgaaggccagaatggacaagcacatggccatcagcagacagctgagcaccgagcaggccgtgctgcaggagagcctggagaaggagagcaaggtgaacaagagactgagcatggagaacgaggagctgctgtggaagctgcacaacggcgacctgtgcagccccaagagaagccccaccagcagcgccatccccctgcagagccccagaaacagcggcagcttccccagccccagcatcagccccagatag

SEQ ID NO: 11488 - DNA, 2313 bp, Artificial Sequence
  Description of Artificial Sequence: Synthetic coding sequence
atgaccgacgacaacagcgacgacaagatcgaggacgagctgcagaccttcttcaccagcgacaaggacggcaacacccacgcctacaaccccaagagcccccccacccagaacagcagcgccagcagcgtgaactggaacagcgccaaccccgacgacatggtggtggactacgagaccgaccccgccgtggtgaccggcgagaacatcagcctgagcctgcagggcgtggaggtgttcggccacgagaagagcagcagcgacttcatcagcaagcaggtgctggacatgcacaaggacagcatctgccagtgccccgccctggtgggcaccgagaagcccaagtacctgcagcacagctgccacagcctggaggccgtggagggccagagcgtggagcccagcctgcccttcgtgtggaagcccaacgacaacctgaactgcgccggctactgcgacgccctggagctgaaccagaccttcgacatgaccgtggacaaggtgaactgcaccttcatcagccaccacgccatcggcaagagccagagcttccacaccgccggcagcctgccccccaccggcagaagaagcggcagcaccagcagcctgagctacagcacctggaccagcagccacagcgacaagacccacgccagagagaccacctacgacagagagagcttcgagaacccccaggtgacccccagcgaggcccaggacatgacctacaccgccttcagcgacgtggtgatgcagagcgaggtgttcgtgagcgacatcggcaaccagtgcgcctgcagcagcggcaaggtgaccagcgagtacaccgacggcagccagcagagactggtgggcgagaaggagacccaggccctgacccccgtgagcgacggcatggaggtgcccaacgacagcgccctgcaggagttcttctgcctgagccacgacgagagcaacagcgagccccacagccagagcagctacagacacaaggagatgggccagaacctgagagagaccgtgagctactgcctgatcgacgacgagtgccccctgatggtgcccgccttcgacaagagcgaggcccaggtgctgaaccccgagcacaaggtgaccgagaccgaggacacccagatggtgagcaagggcaaggacctgggcacccagaaccacaccagcgagctgatcctgagcagcccccccggccagaaggtgggcagcagcttcggcctgacctgggacgccaacgacatggtgatcagcaccgacaagaccatgtgcatgagcacccccgtgctggagcccaccaaggtgaccttcagcgtgagccccatcgaggccaccgagaagtgcaagaaggtggagaagggcaacagaggcctgaagaacatccccgacagcaaggaggcccccgtgaacctgtgcaagcccagcctgggcaagagcaccatcaagaccaacacccccatcggctgcaaggtgagaaagaccgagatcatcagctaccccagacccaacttcaagaacgtgaaggccaaggtgatgagcagagccgtgctgcagcccaaggacgccgccctgagcaaggtgacccccagaccccagcagaccagcgccagcagccccagcagcgtgaacagcagacagcagaccgtgctgagcagaacccccagaagcgacctgaacgccgacaagaaggccgagatcctgatcaacaagacccacaagcagcagttcaacaagctgatcaccagccaggccgtgcacgtgaccacccacagcaagaacgccagccacagagtgcccagaaccaccagcgccgtgaagagcaaccaggaggacgtggacaaggccagcagcagcaacagcgcctgcgagaccggcagcgtgagcgccctgttccagaagatcaagggcatcctgcccgtgaagatggagagcgccgagtgcctggagatgacctacgtgcccaacatcgacagaatcagccccgagaagaagggcgagaaggagaacggcaccagcatggagaagcaggagctgaagcaggagatcatgaacgagaccttcgagtacggcagcctgttcctgggcagcgccagcaagaccaccaccaccagcggcagaaacatcagcaagcccgacagctgcggcctgagacagatcgccgcccccaaggccaaggtgggcccccccgtgagctgcctgagaagaaacagcgacaacagaaaccccagcgccgacagagccgtgagcccccagagaatcagaagagtgagcagcagcgtgctgcccaaggccgccttcagctag

SEQ ID NO: 11489 - DNA, 3651 bp, Artificial Sequence
  Description of Artificial Sequence: Synthetic coding sequence
atgaccgacgacaacagcgacgacaagatcgaggacgagctgcagaccttcttcaccagcgacaaggacggcaacacccacgcctacaaccccaagagcccccccacccagaacagcagcgccagcagcgtgaactggaacagcgccaaccccgacgacatggtggtggactacgagaccgaccccgccgtggtgaccggcgagaacatcagcctgagcctgcagggcgtggaggtgttcggccacgagaagagcagcagcgacttcatcagcaagcaggtgctggacatgcacaaggacagcatctgccagtgccccgccctggtgggcaccgagaagcccaagtacctgcagcacagctgccacagcctggaggccgtggagggccagagcgtggagcccagcctgcccttcgtgtggaagcccaacgacaacctgaactgcgccggctactgcgacgccctggagctgaaccagaccttcgacatgaccgtggacaaggtgaactgcaccttcatcagccaccacgccatcggcaagagccagagcttccacaccgccggcagcctgccccccaccggcagaagaagcggcagcaccagcagcctgagctacagcacctggaccagcagccacagcgacaagacccacgccagagagaccacctacgacagagagagcttcgagaacccccaggtgacccccagcgaggcccaggacatgacctacaccgccttcagcgacgtggtgatgcagagcgaggtgttcgtgagcgacatcggcaaccagtgcgcctgcagcagcggcaaggtgaccagcgagtacaccgacggcagccagcagagactggtgggcgagaaggagacccaggccctgacccccgtgagcgacggcatggaggtgcccaacgacagcgccctgcaggagttcttctgcctgagccacgacgagagcaacagcgagccccacagccagagcagctacagacacaaggagatgggccagaacctgagagagaccgtgagctactgcctgatcgacgacgagtgccccctgatggtgcccgccttcgacaagagcgaggcccaggtgctgaaccccgagcacaaggtgaccgagaccgaggacacccagatggtgagcaagggcaaggacctgggcacccagaaccacaccagcgagctgatcctgagcagcccccccggccagaaggtgggcagcagcttcggcctgacctgggacgccaacgacatggtgatcagcaccgacaagaccatgtgcatgagcacccccgtgctggagcccaccaaggtgaccttcagcgtgagccccatcgaggccaccgagaagtgcaagaaggtggagaagggcaacagaggcctgaagaacatccccgacagcaaggaggcccccgtgaacctgtgcaagcccagcctgggcaagagcaccatcaagaccaacacccccatcggctgcaaggtgagaaagaccgagatcatcagctaccccagacccaacttcaagaacgtgaaggccaaggtgatgagcagagccgtgctgcagcccaaggacgccgccctgagcaaggtgacccccagaccccagcagaccagcgccagcagccccagcagcgtgaacagcagacagcagaccgtgctgagcagaacccccagaagcgacctgaacgccgacaagaaggccgagatcctgatcaacaagacccacaagcagcagttcaacaagctgatcaccagccaggccgtgcacgtgaccacccacagcaagaacgccagccacagagtgcccagaaccaccagcgccgtgaagagcaaccaggaggacgtggacaaggccagcagcagcaacagcgcctgcgagaccggcagcgtgagcgccctgttccagaagatcaagggcatcctgcccgtgaagatggagagcgccgagtgcctggagatgacctacgtgcccaacatcgacagaatcagccccgagaagaagggcgagaaggagaacggcaccagcatggagaagcaggagctgaagcaggagatcatgaacgagaccttcgagtacggcagcctgttcctgggcagcgccagcaagaccaccaccaccagcggcagaaacatcagcaagcccgacagctgcggcctgagacagatcgccgcccccaaggccaaggtgggcccccccgtgagctgcctgagaagaaacagcgacaacagaaaccccagcgccgacagagccgtgagcccccagagaatcagaagagtgagcagcagcgccggcaacgccgccgtgatcaagtacgaggagaagccccccaagcccgccttccagaacggcagcagcggcagcttctacctgaagcccctggtgagcagagcccacgtgcacctgatgaagaccccccccaagggccccagcagaaagaacctgttcaccgccctgaacgccgtggagaagagcagacagaagaaccccagaagcctgtgcatccagccccagaccgcccccgacgccctgccccccgagaagaccctggagctgacccagtacaagaccaagtgcgagaaccagagcggcttcatcctgcagctgaagcagctgctggcctgcggcaacaccaagttcgaggccctgaccgtggtgatccagcacctgctgagcgagagagaggaggccctgaagcagcacaagaccctgagccaggagctggtgaacctgagaggcgagctggtgaccgccagcaccacctgcgagaagctggagaaggccagaaacgagctgcagaccgtgtacgaggccttcgtgcagcagcaccaggccgagaagaccgagagagagaacagactgaaggagttctacaccagagagtacgagaagctgagagacacctacatcgaggaggccgagaagtacaagatgcagctgcaggagcagttcgacaacctgaacgccgcccacgagaccagcaagctggagatcgaggccagccacagcgagaagctggagctgctgaagaaggcctacgaggccagcctgagcgagatcaagaagggccacgagatcgagaagaagagcctggaggacctgctgagcgagaagcaggagagcctggagaagcagatcaacgacctgaagagcgagaacgacgccctgaacgagaagctgaagagcgaggagcagaagagaagagccagagagaaggccaacctgaagaacccccagatcatgtacctggagcaggagctggagagcctgaaggccgtgctggagatcaagaacgagaagctgcaccagcaggacatcaagctgatgaagatggagaagctggtggacaacaacaccgccctggtggacaagctgaagagattccagcaggagaacgaggagctgaaggccagaatggacaagcacatggccatcagcagacagctgagcaccgagcaggccgtgctgcaggagagcctggagaaggagagcaaggtgaacaagagactgagcatggagaacgaggagctgctgtggaagctgcacaacggcgacctgtgcagccccaagagaagccccaccagcagcgccatccccctgcagagccccagaaacagcggcagcttccccagccccagcatcagccccagatag

SEQ ID NO: 11490 - DNA, 1029 bp, Artificial Sequence
  Description of Artificial Sequence: Synthetic coding sequence
atgggctgccccagcagcaagctgtgcctgtacagcccctgcgccgccaccagaagagaggaggccctgaagcagcacaagaccctgagccaggagctggtgaacctgagaggcgagctggtgaccgccagcaccacctgcgagaagctggagaaggccagaaacgagctgcagaccgtgtacgaggccttcgtgcagcagcaccaggccgagaagaccgagagagagaacagactgaaggagttctacaccagagagtacgagaagctgagagacacctacatcgaggaggccgagaagtacaagatgcagctgcaggagcagttcgacaacctgaacgccgcccacgagaccagcaagctggagatcgaggccagccacagcgagaagctggagctgctgaagaaggcctacgaggccagcctgagcgagatcaagaagggccacgagatcgagaagaagagcctggaggacctgctgagcgagaagcaggagagcctggagaagcagatcaacgacctgaagagcgagaacgacgccctgaacgagaagctgaagagcgaggagcagaagagaagagccagagagaaggccaacctgaagaacccccagatcatgtacctggagcaggagctggagagcctgaaggccgtgctggagatcaagaacgagaagctgcaccagcaggacatcaagctgatgaagatggagaagctggtggacaacaacaccgccctggtggacaagctgaagagattccagcaggagaacgaggagctgaaggccagaatggacaagcacatggccatcagcagacagctgagcaccgagcaggccgtgctgcaggagagcctggagaaggagagcaaggtgaacaagagactgagcatggagaacgaggagctgctgtggaagctgcacaacggcgacctgtgcagccccaagagaagccccaccagcagcgccatccccctgcagagccccagaaacagcggcagcttccccagccccagcatcagccccagatag

SEQ ID NO: 11491 - DNA, 3651 bp, Artificial Sequence; identical to SEQ ID NO: 11489
  Description of Artificial Sequence: Synthetic coding sequence

SEQ ID NO: 11492 - DNA, 1248 bp, Artificial Sequence
  Description of Artificial Sequence: Synthetic coding sequence
atgaagaccccccccaagggccccagcagaaagaacctgttcaccgccctgaacgccgtggagaagagcagacagaagaaccccagaagcctgtgcatccagccccagaccgcccccgacgccctgccccccgagaagaccctggagctgacccagtacaagaccaagtgcgagaaccagagcggcttcatcctgcagctgaagcagctgctggcctgcggcaacaccaagttcgaggccctgaccgtggtgatccagcacctgctgagcgagagagaggaggccctgaagcagcacaagaccctgagccaggagctggtgaacctgagaggcgagctggtgaccgccagcaccacctgcgagaagctggagaaggccagaaacgagctgcagaccgtgtacgaggccttcgtgcagcagcaccaggccgagaagaccgagagagagaacagactgaaggagttctacaccagagagtacgagaagctgagagacacctacatcgaggaggccgagaagtacaagatgcagctgcaggagcagttcgacaacctgaacgccgcccacgagaccagcaagctggagatcgaggccagccacagcgagaagctggagctgctgaagaaggcctacgaggccagcctgagcgagatcaagaagggccacgagatcgagaagaagagcctggaggacctgctgagcgagaagcaggagagcctggagaagcagatcaacgacctgaagagcgagaacgacgccctgaacgagaagctgaagagcgaggagcagaagagaagagccagagagaaggccaacctgaagaacccccagatcatgtacctggagcaggagctggagagcctgaaggccgtgctggagatcaagaacgagaagctgcaccagcaggacatcaagctgatgaagatggagaagctggtggacaacaacaccgccctggtggacaagctgaagagattccagcaggagaacgaggagctgaaggccagaatggacaagcacatggccatcagcagacagctgagcaccgagcaggccgtgctgcaggagagcctggagaaggagagcaaggtgaacaagagactgagcatggagaacgaggagctgctgtggaagctgcacaacggcgacctgtgcagccccaagagaagccccaccagcagcgccatccccctgcagagccccagaaacagcggcagcttccccagccccagcatcagccccagatag

SEQ ID NO: 11493 - DNA, 7407 bp, Artificial Sequence
  Description of Artificial Sequence: Synthetic coding sequence
atggccaccgtggtggtggaggccaccgagcccgagcccagcggcagcatcgccaaccccgccgccagcaccagccccagcctgagccacagattcctggacagcaagttctacctgctggtggtggtgggcgagatcgtgaccgaggagcacctgagaagagccatcggcaacatcgagctgggcatcagaagctgggacaccaacctgatcgagtgcaacctggaccaggagctgaagctgttcgtgagcagacacagcgccagattcagccccgaggtgcccggccagaagatcctgcaccacagaagcgacgtgctggagaccgtggtgctgatcaaccccagcgacgaggccgtgagcaccgaggtgagactgatgatcaccgacgccgccagacacaagctgctggtgctgaccggccagtgcttcgagaacaccggcgagctgatcctgcagagcggcagcttcagcttccagaacttcatcgagatcttcaccgaccaggagatcggcgagctgctgagcaccacccaccccgccaacaaggccagcctgaccctgttctgccccgaggagggcgactggaagaacagcaacctggacagacacaacctgcaggacttcatcaacatcaagctgaacagcgccagcatcctgcccgagatggagggcctgagcgagttcaccgagtacctgagcgagagcgtggaggtgcccagccccttcgacatcctggagccccccaccagcggcggcttcctgaagctgagcaagccctgctgctacatcttccccggcggcagaggcgacagcgccctgttcgccgtgaacggcttcaacatgctgatcaacggcggcagcgagagaaagagctgcttctggaagctgatcagacacctggacagagtggacagcatcctgctgacccacatcggcgacgacaacctgcccggcatcaacagcatgctgcagagaaagatcgccgagctggaggaggagcagagccagggcagcaccaccaacagcgactggatgaagaacctgatcagccccgacctgggcgtggtgttcctgaacgtgcccgagaacctgaagaaccccgagcccaacatcaagatgaagagaagcatcgaggaggcctgcttcaccctgcagtacctgaacaagctgagcatgaagcccgagcccctgttcagaagcgtgggcaacaccatcgaccccgtgatcctgttccagaagatgggcgtgggcaagctggagatgtacgtgctgaaccccgtgaagagcagcaaggagatgcagtacttcatgcagcagtggaccggcaccaacaaggacaaggccgagttcatcctgcccaacggccaggaggtggacctgcccatcagctacctgaccagcgtgagcagcctgatcgtgtggcaccccgccaaccccgccgagaagatcatcagagtgctgttccccggcaacagcacccagtacaacatcctggagggcctggagaagctgaagcacctggacttcctgaagcagcccctggccacccagaaggacctgaccggccaggtgcccacccccgtggtgaagcagaccaagctgaagcagagagccgacagcagagagagcctgaagcccgccgccaagcccctgcccagcaagagcgtgagaaaggagagcaaggaggagacccccgaggtgaccaaggtgaaccacgtggagaagccccccaaggtggagagcaaggagaaggtgatggtgaagaaggacaagcccatcaagaccgagaccaagcccagcgtgaccgagaaggaggtgcccagcaaggaggagcccagccccgtgaaggccgaggtggccgagaagcaggccaccgacgtgaagcccaaggccgccaaggagaagaccgtgaagaaggagaccaaggtgaagcccgaggacaagaaggaggagaaggagaagcccaagaaggaggtggccaagaaggaggacaagacccccatcaagaaggaggagaagcccaagaaggaggaggtgaagaaggaggtgaagaaggagatcaagaaggaggagaagaaggagcccaagaaggaggtgaagaaggagaccccccccaaggaggtgaagaaggaggtgaagaaggaggagaagaaggaggtgaagaaggaggagaaggagcccaagaaggagatcaagaagctgcccaaggacgccaagaagagcagcacccccctgagcgaggccaagaagcccgccgccctgaagcccaaggtgcccaagaaggaggagagcgtgaagaaggacagcgtggccgccggcaagcccaaggagaagggcaagatcaaggtgatcaagaaggagggcaaggccgccgaggccgtggccgccgccgtgggcaccggcgccaccaccgccgccgtgatggccgccgccggcatcgccgccatcggccccgccaaggagctggaggccgagagaagcctgatgagcagccccgaggacctgaccaaggacttcgaggagctgaaggccgaggaggtggacgtgaccaaggacatcaagccccagctggagctgatcgaggacgaggagaagctgaaggagaccgagcccgtggaggcctacgtgatccagaaggagagagaggtgaccaagggccccgccgagagccccgacgagggcatcaccaccaccgagggcgagggcgagtgcgagcagacccccgaggagctggagcccgtggagaagcagggcgtggacgacatcgagaagttcgaggacgagggcgccggcttcgaggagagcagcgagaccggcgactacgaggagaaggccgagaccgaggaggccgaggagcccgaggaggacggcgaggagcacgtgtgcgtgagcgccagcaagcacagccccaccgaggacgaggagagcgccaaggccgaggccgacgcctacatcagagagaagagagagagcgtggccagcggcgacgacagagccgaggaggacatggacgaggccatcgagaagggcgaggccgagcagagcgaggaggaggccgacgaggaggacaaggccgaggacgccagagaggaggagtacgagcccgagaagatggaggccgaggactacgtgatggccgtggtggacaaggccgccgaggccggcggcgccgaggagcagtacggcttcctgaccacccccaccaagcagctgggcgcccagagccccggcagagagcccgccagcagcatccacgacgagaccctgcccggcggcagcgagagcgaggccaccgccagcgacgaggagaacagagaggaccagcccgaggagttcaccgccaccagcggctacacccagagcaccatcgagatcagcagcgagcccacccccatggacgagatgagcacccccagagacgtgatgagcgacgagaccaacaacgaggagaccgagagccccagccaggagttcgtgaacatcaccaagtacgagagcagcctgtacagccaggagtacagcaagcccgccgacgtgacccccctgaacggcttcagcgagggcagcaagaccgacgccaccgacggcaaggactacaacgccagcgccagcaccatcagcccccccagcagcatggaggaggacaagttcagcagaagcgccctgagagacgcctactgcagcgaggtgaaggccagcaccaccctggacatcaaggacagcatcagcgccgtgagcagcgagaaggtgagccccagcaagagccccagcctgagccccagcccccccagccccctggagaagacccccctgggcgagagaagcgtgaacttcagcctgacccccaacgagatcaaggtgagcgccgaggccgaggtggcccccgtgagccccgaggtgacccaggaggtggtggaggagcactgcgccagccccgaggacaagaccctggaggtggtgagccccagccagagcgtgaccggcagcgccggccacaccccctactaccagagccccaccgacgagaagagcagccacctgcccaccgaggtgatcgagaagccccccgccgtgcccgtgagcttcgagttcagcgacgccaaggacgagaacgagagagccagcgtgagccccatggacgagcccgtgcccgacagcgagagccccatcgagaaggtgctgagccccctgagaagcccccccctgatcggcagcgagagcgcctacgagagcttcctgagcgccgacgacaaggccagcggcagaggcgccgagagccccttcgaggagaagagcggcaagcagggcagccccgaccaggtgagccccgtgagcgagatgaccagcaccagcctgtaccaggacaagcaggagggcaagagcaccgacttcgcccccatcaaggaggacttcggccaggagaagaagaccgacgacgtggaggccatgagcagccagcccgccctggccctggacgagagaaagctgggcgacgtgagccccacccagatcgacgtgagccagttcggcagcttcaaggaggacaccaagatgagcatcagcgagggcaccgtgagcgacaagagcgccacccccgtggacgagggcgtggccgaggacacctacagccacatggagggcgtggccagcgtgagcaccgccagcgtggccaccagcagcttccccgagcccaccaccgacgacgtgagccccagcctgcacgccgaggtgggcagcccccacagcaccgaggtggacgacagcctgagcgtgagcgtggtgcagacccccaccaccttccaggagaccgagatgagccccagcaaggaggagtgccccagacccatgagcatcagcccccccgacttcagccccaagaccgccaagagcagaacccccgtgcaggaccacagaagcgagcagagcagcatgagcatcgagttcggccaggagagccccgagcagagcctggccatggacttcagcagacagagccccgaccaccccaccgtgggcgccggcgtgctgcacatcaccgagaacggccccaccgaggtggactacagccccagcgacatgcaggacagcagcctgagccacaagatcccccccatggaggagcccagctacacccaggacaacgacctgagcgagctgatcagcgtgagccaggtggaggccagccccagcaccagcagcgcccacacccccagccagatcgccagccccctgcaggaggacaccctgagcgacgtggccccccccagagacatgagcctgtacgccagcctgaccagcgagaaggtgcagagcctggagggcgagaagctgagccccaagagcgacatcagccccctgacccccagagagagcagccccctgtacagccccaccttcagcgacagcaccagcgccgtgaaggagaagaccgccacctgccacagcagcagcagcccccccatcgacgccgccagcgccgagccctacggcttcagagccagcgtgctgttcgacaccatgcagcaccacctggccctgaacagagacctgagcacccccggcctggagaaggacagcggcggcaagacccccggcgacttcagctacgcctaccagaagcccgaggagaccaccagaagccccgacgaggaggactacgactacgagagctacgagaagaccaccagaaccagcgacgtgggcggctactactacgagaagatcgagagaaccaccaagagccccagcgacagcggctacagctacgagaccatcggcaagaccaccaagacccccgaggacggcgactacagctacgagatcatcgagaagaccaccagaacccccgaggagggcggctacagctacgacatcagcgagaagaccaccagcccccccgaggtgagcggctacagctacgagaagaccgagagaagcagaagactgctggacgacatcagcaacggctacgacgacagcgaggacggcggccacaccctgggcgaccccagctacagctacgagaccaccgagaagatcaccagcttccccgagagcgagggctacagctacgagaccagcaccaagaccaccagaacccccgacaccagcacctactgctacgagaccgccgagaagatcaccagaaccccccaggccagcacctacagctacgagaccagcgacctgtgctacaccgccgagaagaagagccccagcgaggccagacaggacgtggacctgtgcctggtgagcagctgcgagtacaagcaccccaagaccgagctgagccccagcttcatcaaccccaaccccctggagtggttcgccagcgaggagcccaccgaggagagcgagaagcccctgacccagagcggcggcgccccccccccccccggcggcaagcagcagggcagacagtgcgacgagaccccccccaccagcgtgagcgagagcgcccccagccagaccgacagcgacgtgccccccgagaccgaggagtgccccagcatcaccgccgacgccaacatcgacagcgaggacgagagcgagaccatccccaccgacaagaccgtgacctacaagcacatggaccccccccccgcccccgtgcaggacagaagccccagccccagacaccccgacgtgagcatggtggaccccgaggccctggccatcgagcagaacctgggcaaggccctgaagaaggacctgaaggagaagaccaagaccaagaagcccggcaccaagaccaagagcagcagccccgtgaagaagagcgacggcaagagcaagcccctggccgccagccccaagcccgccggcctgaaggagagcagcgacaaggtgagcagagtggccagccccaagaagaaggagagcgtggagaaggccgccaagcccaccaccacccccgaggtgaaggccgccagaggcgaggagaaggacaaggagaccaagaacgccgccaacgccagcgccagcaagagcgccaagaccgccaccgccggccccggcaccaccaagaccaccaagagcagcgccgtgccccccggcctgcccgtgtacctggacctgtgctacatccccaaccacagcaacagcaagaacgtggacgtggagttcttcaagagagtgagaagcagctactacgtggtgagcggcaacgaccccgccgccgaggagcccagcagagccgtgctggacgccctgctggagggcaaggcccagtggggcagcaacatgcaggtgaccctgatccccacccacgacagcgaggtgatgagagagtggtaccaggagacccacgagaagcagcaggacctgaacatcatggtgctggccagcagcagcaccgtggtgatgcaggacgagagcttccccgcctgcaagatcgagctgtag

SEQ ID NO: 11494 - DNA, 432 bp, Artificial Sequence
  Description of Artificial Sequence: Synthetic coding sequence
atgcagcacagaggcttcctgctgctgaccctgctggccctgctggccctgaccagcgccgtggccaagaagaaggacaaggtgaagaagggcggccccggcagcgagtgcgccgagtgggcctggggcccctgcacccccagcagcaaggactgcggcgtgggcttcagagagggcacctgcggcgcccagacccagagaatcagatgcagagtgccctgcaactggaagaaggagttcggcgccgactgcaagtacaagttcgagaactggggcgcctgcgacggcggcaccggcaccaaggtgagacagggcaccctgaagaaggccagatacaacgcccagtgccaggagaccatcagagtgaccaagccctgcacccccaagaccaaggccaaggccaaggccaagaagggcaagggcaaggactag

SEQ ID NO: 11495 - DNA, 432 bp, Artificial Sequence; identical to SEQ ID NO: 11494
  Description of Artificial Sequence: Synthetic coding sequence

SEQ ID NO: 11496 - DNA, 432 bp, Artificial Sequence; identical to SEQ ID NO: 11494
  Description of Artificial Sequence: Synthetic coding sequence

SEQ ID NO: 11497 - DNA, 459 bp, Artificial Sequence
  Description of Artificial Sequence: Synthetic coding sequence
atgcagcacagaggcttcctgctgctgaccctgctggccctgctggccctgaccagcgccgtggccaagaagaaggaggagggcgccctgcagtgcagcgtgcccggcgaccaccccagacaccaggccctgcacccccaggaccagagcaagggccagagccaggagagagagggcaagggcctggacgccaagcccggctgccagggcgcccccggcgtgacctggggcctggcccacgccctgcccctgcccggccccagatgcgacccccccgtgcccagcgtgtgcagcctggccctgatcaaccacgccctgccctgccccagccacagccccgccccccccctgagcgcccagagcggcgagggccagggcatcctgggcagcctgagcctgccccagagcaacgtgagccccagagccagattctgcagcagcccccagttccactactag

SEQ ID NO: 11498 - DNA, 432 bp, Artificial Sequence; identical to SEQ ID NO: 11494
  Description of Artificial Sequence: Synthetic coding sequence

SEQ ID NO: 11499 - DNA, 432 bp, Artificial Sequence; identical to SEQ ID NO: 11494
  Description of Artificial Sequence: Synthetic coding sequence

SEQ ID NO: 11500 - DNA, 432 bp, Artificial Sequence; identical to SEQ ID NO: 11494
  Description of Artificial Sequence: Synthetic coding sequence

SEQ ID NO: 11501 - DNA, 150 bp, Artificial Sequence
  Description of Artificial Sequence: Synthetic coding sequence
atgcagcacagaggcttcctgctgctgaccctgctggccctgctggccctgaccagcgccgtggccaagaagaaggacaaggtgaagaagggcggccccggcagcgagtgcgccgagtgggcctggggcccctgcacccccagcagctag

SEQ ID NO: 11502 - DNA, 396 bp, Artificial Sequence
  Description of Artificial Sequence: Synthetic coding sequence
atgcagcacagaggcttcctgctgctgaccctgctggccctgctggccctgaccagcgccgtggccaagaagaaggacaaggtgaagaagggcggccccggcagcgagtgcgccgagtgggcctggggcccctgcacccccagcagcaaggactgcggcgtgggcttcagagagggcacctgcggcgcccagacccagagaatcagatgcagagtgccctgcaactggaagaaggagttcggcgccgactgcaagtacaagttcgagaactggggcgcctgcgacggcggcaccggcaccaaggtgagacagggcaccctgaagaaggccagatacaacgcccagtgccaggagaccatcagagtgaccaagccctgcacccccaagaccaagtag

SEQ ID NO: 11503 - DNA, 264 bp, Artificial Sequence
  Description of Artificial Sequence: Synthetic coding sequence
atgcagcacagaggcttcctgctgctgaccctgctggccctgctggccctgaccagcgccgtggccaagaagaaggccgactgcaagtacaagttcgagaactggggcgcctgcgacggcggcaccggcaccaaggtgagacagggcaccctgaagaaggccagatacaacgcccagtgccaggagaccatcagagtgaccaagccctgcacccccaagaccaaggccaaggccaaggccaagaagggcaagggcaaggactag

SEQ ID NO: 11504 - DNA, 2715 bp, Artificial Sequence
  Description of Artificial Sequence: Synthetic coding sequence
atggccgagagcagcgagagcttcaccatggccagcagccccgcccagagaagaagaggcaacgaccccctgaccagcagccccggcagaagcagcagaagaaccgacgccctgaccagcagccccggcagagacctgccccccttcgaggacgagagcgagggcctgctgggcaccgagggccccctggaggaggaggaggacggcgaggagctgatcggcgacggcatggagagagactacagagccatccccgagctggacgcctacgaggccgagggcctggccctggacgacgaggacgtggaggagctgaccgccagccagagagaggccgccgagagagccatgagacagagagacagagaggccggcagaggcctgggcagaatgagaagaggcctgctgtacgacagcgacgaggaggacgaggagagacccgccagaaagagaagacaggtggagagagccaccgaggacggcgaggaggacgaggagatgatcgagagcatcgagaacctggaggacctgaagggccacagcgtgagagagtgggtgagcatggccggccccagactggagatccaccacagattcaagaacttcctgagaacccacgtggacagccacggccacaacgtgttcaaggagagaatcagcgacatgtgcaaggagaacagagagagcctggtggtgaactacgaggacctggccgccagagagcacgtgctggcctacttcctgcccgaggcccccgccgagctgctgcagatcttcgacgaggccgccctggaggtggtgctggccatgtaccccaagtacgacagaatcaccaaccacatccacgtgagaatcagccacctgcccctggtggaggagctgagaagcctgagacagctgcacctgaaccagctgatcagaaccagcggcgtggtgaccagctgcaccggcgtgctgccccagctgagcatggtgaagtacaactgcaacaagtgcaacttcgtgctgggccccttctgccagagccagaaccaggaggtgaagcccggcagctgccccgagtgccagagcgccggccccttcgaggtgaacatggaggagaccatctaccagaactaccagagaatcagaatccaggagagccccggcaaggtggccgccggcagactgcccagaagcaaggacgccatcctgctggccgacctggtggacagctgcaagcccggcgacgagatcgagctgaccggcatctaccacaacaactacgacggcagcctgaacaccgccaacggcttccccgtgttcgccaccgtgatcctggccaaccacgtggccaagaaggacaacaaggtggccgtgggcgagctgaccgacgaggacgtgaagatgatcaccagcctgagcaaggaccagcagatcggcgagaagatcttcgccagcatcgcccccagcatctacggccacgaggacatcaagagaggcctggccctggccctgttcggcggcgagcccaagaaccccggcggcaagcacaaggtgagaggcgacatcaacgtgctgctgtgcggcgaccccggcaccgccaagagccagttcctgaagtacatcgagaaggtgagcagcagagccatcttcaccaccggccagggcgccagcgccgtgggcctgaccgcctacgtgcagagacaccccgtgagcagagagtggaccctggaggccggcgccctggtgctggccgacagaggcgtgtgcctgatcgacgagttcgacaagatgaacgaccaggacagaaccagcatccacgaggccatggagcagcagagcatcagcatcagcaaggccggcatcgtgaccagcctgcaggccagatgcaccgtgatcgccgccgccaaccccatcggcggcagatacgaccccagcctgaccttcagcgagaacgtggacctgaccgagcccatcatcagcagattcgacatcctgtgcgtggtgagagacaccgtggaccccgtgcaggacgagatgctggccagattcgtggtgggcagccacgtgagacaccaccccagcaacaaggaggaggagggcctggccaacggcagcgccgccgagcccgccatgcccaacacctacggcgtggagcccctgccccaggaggtgctgaagaagtacatcatctacgccaaggagagagtgcaccccaagctgaaccagatggaccaggacaaggtggccaagatgtacagcgacctgagaaaggagagcatggccaccggcagcatccccatcaccgtgagacacatcgagagcatgatcagaatggccgaggcccacgccagaatccacctgagagactacgtgatcgaggacgacgtgaacatggccatcagagtgatgctggagagcttcatcgacacccagaagttcagcgtgatgagaagcatgagaaagaccttcgccagatacctgagcttcagaagagacaacaacgagctgctgctgttcatcctgaagcagctggtggccgagcaggtgacctaccagagaaacagattcggcgcccagcaggacaccatcgaggtgcccgagaaggacctggtggacaaggccagacagatcaacatccacaacctgagcgccttctacgacagcgagctgttcagaatgaacaagttcagccacgacctgaagagaaagatgatcctgcagcagttctag

SEQ ID NO: 11505 - DNA, 2427 bp, Artificial Sequence
  Description of Artificial Sequence: Synthetic coding sequence
atggccgagagcagcgagagcttcaccatggccagcagccccgcccagagaagaagaggcaacgaccccctgaccagcagccccggctggggcctgggcagaatgagaagaggcctgctgtacgacagcgacgaggaggacgaggagagacccgccagaaagagaagacaggtggagagagccaccgaggacggcgaggaggacgaggagatgatcgagagcatcgagaacctggaggacctgaagggccacagcgtgagagagtgggtgagcatggccggccccagactggagatccaccacagattcaagaacttcctgagaacccacgtggacagccacggccacaacgtgttcaaggagagaatcagcgacatgtgcaaggagaacagagagagcctggtggtgaactacgaggacctggccgccagagagcacgtgctggcctacttcctgcccgaggcccccgccgagctgctgcagatcttcgacgaggccgccctggaggtggtgctggccatgtaccccaagtacgacagaatcaccaaccacatccacgtgagaatcagccacctgcccctggtggaggagctgagaagcctgagacagctgcacctgaaccagctgatcagaaccagcggcgtggtgaccagctgcaccggcgtgctgccccagctgagcatggtgaagtacaactgcaacaagtgcaacttcgtgctgggccccttctgccagagccagaaccaggaggtgaagcccggcagctgccccgagtgccagagcgccggccccttcgaggtgaacatggaggagaccatctaccagaactaccagagaatcagaatccaggagagccccggcaaggtggccgccggcagactgcccagaagcaaggacgccatcctgctggccgacctggtggacagctgcaagcccggcgacgagatcgagctgaccggcatctaccacaacaactacgacggcagcctgaacaccgccaacggcttccccgtgttcgccaccgtgatcctggccaaccacgtggccaagaaggacaacaaggtggccgtgggcgagctgaccgacgaggacgtgaagatgatcaccagcctgagcaaggaccagcagatcggcgagaagatcttcgccagcatcgcccccagcatctacggccacgaggacatcaagagaggcctggccctggccctgttcggcggcgagcccaagaaccccggcggcaagcacaaggtgagaggcgacatcaacgtgctgctgtgcggcgaccccggcaccgccaagagccagttcctgaagtacatcgagaaggtgagcagcagagccatcttcaccaccggccagggcgccagcgccgtgggcctgaccgcctacgtgcagagacaccccgtgagcagagagtggaccctggaggccggcgccctggtgctggccgacagaggcgtgtgcctgatcgacgagttcgacaagatgaacgaccaggacagaaccagcatccacgaggccatggagcagcagagcatcagcatcagcaaggccggcatcgtgaccagcctgcaggccagatgcaccgtgatcgccgccgccaaccccatcggcggcagatacgaccccagcctgaccttcagcgagaacgtggacctgaccgagcccatcatcagcagattcgacatcctgtgcgtggtgagagacaccgtggaccccgtgcaggacgagatgctggccagattcgtggtgggcagccacgtgagacaccaccccagcaacaaggaggaggagggcctggccaacggcagcgccgccgagcccgccatgcccaacacctacggcgtggagcccctgccccaggaggtgctgaagaagtacatcatctacgccaaggagagagtgcaccccaagctgaaccagatggaccaggacaaggtggccaagatgtacagcgacctgagaaaggagagcatggccaccggcagcatccccatcaccgtgagacacatcgagagcatgatcagaatggccgaggcccacgccagaatccacctgagagactacgtgatcgaggacgacgtgaacatggccatcagagtgatgctggagagcttcatcgacacccagaagttcagcgtgatgagaagcatgagaaagaccttcgccagatacctgagcttcagaagagacaacaacgagctgctgctgttcatcctgaagcagctggtggccgagcaggtgacctaccagagaaacagattcggcgcccagcaggacaccatcgaggtgcccgagaaggacctggtggacaaggccagacagatcaacatccacaacctgagcgccttctacgacagcgagctgttcagaatgaacaagttcagccacgacctgaagagaaagatgatcctgcagcagttctag

SEQ ID NO: 11506 - DNA, 2865 bp, Artificial Sequence
  Description of Artificial Sequence: Synthetic coding sequence
atggccgagagcagcgagagcttcaccatggccagcagccccgcccagagaagaagaggcaacgaccccctgaccagcagccccggcagaagcagcagaagaaccgacgccctgaccagcagccccggcagagacctgccccccttcgaggacgagagcgagggcctgctgggcaccgagggccccctggaggaggaggaggacggcgaggagctgatcggcgacggcatggagagagactacagagccatccccgagctggacgcctacgaggccgagggcctggccctggacgacgaggacgtggaggagctgaccgccagccagagagaggccggcagaggcctgctgtacgacagcgacgaggaggacgaggagagacccgccagaaagagaagacaggtggagagagccaccgaggacggcgaggaggacgaggagatgatcgagagcatcgagaacctggaggacctgaagggccacagcgtgagagagtgggtgagcatggccggccccagactggagatccaccacagattcaagaacttcctgagaacccacgtggacagccacggccacaacgtgttcaaggagagaatcagcgacatgtgcaaggagaacagagagagcctggtggtgaactacgaggacctggccgccagagagcacgtgctggcctacttcctgcccgaggcccccgccgagctgctgcagatcttcgacgaggccgccctggaggtggtgctggccatgtaccccaagtacgacagaatcaccaaccacatccacgtgagaatcagccacctgcccctggtggaggagctgagaagcctgagacagctgcacctgaaccagctgatcagaaccagcggcgtggtgaccagctgcaccggcgtgctgccccagctgagcatggtgaagtacaactgcaacaagtgcaacttcgtgctgggccccttctgccagagccagaaccaggaggtgaagcccggcagctgccccgagtgccagagcgccggccccttcgaggtgaacatggaggagaccatctaccagaactaccagagaatcagaatccaggagagccccggcaaggtggccgccggcagactgcccagaagcaaggacgccatcctgctggccgacctggtggacagctgcaagcccggcgacgagatcgagctgaccggcatctaccacaacaactacgacggcagcctgaacaccgccaacggcttccccgtgttcgccaccgtgatcctggccaaccacgtggccaagaaggacaacaaggtggccgtgggcgagctgaccgacgaggacgtgaagatgatcaccagcctgagcaaggaccagcagatcggcgagaaggagagcagcagaaacgccagcctggccgaggccggcatcggcgccatccccagccagctgctggccatcgagcccagcctgagaagaagcggcgtgcccatcggcgaggtgggcgtgagccagagacaggaggccagaagcttcagcagcgccaacacccactggttcctggaggacctgctgggccccagctgcagagacaccatgatcttcgccagcatcgcccccagcatctacggccacgaggacatcaagagaggcctggccctggccctgttcggcggcgagcccaagaaccccggcggcaagcacaaggtgagaggcgacatcaacgtgctgctgtgcggcgaccccggcaccgccaagagccagttcctgaagtacatcgagaaggtgagcagcagagccatcttcaccaccggccagggcgccagcgccgtgggcctgaccgcctacgtgcagagacaccccgtgagcagagagtggaccctggaggccggcgccctggtgctggccgacagaggcgtgtgcctgatcgacgagttcgacaagatgaacgaccaggacagaaccagcatccacgaggccatggagcagcagagcatcagcatcagcaaggccggcatcgtgaccagcctgcaggccagatgcaccgtgatcgccgccgccaaccccatcggcggcagatacgaccccagcctgaccttcagcgagaacgtggacctgaccgagcccatcatcagcagattcgacatcctgtgcgtggtgagagacaccgtggaccccgtgcaggacgagatgctggccagattcgtggtgggcagccacgtgagacaccaccccagcaacaaggaggaggagggcctggccaacggcagcgccgccgagcccgccatgcccaacacctacggcgtggagcccctgccccaggaggtgctgaagaagtacatcatctacgccaaggagagagtgcaccccaagctgaaccagatggaccaggacaaggtggccaagatgtacagcgacctgagaaaggagagcatggccaccggcagcatccccatcaccgtgagacacatcgagagcatgatcagaatggccgaggcccacgccagaatccacctgagagactacgtgatcgaggacgacgtgaacatggccatcagagtgatgctggagagcttcatcgacacccagaagttcagcgtgatgagaagcatgagaaagaccttcgccagatacctgagcttcagaagagacaacaacgagctgctgctgttcatcctgaagcagctggtggccgagcaggtgacctaccagagaaacagattcggcgcccagcaggacaccatcgaggtgcccgagaaggacctggtggacaaggccagacagatcaacatccacaacctgagcgccttctacgacagcgagctgttcagaatgaacaagttcagccacgacctgaagagaaagatgatcctgcagcagttctag

SEQ ID NO: 11507 - DNA, 753 bp, Artificial Sequence
  Description of Artificial Sequence: Synthetic coding sequence
atggccctgagagccggcctggtgctgggcttccacaccctgatgaccctgctgagcccccaggaggccggcgccaccaaggccgaccacatgggcagctacggccccgccttctaccagagctacggcgccagcggccagttcacccacgagttcgacgaggagcagctgttcagcgtggacctgaagaagagcgaggccgtgtggagactgcccgagttcggcgacttcgccagattcgacccccagggcggcctggccggcatcgccgccatcaaggcccacctggacatcctggtggagagaagcaacagaagcagagccatcaacgtgccccccagagtgaccgtgctgcccaagagcagagtggagctgggccagcccaacatcctgatctgcatcgtggacaacatcttcccccccgtgatcaacatcacctggctgagaaacggccagaccgtgaccgagggcgtggcccagaccagcttctacagccagcccgaccacctgttcagaaagttccactacctgcccttcgtgcccagcgccgaggacgtgtacgactgccaggtggagcactggggcctggacgcccccctgctgagacactgggagctgcaggtgcccatccccccccccgacgccatggagaccctggtgtgcgccctgggcctggccatcggcctggtgggcttcctggtgggcaccgtgctgatcatcatgggcacctacgtgagcagcgtgcccagatag

SEQ ID NO: 11508 - DNA, 993 bp, Artificial Sequence
  Description of Artificial Sequence: Synthetic coding sequence
atgcacagatacagagcccccggcgagcaggacggcgacgccatgcccctgggcagcgccgtggacatcctggccaccgacgaccccaacttcagccaggaggaccagcaggacacccagatctacgagaagcacgacaacctgctgcacggcaccaagaagaagaaggagaagatggtgagcgccgccttcatgaagaagtacatccacgtggccaagatcatcaagcccgtgctgacccaggagagcgccacctacatcgccgaggagtacagcagactgagaagccaggacagcatgagcagcgacaccgccagaaccagccccgtgaccgccagaaccctggagaccctgatcagactggccaccgcccacgccaaggccagaatgagcaagaccgtggacctgcaggacgccgaggaggccgtggagctggtgcagtacgcctacttcaagaaggtgctggagaaggagaagaagagaaagaagagaagcgaggacgagagcgagaccgaggacgaggaggagaagagccaggaggaccaggagcagaagagaaagagaagaaagaccagacagcccgacgccaaggacggcgacagctacgacccctacgacttcagcgacaccgaggaggagatgccccaggtgcacacccccaagaccgccgacagccaggagaccaaggagagccagaaggtggagctgagcgagagcagagacggcatcagcccctgctgccccggctggagctggacccccggcctgaagcagagcttctacctgagcctgcccaagggctgggactacagacacaagcccctgtgcctgttcgacctgatcctgttcaacgactgcagagtgagcatggtggagggcatccagggcggccccctgggctgcgtgcccggcagcagctgcgccgtgaacagacacgagagcccccacagaatccaccagcccggccagagaagagccctgctgttcagctag

SEQ ID NO: 11509 - DNA, 2289 bp, Artificial Sequence
  Description of Artificial Sequence: Synthetic coding sequence
atgtggagctgcggcagactgagagagatcacctggaccagctggaccaccagactgctgaacaacgccttcgaggagctggtggccttccagagagccctgaaggacttcgtggccagcatcgacgccacctacgccaagcagtacgaggagttctacgtgggcctggagggcagcttcggcagcaagcacgtgagccccagaaccctgaccagctgcttcctgagctgcgtggtgtgcgtggagggcatcgtgaccaagtgcagcctggtgagacccaaggtggtgagaagcgtgcactactgccccgccaccaagaagaccatcgagagaagatacagcgacctgaccaccctggtggccttccccagcagcagcgtgtaccccaccaaggacgaggagaacaaccccctggagaccgagtacggcctgagcgtgtacaaggaccaccagaccatcaccatccaggagatgcccgagaaggcccccgccggccagctgcccagaagcgtggacgtgatcctggacgacgacctggtggacaaggccaagcccggcgacagagtgcaggtggtgggcacctacagatgcctgcccggcaagaagggcggctacaccagcggcaccttcagaaccgtgctgatcgcctgcaacgtgaagcagatgagcaaggacgcccagcccagcttcagcgccgaggacatcgccaagatcaagaagttcagcaagaccagaagcaaggacatcttcgaccagctggccaagagcctggcccccagcatccacggccacgactacgtgaagaaggccatcctgtgcctgctgctgggcggcgtggagagagacctggagaacggcagccacatcagaggcgacatcaacatcctgctgatcggcgaccccagcgtggccaagagccagctgctgagatacgtgctgtgcaccgcccccagagccatccccaccaccggcagaggcagcagcggcgtgggcctgaccgccgccgtgaccaccgaccaggagaccggcgagagaagactggaggccggcgccatggtgctggccgacagaggcgtggtgtgcatcgacgagttcgacaagatgagcgacatggacagaaccgccatccacgaggtgatggagcagggcagagtgaccatcgccaaggccggcatccacgccagactgaacgccagatgcagcgtgctggccgccgccaaccccgtgtacggcagatacgaccagtacaagacccccatggagaacatcggcctgcaggacagcctgctgagcagattcgacctgctgttcatcatgctggaccagatggaccccgagcaggacagagagatcagcgaccacgtgctgagaatgcacagatacagagcccccggcgagcaggacggcgacgccatgcccctgggcagcgccgtggacatcctggccaccgacgaccccaacttcagccaggaggaccagcaggacacccagatctacgagaagcacgacaacctgctgcacggcaccaagaagaagaaggagaagatggtgagcgccgccttcatgaagaagtacatccacgtggccaagatcatcaagcccgtgctgacccaggagagcgccacctacatcgccgaggagtacagcagactgagaagccaggacagcatgagcagcgacaccgccagaaccagccccgtgaccgccagaaccctggagaccctgatcagactggccaccgcccacgccaaggccagaatgagcaagaccgtggacctgcaggacgccgaggaggccgtggagctggtgcagtacgcctacttcaagaaggtgctggagaaggagaagaagagaaagaagagaagcgaggacgagagcgagaccgaggacgaggaggagaagagccaggaggaccaggagcagaagagaaagagaagaaagaccagacagcccgacgccaaggacggcgacagctacgacccctacgacttcagcgacaccgaggaggagatgccccaggtgcacacccccaagaccgccgacagccaggagaccaaggagagccagaaggtggagctgagcgagagcagactgaaggccttcaaggtggccctgctggacgtgttcagagaggcccacgcccagagcatcggcatgaacagactgaccgagagcatcaacagagacagcgaggagcccttcagcagcgtggagatccaggccgccctgagcaagatgcaggacgacaaccaggtgatggtgagcgagggcatcatcttcctgatctag

SEQ ID NO: 11510 - DNA, 987 bp, Artificial Sequence
  Description of Artificial Sequence: Synthetic coding sequence
agatacagagcccccggcgagcaggacggcgacgccatgcccctgggcagcgccgtggacatcctggccaccgacgaccccaacttcagccaggaggaccagcaggacacccagatctacgagaagcacgacaacctgctgcacggcaccaagaagaagaaggagaagatggtgagcgccgccttcatgaagaagtacatccacgtggccaagatcatcaagcccgtgctgacccaggagagcgccacctacatcgccgaggagtacagcagactgagaagccaggacagcatgagcagcgacaccgccagaaccagccccgtgaccgccagaaccctggagaccctgatcagactggccaccgcccacgccaaggccagaatgagcaagaccgtggacctgcaggacgccgaggaggccgtggagctggtgcagtacgcctacttcaagaaggtgctggagaaggagaagaagagaaagaagagaagcgaggacgagagcgagaccgaggacgaggaggagaagagccaggaggaccaggagcagaagagaaagagaagaaagaccagacagcccgacgccaaggacggcgacagctacgacccctacgacttcagcgacaccgaggaggagatgccccaggtgcacacccccaagaccgccgacagccaggagaccaaggagagccagaaggtggagctgagcgagagcagagacggcatcagcccctgctgccccggctggagctggacccccggcctgaagcagagcttctacctgagcctgcccaagggctgggactacagacacaagcccctgtgcctgttcgacctgatcctgttcaacgactgcagagtgagcatggtggagggcatccagggcggccccctgggctgcgtgcccggcagcagctgcgccgtgaacagacacgagagcccccacagaatccaccagcccggccagagaagagccctgctgttcagctag

SEQ ID NO: 11511 - DNA, 2562 bp, Artificial Sequence
  Description of Artificial Sequence: Synthetic coding sequence
atgctgcccagaagcccccccctgcccagaggcaacctgtggtggagagaggagttcggcagcttcagagccggcgtggagagcagctgggagccccccagagacttcggcggcggcagcagcctggccgccggcatggccggcaccgtggtgctggacgacgtggagctgagagaggcccagagagactacctggacttcctggacgacgaggaggaccagggcatctaccagagcaaggtgagagagctgatcagcgacaaccagtacagactgatcgtgaacgtgaacgacctgagaagaaagaacgagaagagagccaacagactgctgaacaacgccttcgaggagctggtggccttccagagagccctgaaggacttcgtggccagcatcgacgccacctacgccaagcagtacgaggagttctacgtgggcctggagggcagcttcggcagcaagcacgtgagccccagaaccctgaccagctgcttcctgagctgcgtggtgtgcgtggagggcatcgtgaccaagtgcagcctggtgagacccaaggtggtgagaagcgtgcactactgccccgccaccaagaagaccatcgagagaagatacagcgacctgaccaccctggtggccttccccagcagcagcgtgtaccccaccaaggacgaggagaacaaccccctggagaccgagtacggcctgagcgtgtacaaggaccaccagaccatcaccatccaggagatgcccgagaaggcccccgccggccagctgcccagaagcgtggacgtgatcctggacgacgacctggtggacaaggccaagcccggcgacagagtgcaggtggtgggcacctacagatgcctgcccggcaagaagggcggctacaccagcggcaccttcagaaccgtgctgatcgcctgcaacgtgaagcagatgagcaaggacgcccagcccagcttcagcgccgaggacatcgccaagatcaagaagttcagcaagaccagaagcaaggacatcttcgaccagctggccaagagcctggcccccagcatccacggccacgactacgtgaagaaggccatcctgtgcctgctgctgggcggcgtggagagagacctggagaacggcagccacatcagaggcgacatcaacatcctgctgatcggcgaccccagcgtggccaagagccagctgctgagatacgtgctgtgcaccgcccccagagccatccccaccaccggcagaggcagcagcggcgtgggcctgaccgccgccgtgaccaccgaccaggagaccggcgagagaagactggaggccggcgccatggtgctggccgacagaggcgtggtgtgcatcgacgagttcgacaagatgagcgacatggacagaaccgccatccacgaggtgatggagcagggcagagtgaccatcgccaaggccggcatccacgccagactgaacgccagatgcagcgtgctggccgccgccaaccccgtgtacggcagatacgaccagtacaagacccccatggagaacatcggcctgcaggacagcctgctgagcagattcgacctgctgttcatcatgctggaccagatggaccccgagcaggacagagagatcagcgaccacgtgctgagaatgcacagatacagagcccccggcgagcaggacggcgacgccatgcccctgggcagcgccgtggacatcctggccaccgacgaccccaacttcagccaggaggaccagcaggacacccagatctacgagaagcacgacaacctgctgcacggcaccaagaagaagaaggagaagatggtgagcgccgccttcatgaagaagtacatccacgtggccaagatcatcaagcccgtgctgacccaggagagcgccacctacatcgccgaggagtacagcagactgagaagccaggacagcatgagcagcgacaccgccagaaccagccccgtgaccgccagaaccctggagaccctgatcagactggccaccgcccacgccaaggccagaatgagcaagaccgtggacctgcaggacgccgaggaggccgtggagctggtgcagtacgcctacttcaagaaggtgctggagaaggagaagaagagaaagaagagaagcgaggacgagagcgagaccgaggacgaggaggagaagagccaggaggaccaggagcagaagagaaagagaagaaagaccagacagcccgacgccaaggacggcgacagctacgacccctacgacttcagcgacaccgaggaggagatgccccaggtgcacacccccaagaccgccgacagccaggagaccaaggagagccagaaggtggagctgagcgagagcagactgaaggccttcaaggtggccctgctggacgtgttcagagaggcccacgcccagagcatcggcatgaacagactgaccgagagcatcaacagagacagcgaggagcccttcagcagcgtggagatccaggccgccctgagcaagatgcaggacgacaaccaggtgatggtgagcgagggcatcatcttcctgatctag

SEQ ID NO: 11512 - DNA, 2592 bp, Artificial Sequence
  Description of Artificial Sequence: Synthetic coding sequence
atgagcagccccgccagcacccccagcagaagaggcagcagaagaggcagagccacccccgcccagacccccagaagcgaggacgccagaagcagccccagccagagaagaagaggcgaggacagcaccagcaccggcgagctgcagcccatgcccaccagccccggcgtggacctgcagagccccgccgcccaggacgtgctgttcagcagccccccccagatgcacagcagcgccatccccctggacttcgacgtgagcagccccctgacctacggcacccccagcagcagagtggagggcacccccagaagcggcgtgagaggcacccccgtgagacagagacccgacctgggcagcgcccagaagggcctgcaggtggacctgcagagcgacggcgccgccgccgaggacatcgtggccagcgagcagagcctgggccagaagctggtgatctggggcaccgacgtgaacgtggccgcctgcaaggagaacttccagagattcctgcagagattcatcgaccccctggccaaggaggaggagaacgtgggcatcgacatcaccgagcccctgtacatgcagagactgggcgagatcaacgtgatcggcgagcccttcctgaacgtgaactgcgagcacatcaagagcttcgacaagaacctgtacagacagctgatcagctacccccaggaggtgatccccaccttcgacatggccgtgaacgagatcttcttcgacagataccccgacagcatcctggagcaccagatccaggtgagacccttcaacgccctgaagaccaagaacatgagaaacctgaaccccgaggacatcgaccagctgatcaccatcagcggcatggtgatcagaaccagccagctgatccccgagatgcaggaggccttcttccagtgccaggtgtgcgcccacaccaccagagtggagatggacagaggcagaatcgccgagcccagcgtgtgcggcagatgccacaccacccacagcatggccctgatccacaacagaagcctgttcagcgacaagcagatgatcaagctgcaggagagccccgaggacatgcccgccggccagaccccccacaccgtgatcctgttcgcccacaacgacctggtggacaaggtgcagcccggcgacagagtgaacgtgaccggcatctacagagccgtgcccatcagagtgaaccccagagtgagcaacgtgaagagcgtgtacaagacccacatcgacgtgatccactacagaaagaccgacgccaagagactgcacggcctggacgaggaggccgagcagaagctgttcagcgagaagagagtggagctgctgaaggagctgagcagaaagcccgacatctacgagagactggccagcgccctggcccccagcatctacgagcacgaggacatcaagaagggcatcctgctgcagctgttcggcggcaccagaaaggacttcagccacaccggcagaggcaagttcagagccgagatcaacatcctgctgtgcggcgaccccggcaccagcaagagccagctgctgcagtacgtgtacaacctggtgcccagaggccagtacaccagcggcaagggcagcagcgccgtgggcctgaccgcctacgtgatgaaggaccccgagaccagacagctggtgctgcagaccggcgccctggtgctgagcgacaacggcatctgctgcatcgacgagttcgacaagatgaacgagagcaccagaagcgtgctgcacgaggtgatggagcagcagaccctgagcatcgccaaggccggcatcatctgccagctgaacgccagaaccagcgtgctggccgccgccaaccccatcgagagccagtggaaccccaagaagaccaccatcgagaacatccagctgccccacaccctgctgagcagattcgacctgatcttcctgctgctggacccccaggacgaggcctacgacagaagactggcccaccacctggtggccctgtactaccagagcgaggagcaggccgaggaggagctgctggacatggccgtgctgaaggactacatcgcctacgcccacagcaccatcatgcccagactgagcgaggaggccagccaggccctgatcgaggcctacgtggacatgagaaagatcggcagcagcagaggcatggtgagcgcctaccccagacagctggagagcctgatcagactggccgaggcccacgccaaggtgagactgagcaacaaggtggaggccatcgacgtggaggaggccaagagactgcacagagaggccctgaagcagagcgccaccgaccccagaaccggcatcgtggacatcagcatcctgaccaccggcatgagcgccaccagcagaaagagaaaggaggagctggccgaggccctgaagaagctgatcctgagcaagggcaagacccccgccctgaagtaccagcagctgttcgaggacatcagaggccagagcgacatcgccatcaccaaggacatgttcgaggaggccctgagagccctggccgacgacgacttcctgaccgtgaccggcaagaccgtgagactgctgtag

SEQ ID NO: 11513 - DNA, 2472 bp, Artificial Sequence
  Description of Artificial Sequence: Synthetic coding sequence
atgcccggccacctgcccctgagagacgtggaggccagaatccccccccccagaggcagctgcagcagatgccagcccagactggagtggacctgcagagccctgctgagaagaacctgctgcttccccgccctgcccaagtgcatcctgcagctgagcctgctgaccctgatgctggagggcacccccagaagcggcgtgagaggcacccccgtgagacagagacccgacctgggcagcgcccagaagggcctgcaggtggacctgcagagcgacggcgccgccgccgaggacatcgtggccagcgagcagagcctgggccagaagctggtgatctggggcaccgacgtgaacgtggccgcctgcaaggagaacttccagagattcctgcagagattcatcgaccccctggccaaggaggaggagaacgtgggcatcgacatcaccgagcccctgtacatgcagagactgggcgagatcaacgtgatcggcgagcccttcctgaacgtgaactgcgagcacatcaagagcttcgacaagaacctgtacagacagctgatcagctacccccaggaggtgatccccaccttcgacatggccgtgaacgagatcttcttcgacagataccccgacagcatcctggagcaccagatccaggtgagacccttcaacgccctgaagaccaagaacatgagaaacctgaaccccgaggacatcgaccagctgatcaccatcagcggcatggtgatcagaaccagccagctgatccccgagatgcaggaggccttcttccagtgccaggtgtgcgcccacaccaccagagtggagatggacagaggcagaatcgccgagcccagcgtgtgcggcagatgccacaccacccacagcatggccctgatccacaacagaagcctgttcagcgacaagcagatgatcaagctgcaggagagccccgaggacatgcccgccggccagaccccccacaccgtgatcctgttcgcccacaacgacctggtggacaaggtgcagcccggcgacagagtgaacgtgaccggcatctacagagccgtgcccatcagagtgaaccccagagtgagcaacgtgaagagcgtgtacaagacccacatcgacgtgatccactacagaaagaccgacgccaagagactgcacggcctggacgaggaggccgagcagaagctgttcagcgagaagagagtggagctgctgaaggagctgagcagaaagcccgacatctacgagagactggccagcgccctggcccccagcatctacgagcacgaggacatcaagaagggcatcctgctgcagctgttcggcggcaccagaaaggacttcagccacaccggcagaggcaagttcagagccgagatcaacatcctgctgtgcggcgaccccggcaccagcaagagccagctgctgcagtacgtgtacaacctggtgcccagaggccagtacaccagcggcaagggcagcagcgccgtgggcctgaccgcctacgtgatgaaggaccccgagaccagacagctggtgctgcagaccggcgccctggtgctgagcgacaacggcatctgctgcatcgacgagttcgacaagatgaacgagagcaccagaagcgtgctgcacgaggtgatggagcagcagaccctgagcatcgccaaggccggcatcatctgccagctgaacgccagaaccagcgtgctggccgccgccaaccccatcgagagccagtggaaccccaagaagaccaccatcgagaacatccagctgccccacaccctgctgagcagattcgacctgatcttcctgctgctggacccccaggacgaggcctacgacagaagactggcccaccacctggtggccctgtactaccagagcgaggagcaggccgaggaggagctgctggacatggccgtgctgaaggactacatcgcctacgcccacagcaccatcatgcccagactgagcgaggaggccagccaggccctgatcgaggcctacgtggacatgagaaagatcggcagcagcagaggcatggtgagcgcctaccccagacagctggagagcctgatcagactggccgaggcccacgccaaggtgagactgagcaacaaggtggaggccatcgacgtggaggaggccaagagactgcacagagaggccctgaagcagagcgccaccgaccccagaaccggcatcgtggacatcagcatcctgaccaccggcatgagcgccaccagcagaaagagaaaggaggagctggccgaggccctgaagaagctgatcctgagcaagggcaagacccccgccctgaagtaccagcagctgttcgaggacatcagaggccagagcgacatcgccatcaccaaggacatgttcgaggaggccctgagagccctggccgacgacgacttcctgaccgtgaccggcaagaccgtgagactgctgtag

SEQ ID NO: 11514 - DNA, 2592 bp, Artificial Sequence; identical to SEQ ID NO: 11512
  Description of Artificial Sequence: Synthetic coding sequence

SEQ ID NO: 11515 - DNA, 855 bp, Artificial Sequence
  Description of Artificial Sequence: Synthetic coding sequence
atggcccccagactgtgcagcatcagcgtgaccgccagaagactgctgggcggccccggccccagagccggcgacgtggccagcgccgccgccgccagattctacagcaaggacaacgagggcagctggttcagaagcctgttcgtgcacaaggtggaccccagaaaggacgcccacagcaccctgctgagcaagaaggagaccagcaacctgtacaagatccagttccacaacgtgaagcccgagtacctggacgcctacaacagcctgaccgaggccgtgctgcccaagctgcacctggacgaggactacccctgcagcctggtgggcaactggaacacctggtacggcgagcaggaccaggccgtgcacctgtggagattcagcggcggctaccccgccctgatggactgcatgaacaagctgaagaacaacaaggagtacctggagttcagaagagagagaagccagatgctgctgagcagaagaaaccagctgctgctggagttcagcttctggaacgagccccagcccagaatgggccccaacatctacgagctgagaacctacaagctgaagcccggcaccatgatcgagtggggcaacaactgggccagagccatcaagtacagacaggagaaccaggaggccgtgggcggcttcttcagccagatcggcgagctgtacgtggtgcaccacctgtgggcctacaaggacctgcagagcagagaggagaccagaaacgccgcctggagaaagagaggctgggacgagaacgtgtactacaccgtgcccctggtgagacacatggagagcagaatcatgatccccctgaagatcagccccctgcagtag

SEQ ID NO: 11516 - DNA, 2076 bp, Artificial Sequence
  Description of Artificial Sequence: Synthetic coding sequence
atgagcggcttcgacgaccccggcatcttctacagcgacagcttcggcggcgacgcccaggccgacgagggccaggccagaaagagccagctgcagagaagattcaaggagttcctgagacagtacagagtgggcaccgacagaaccggcttcaccttcaagtacagagacgagctgaagagacactacaacctgggcgagtactggatcgaggtggagatggaggacctggccagcttcgacgaggacctggccgactacctgtacaagcagcccgccgagcacctgcagctgagcgacatgatgagccacctggtgaagatccccggcatcatcatcgccgccagcgccgtgagagccaaggccaccagaatcagcatccagtgcagaagctgcagaaacaccctgaccaacatcgccatgagacccggcctggagggctacgccctgcccagaaagtgcaacaccgaccaggccggcagacccaagtgccccctggacccctacttcatcatgcccgacaagtgcaagtgcgtggacttccagaccctgaagctgcaggagctgcccgacgccgtgccccacggcgagatgcccagacacatgcagctgtactgcgacagatacctgtgcgacaaggtggtgcccggcaacagagtgaccatcatgggcatctacagcatcaagaagttcggcctgaccaccagcagaggcagagacagagtgggcgtgggcatcagaagcagctacatcagagtgctgggcatccaggtggacaccgacggcagcggcagaagcttcgccggcgccgtgagcccccaggaggaggaggagttcagaagactggccgccctgcccaacgtgtacgaggtgatcagcaagagcatcgcccccagcatcttcggcggcaccgacatgaagaaggccatcgcctgcctgctgttcggcggcagcagaaagagactgcccgacggcctgaccagaagaggcgacatcaacctgctgatgctgggcgaccccggcaccgccaagagccagctgctgaagttcgtggagaagtgcagccccatcggcgtgtacaccagcggcaagggcagcagcgccgccggcctgaccgccagcgtgatgagagaccccagcagcagaaacttcatcatggagggcggcgccatggtgctggccgacggcggcgtggtgtgcatcgacgagttcgacaagatgagagaggacgacagagtggccatccacgaggccatggagcagcagaccatcagcatcgccaaggccggcatcaccaccaccctgaacagcagatgcagcgtgctggccgccgccaacagcgtgttcggcagatgggacgagaccaagggcgaggacaacatcgacttcatgcccaccatcctgagcagattcgacatgatcttcatcgtgaaggacgagcacaacgaggagagagacgtgatgctggccaagcacgtgatcaccctgcacgtgagcgccctgacccagacccaggccgtggagggcgagatcgacctggccaagctgaagaagttcatcgcctactgcagagtgaagtgcggccccagactgagcgccgaggccgccgagaagctgaagaacagatacatcatcatgagaagcggcgccagacagcacgagagagacagcgacagaagaagcagcatccccatcaccgtgagacagctggaggccatcgtgagaatcgccgaggccctgagcaagatgaagctgcagcccttcgccaccgaggccgacgtggaggaggccctgagactgttccaggtgagcaccctggacgccgccctgagcggcaccctgagcggcgtggagggcttcaccagccaggaggaccaggagatgctgagcagaatcgagaagcagctgaagagaagattcgccatcggcagccaggtgagcgagcacagcatcatcaaggacttcaccaagcagaagtaccccgagcacgccatccacaaggtgctgcagctgatgctgagaagaggcgagatccagcacagaatgcagagaaaggtgctgtacagactgaagtag

SEQ ID NO: 11517 - DNA, 696 bp, Artificial Sequence
  Description of Artificial Sequence: Synthetic coding sequence
atgagcggcttcgacgaccccggcatcttctacagcgacagcttcggcggcgacgcccaggccgacgagggccaggccagaaagagccagctgcagagaagattcaaggagttcctgagacagtacagagtgggcaccgacagaaccggcttcaccttcaagtacagcctggcccccagcctgatcgagcacctgctgcccgccagatactgcagcggctgctgggccgccgccctgaagctggacctggcccccgccagcagagacgagctgaagagacactacaacctgggcgagtactggatcgaggtggagatggaggacctggccagcttcgacgaggacctggccgactacctgtacaagcagcccgccgagcacctgcagctgctggaggaggccgccaaggaggtggccgacgaggtgaccagacccagacccagcggcgaggaggtgctgcaggacatccaggtgatgctgaagagcgacgccagccccagcagcatcagaagcctgaagagcgacatgatgagccacctggtgaagatccccggcatcatcatcgccgccagcgccgtgagagccaaggccaccagaatcagcatccagtgcagaagctgcagaaacaccctgaccaacatcgccatgagacccggcctggagggctacgccctgcccagaaagtgcaacacctag

SEQ ID NO: 11518 - DNA, 1125 bp, Artificial Sequence
  Description of Artificial Sequence: Synthetic coding sequence
atgaacagcagcggcatcaccacctggggcagcaccggcctgagatggagatggagaaccagacccagacccagcggcgaggaggtgctgcaggacatccaggtgatgctgaagagcgacgccagccccagcagcatcagaagcctgaagagcgacatgatgagccacctggtgaagatccccggcatcatcatcgccgccagcgccgtgagagccaaggccaccagaatcagcatccagtgcagaagctgcagaaacaccctgaccaacatcgccatgagacccggcctggagggctacgccctgcccagaaagtgcaacaccgaccaggccggcagacccaagtgccccctggacccctacttcatcatgcccgacaagtgcaagtgcgtggacttccagaccctgaagctgcaggagctgcccgacgccgtgccccacggcgagatgcccagacacatgcagctgtactgcgacagatacctgtgcgacaaggtggtgcccggcaacagagtgaccatcatgggcatctacagcatcaagaagttcggcctgaccaccagcagaggcagagacagagtgggcgtgggcatcagaagcagctacatcagagtgctgggcatccaggtggacaccgacggcagcggcagaagcttcgccggcgccgtgagcccccaggaggaggaggagttcagaagactggccgccctgcccaacgtgtacgaggtgatcagcaagagcatcgcccccagcatcttcggcggcaccgacatgaagaaggccatcgcctgcctgctgttcggcggcagcagaaagagactgcccgacggcctgaccagaagaggcgacatcaacctgctgatgctgggcgaccccggcaccgccaagagccagctgctgaagttcgtggagaagtgcagccccatcggcgtgtacaccagcggcaagggcagcagcgccgccggcctgaccgccagcgtgatgagagaccccagcagcagaaacttcatcatggagggcggcgccatggtgctggccgacggcggcgtggtgtgcatcgacgagttcgacaagcacagagaggccgcccaggcccccctgtgccactggctgcccggcgtgtag

SEQ ID NO: 11519 - DNA, 1788 bp, Artificial Sequence
  Description of Artificial Sequence: Synthetic coding sequence
atgttctacttcagaggctgcggcagatgggtggccgtgagcttcaccaagcagcagttccccctggccagactgagcagcgacagcgccgcccccagaaccccccacttcgacgtgatcgtgatcggcggcggccacgccggcaccgaggccgccaccgccgccgccagatgcggcagcagaaccctgctgctgacccacagagtggacaccatcggccagatgagctgcaaccccagcttcggcggcatcggcaagggccacctgatgagagaggtggacgccctggacggcctgtgcagcagaatctgcgaccagagcggcgtgcactacaaggtgctgaacagaagaaagggccccgccgtgtggggcctgagagcccagatcgacagaaagctgtacaagcagaacatgcagaaggagatcctgaacacccccctgctgaccgtgcaggagggcgccgtggaggacctgatcctgaccgagcccgagcccgagcacaccggcaagtgcagagtgagcggcgtggtgctgcccgaggaccagctgccctgctacctgacccacaccaaccccagagtggacgagatcgtgctgaagaacctgcacctgaacagccacgtgaaggagaccaccagaggccccagatactgccccagcatcgagagcaaggtgctgagattccccaacagactgcaccaggtgtggctggagcccgagggcatggacagcgacctgatctacccccagggcctgagcatgaccctgcccgccgagctgcaggagaagatgatcacctgcatcagaggcctggagaaggccaaggtgatccagcccggctacggcgtgcagtacgactacctggaccccagacagatcacccccagcctggagacccacctggtgcagagactgttcttcgccggccagatcaacggcaccaccggctacgaggaggccgccgcccagggcgtgatcgccggcatcaacgccagcctgagagtgagcagaaagccccccttcgtggtgagcagaaccgagggctacatcggcgtgctgatcgacgacctgaccaccctgggcaccagcgagccctacagaatgttcaccagcagagtggagttcagactgagcctgagacccgacaacgccgacagcagactgaccctgagaggctacaaggacgccggctgcgtgagccagcagagatacgagagagcctgctggatgaagagcagcctggaggagggcatcagcgtgctgaagagcatcgagttcctgagcagcaagtggaagaagctgatccccgaggccagcatcagcaccagcagaagcctgcccgtgagagccctggacgtgctgaagtacgaggaggtggacatggacagcctggccaaggccgtgcccgagcccctgaagaagtacaccaagtgcagagagctggccgagagactgaagatcgaggccacctacgagagcgtgctgttccaccagctgcaggagatcaagggcgtgcagcaggacgaggccctgcagctgcccaaggacctggactacctgaccatcagagacgtgagcctgagccacgaggtgagagagaagctgcacttcagcagaccccagaccatcggcgccgccagcagaatccccggcgtgacccccgccgccatcatcaacctgctgagattcgtgaagaccacccagagaagacagagcgccatgaacgagagcagcaagaccgaccagtacctgtgcgacgccgacagactgcaggagagagagctgtag

SEQ ID NO: 11520 - DNA, 2154 bp, Artificial Sequence
  Description of Artificial Sequence: Synthetic coding sequence
atgttctacttcagaggctgcggcagatgggtggccgtgagcttcaccaagcagcagttccccctggccagactgagcagcgacagcgccgcccccagaaccccccacttcgacgtgatcgtgatcggcggcggccacgccggcaccgaggccgccaccgccgccgccagatgcggcagcagaaccctgctgctgacccacagagtggacaccatcggccagatgagctgcaaccccagcttcggcggcatcggcaagggccacctgatgagagaggtggacgccctggacggcctgtgcagcagaatctgcgaccagagcggcgtgcactacaaggtgctgaacagaagaaagggccccgccgtgtggggcctgagagcccagatcgacagaaagctgtacaagcagaacatgcagaaggagatcctgaacacccccctgctgaccgtgcaggagggcgccgtggaggacctgatcctgaccgagcccgagcccgagcacaccggcaagtgcagagtgagcggcgtggtgctggtggacggcagcaccgtgtacgccgagagcgtgatcctgaccaccggcaccttcctgagaggcatgatcgtgatcggcctggagacccaccccgccggcagactgggcgaccagcccagcatcggcctggcccagaccctggagaagctgggcttcgtggtgggcagactgaagaccggcaccccccccagaatcgccaaggagagcatcaacttcagcatcctgaacaagcacatccccgacaaccccagcatccccttcagcttcaccaacgagaccgtgtggatcaagcccgaggaccagctgccctgctacctgacccacaccaaccccagagtggacgagatcgtgctgaagaacctgcacctgaacagccacgtgaaggagaccaccagaggccccagatactgccccagcatcgagagcaaggtgctgagattccccaacagactgcaccaggtgtggctggagcccgagggcatggacagcgacctgatctacccccagggcctgagcatgaccctgcccgccgagctgcaggagaagatgatcacctgcatcagaggcctggagaaggccaaggtgatccagcccgacggcgtgctgctgctgctgcccagaatggagtgcaacggcgccatcagcgcccaccacaacctgcccctgcccggctacggcgtgcagtacgactacctggaccccagacagatcacccccagcctggagacccacctggtgcagagactgttcttcgccggccagatcaacggcaccaccggctacgaggaggccgccgcccagggcgtgatcgccggcatcaacgccagcctgagagtgagcagaaagccccccttcgtggtgagcagaaccgagggctacatcggcgtgctgatcgacgacctgaccaccctgggcaccagcgagccctacagaatgttcaccagcagagtggagttcagactgagcctgagacccgacaacgccgacagcagactgaccctgagaggctacaaggacgccggctgcgtgagccagcagagatacgagagagcctgctggatgaagagcagcctggaggagggcatcagcgtgctgaagagcatcgagttcctgagcagcaagtggaagaagctgatccccgaggccagcatcagcaccagcagaagcctgcccgtgagagccctggacgtgctgaagtacgaggaggtggacatggacagcctggccaaggccgtgcccgagcccctgaagaagtacaccaagtgcagagagctggccgagagactgaagatcgaggccacctacgagagcgtgctgttccaccagctgcaggagatcaagggcgtgcagcaggacgaggccctgcagctgcccaaggacctggactacctgaccatcagagacgtgagcctgagccacgaggtgagagagaagctgcacttcagcagaccccagaccatcggcgccgccagcagaatccccggcgtgacccccgccgccatcatcaacctgctgagattcgtgaagaccacccagagaagacagagcgccatgaacgagagcagcaagaccgaccagtacctgtgcgacgccgacagactgcaggagagagagctgtag

SEQ ID NO: 11521 - DNA, 1932 bp, Artificial Sequence
  Description of Artificial Sequence: Synthetic coding sequence
atgagctgcaaccccagcttcggcggcatcggcaagggccacctgatgagagaggtggacgccctggacggcctgtgcagcagaatctgcgaccagagcggcgtgcactacaaggtgctgaacagaagaaagggccccgccgtgtggggcctgagagcccagatcgacagaaagctgtacaagcagaacatgcagaaggagatcctgaacacccccctgctgaccgtgcaggagggcgccgtggaggacctgatcctgaccgagcccgagcccgagcacaccggcaagtgcagagtgagcggcgtggtgctggtggacggcagcaccgtgtacgccgagagcgtgatcctgaccaccggcaccttcctgagaggcatgatcgtgatcggcctggagacccaccccgccggcagactgggcgaccagcccagcatcggcctggcccagaccctggagaagctgggcttcgtggtgggcagactgaagaccggcaccccccccagaatcgccaaggagagcatcaacttcagcatcctgaacaagcacatccccgacaaccccagcatccccttcagcttcaccaacgagaccgtgtggatcaagcccgaggaccagctgccctgctacctgacccacaccaaccccagagtggacgagatcgtgctgaagaacctgcacctgaacagccacgtgaaggagaccaccagaggccccagatactgccccagcatcgagagcaaggtgctgagattccccaacagactgcaccaggtgtggctggagcccgagggcatggacagcgacctgatctacccccagggcctgagcatgaccctgcccgccgagctgcaggagaagatgatcacctgcatcagaggcctggagaaggccaaggtgatccagcccgacggcgtgctgctgctgctgcccagaatggagtgcaacggcgccatcagcgcccaccacaacctgcccctgcccggctacggcgtgcagtacgactacctggaccccagacagatcacccccagcctggagacccacctggtgcagagactgttcttcgccggccagatcaacggcaccaccggctacgaggaggccgccgcccagggcgtgatcgccggcatcaacgccagcctgagagtgagcagaaagccccccttcgtggtgagcagaaccgagggctacatcggcgtgctgatcgacgacctgaccaccctgggcaccagcgagccctacagaatgttcaccagcagagtggagttcagactgagcctgagacccgacaacgccgacagcagactgaccctgagaggctacaaggacgccggctgcgtgagccagcagagatacgagagagcctgctggatgaagagcagcctggaggagggcatcagcgtgctgaagagcatcgagttcctgagcagcaagtggaagaagctgatccccgaggccagcatcagcaccagcagaagcctgcccgtgagagccctggacgtgctgaagtacgaggaggtggacatggacagcctggccaaggccgtgcccgagcccctgaagaagtacaccaagtgcagagagctggccgagagactgaagatcgaggccacctacgagagcgtgctgttccaccagctgcaggagatcaagggcgtgcagcaggacgaggccctgcagctgcccaaggacctggactacctgaccatcagagacgtgagcctgagccacgaggtgagagagaagctgcacttcagcagaccccagaccatcggcgccgccagcagaatccccggcgtgacccccgccgccatcatcaacctgctgagattcgtgaagaccacccagagaagacagagcgccatgaacgagagcagcaagaccgaccagtacctgtgcgacgccgacagactgcaggagagagagctgtag

SEQ ID NO: 11522 - DNA, 2199 bp, Artificial Sequence
  Description of Artificial Sequence: Synthetic coding sequence
atgttctacttcagaggctgcggcagatgggtggccgtgagcttcaccaagcagcagttccccctggccagactgagcagcgacagcgccgcccccagaaccccccacttcgacgtgatcgtgatcggcggcggccacgccggcaccgaggccgccaccgccgccgccagatgcggcagcagaaccctgctgctgacccacagagtggacaccatcggccagatgagctgcaaccccagcttcggcggcatcggcaagggccacctgatgagagaggtggacgccctggacggcctgtgcagcagaatctgcgaccagagcggcgtgcactacaaggtgctgaacagaagaaagggccccgccgtgtggggcctgagagcccagatcgacagaaagctgtacaagcagaacatgcagaaggagatcctgaacacccccctgctgaccgtgcaggagggcgccgtggaggacctgatcctgaccgagcccgagcccgagcacaccggcaagtgcagagtgagcggcgtggtgctggtggacggcagcaccgtgtacgccgagagcgtgatcctgaccaccggcaccttcctgagaggcatgatcgtgatcggcctggagacccaccccgccggcagactgggcgaccagcccagcatcggcctggcccagaccctggagaagctgggcttcgtggtgggcagactgaagaccggcaccccccccagaatcgccaaggagagcatcaacttcagcatcctgaacaagcacatccccgacaaccccagcatccccttcagcttcaccaacgagaccgtgtggatcaagcccgaggaccagctgccctgctacctgacccacaccaaccccagagtggacgagatcgtgctgaagaacctgcacctgaacagccacgtgaaggagaccaccagaggccccagatactgccccagcatcgagagcaaggtgctgagattccccaacagactgcaccaggtgtggctggagcccgagggcatggacagcgacctgatctacccccagggcctgagcatgaccctgcccgccgagctgcaggagaagatgatcacctgcatcagaggcctggagaaggccaaggtgatccagcccggctacggcgtgcagtacgactacctggaccccagacagatcacccccagcctggagacccacctggtgcagagactgttcttcgccggccagatcaacggcaccaccggctacgaggaggccgccgcccagaccgagtgctgcagcgtggccagactggagtgcagcgacatgatcagccagctgcaggccatcctgctgccccagcccagcctggtggccggcaccgccggcatgcaccacaacacccagggcgtgatcgccggcatcaacgccagcctgagagtgagcagaaagccccccttcgtggtgagcagaaccgagggctacatcggcgtgctgatcgacgacctgaccaccctgggcaccagcgagccctacagaatgttcaccagcagagtggagttcagactgagcctgagacccgacaacgccgacagcagactgaccctgagaggctacaaggacgccggctgcgtgagccagcagagatacgagagagcctgctggatgaagagcagcctggaggagggcatcagcgtgctgaagagcatcgagttcctgagcagcaagtggaagaagctgatccccgaggccagcatcagcaccagcagaagcctgcccgtgagagccctggacgtgctgaagtacgaggaggtggacatggacagcctggccaaggccgtgcccgagcccctgaagaagtacaccaagtgcagagagctggccgagagactgaagatcgaggccacctacgagagcgtgctgttccaccagctgcaggagatcaagggcgtgcagcaggacgaggccctgcagctgcccaaggacctggactacctgaccatcagagacgtgagcctgagccacgaggtgagagagaagctgcacttcagcagaccccagaccatcggcgccgccagcagaatccccggcgtgacccccgccgccatcatcaacctgctgagattcgtgaagaccacccagagaagacagagcgccatgaacgagagcagcaagaccgaccagtacctgtgcgacgccgacagactgcaggagagagagctgtag

SEQ ID NO: 11523 - DNA, 2079 bp, Artificial Sequence
  Description of Artificial Sequence: Synthetic coding sequence
atgttctacttcagaggctgcggcagatgggtggccgtgagcttcaccaagcagcagttccccctggccagactgagcagcgacagcgccgcccccagaaccccccacttcgacgtgatcgtgatcggcggcggccacgccggcaccgaggccgccaccgccgccgccagatgcggcagcagaaccctgctgctgacccacagagtggacaccatcggccagatgagctgcaaccccagcttcggcggcatcggcaagggccacctgatgagagaggtggacgccctggacggcctgtgcagcagaatctgcgaccagagcggcgtgcactacaaggtgctgaacagaagaaagggccccgccgtgtggggcctgagagcccagatcgacagaaagctgtacaagcagaacatgcagaaggagatcctgaacacccccctgctgaccgtgcaggagggcgccgtggaggacctgatcctgaccgagcccgagcccgagcacaccggcaagtgcagagtgagcggcgtggtgctggtggacggcagcaccgtgtacgccgagagcgtgatcctgaccaccggcaccttcctgagaggcatgatcgtgatcggcctggagacccaccccgccggcagactgggcgaccagcccagcatcggcctggcccagaccctggagaagctgggcttcgtggtgggcagactgaagaccggcaccccccccagaatcgccaaggagagcatcaacttcagcatcctgaacaagcacatccccgacaaccccagcatccccttcagcttcaccaacgagaccgtgtggatcaagcccgaggaccagctgccctgctacctgacccacaccaaccccagagtggacgagatcgtgctgaagaacctgcacctgaacagccacgtgaaggagaccaccagaggccccagatactgccccagcatcgagagcaaggtgctgagattccccaacagactgcaccaggtgtggctggagcccgagggcatggacagcgacctgatctacccccagggcctgagcatgaccctgcccgccgagctgcaggagaagatgatcacctgcatcagaggcctggagaaggccaaggtgatccagcccggctacggcgtgcagtacgactacctggaccccagacagatcacccccagcctggagacccacctggtgcagagactgttcttcgccggccagatcaacggcaccaccggctacgaggaggccgccgcccagggcgtgatcgccggcatcaacgccagcctgagagtgagcagaaagccccccttcgtggtgagcagaaccgagggctacatcggcgtgctgatcgacgacctgaccaccctgggcaccagcgagccctacagaatgttcaccagcagagtggagttcagactgagcctgagacccgacaacgccgacagcagactgaccctgagaggctacaaggacgccggctgcgtgagccagcagagatacgagagagcctgctggatgaagagcagcctggaggagggcatcagcgtgctgaagagcatcgagttcctgagcagcaagtggaagaagctgatccccgaggccagcatcagcaccagcagaagcctgcccgtgagagccctggacgtgctgaagtacgaggaggtggacatggacagcctggccaaggccgtgcccgagcccctgaagaagtacaccaagtgcagagagctggccgagagactgaagatcgaggccacctacgagagcgtgctgttccaccagctgcaggagatcaagggcgtgcagcaggacgaggccctgcagctgcccaaggacctggactacctgaccatcagagacgtgagcctgagccacgaggtgagagagaagctgcacttcagcagaccccagaccatcggcgccgccagcagaatccccggcgtgacccccgccgccatcatcaacctgctgagattcgtgaagaccacccagagaagacagagcgccatgaacgagagcagcaagaccgaccagtacctgtgcgacgccgacagactgcaggagagagagctgtag

SEQ ID NO: 11524 - DNA, 381 bp, Artificial Sequence
  Description of Artificial Sequence: Synthetic coding sequence
atgagcatcggcgtgcccatcaaggtgctgcacgaggccgagggccacatcgtgacctgcgagaccaacaccggcgaggtgtacagaggcaagctgatcgaggccgaggacaacatgaactgccagatgagcaacatcaccgtgacctacagagacggcagagtggcccagctggagcaggtgtacatcagaggcagcaagatcagattcctgatcctgcccgacatgctgaagaacgcccccatgctgaagagcatgaagaacaagaaccagggcagcggcgccggcagaggcaaggccgccatcctgaaggcccaggtggccgccagaggcagaggcagaggcatgggcagaggcaacatcttccagaagagaagatag

SEQ ID NO: 11525 - DNA, 1083 bp, Artificial Sequence
  Description of Artificial Sequence: Synthetic coding sequence
atggccgccgccgccgccgccggcgccggccccgagatggtgagaggccaggtgttcgacgtgggccccagatacaccaacctgagctacatcggcgagggcgcctacggcatggtgtgcagcgcctacgacaacgtgaacaaggtgagagtggccatcaagaagatcagccccttcgagcaccagacctactgccagagaaccctgagagagatcaagatcctgctgagattcagacacgagaacatcatcggcatcaacgacatcatcagagcccccaccatcgagcagatgaaggacgtgtacatcgtgcaggacctgatggagaccgacctgtacaagctgctgaagacccagcacctgagcaacgaccacatctgctacttcctgtaccagatcctgagaggcctgaagtacatccacagcgccaacgtgctgcacagagacctgaagcccagcaacctgctgctgaacaccacctgcgacctgaagatctgcgacttcggcctggccagagtggccgaccccgaccacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacctgaaggccagaaactacctgctgagcctgccccacaagaacaaggtgccctggaacagactgttccccaacgccgacagcaaggccctggacctgctggacaagatgctgaccttcaacccccacaagagaatcgaggtggagcaggccctggcccacccctacctggagcagtactacgaccccagcgacgagcccatcgccgaggcccccttcaagttcgacatggagctggacgacctgcccaaggagaagctgaaggagctgatcttcgaggagaccgccagattccagcccggctacagaagctag

SEQ ID NO: 11526 - DNA, 1047 bp, Artificial Sequence
  Description of Artificial Sequence: Synthetic coding sequence
atggtgagaggccaggtgttcgacgtgggccccagatacaccaacctgagctacatcggcgagggcgcctacggcatggtgtgcagcgcctacgacaacgtgaacaaggtgagagtggccatcaagaagatcagccccttcgagcaccagacctactgccagagaaccctgagagagatcaagatcctgctgagattcagacacgagaacatcatcggcatcaacgacatcatcagagcccccaccatcgagcagatgaaggacgtgtacatcgtgcaggacctgatggagaccgacctgtacaagctgctgaagacccagcacctgagcaacgaccacatctgctacttcctgtaccagatcctgagaggcctgaagtacatccacagcgccaacgtgctgcacagagacctgaagcccagcaacctgctgctgaacaccacctgcgacctgaagatctgcgacttcggcctggccagagtggccgaccccgaccacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacctgaaggccagaaactacctgctgagcctgccccacaagaacaaggtgccctggaacagactgttccccaacgccgacagcaaggccctggacctgctggacaagatgctgaccttcaacccccacaagagaatcgaggtggagcaggccctggcccacccctacctggagcagtactacgaccccagcgacgagcccatcgccgaggcccccttcaagttcgacatggagctggacgacctgcccaaggagaagctgaaggagctgatcttcgaggagaccgccagattccagcccggctacagaagctag

SEQ ID NO: 11527 - DNA, 951 bp, Artificial Sequence
  Description of Artificial Sequence: Synthetic coding sequence
atggccgccgccgccgccgccggcgccggccccgagatggtgagaggccaggtgttcgacgtgggccccagatacaccaacctgagctacatcggcgagggcgcctacggcatggtgtgcagcgcctacgacaacgtgaacaaggtgagagtggccatcaagaagatcagccccttcgagcaccagacctactgccagagaaccctgagagagatcaagatcctgctgagattcagacacgagaacatcatcggcatcaacgacatcatcagagcccccaccatcgagcagatgaaggacgtgtacatcgtgcaggacctgatggagaccgacctgtacaagctgctgaagacccagcacctgagcaacgaccacatctgctacttcctgtaccagatcctgagaggcctgaagtacatccacagcgccaacgtgctgcacagagacctgaagcccagcaacctgctgctgaacaccacctgcgacctgaagatctgcgacttcggcctggccagagtggccgaccccgaccacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctggccctggacctgctggacaagatgctgaccttcaacccccacaagagaatcgaggtggagcaggccctggcccacccctacctggagcagtactacgaccccagcgacgagcccatcgccgaggcccccttcaagttcgacatggagctggacgacctgcccaaggagaagctgaaggagctgatcttcgaggagaccgccagattccagcccggctacagaagctag

SEQ ID NO: 11528 - DNA, 1095 bp, Artificial Sequence
  Description of Artificial Sequence: Synthetic coding sequence
atgagcggccccagagccggcttctacagacaggagctgaacaagaccgtgtgggaggtgccccagagactgcagggcctgagacccgtgggcagcggcgcctacggcagcgtgtgcagcgcctacgacgccagactgagacagaaggtggccgtgaagaagctgagcagacccttccagagcctgatccacgccagaagaacctacagagagctgagactgctgaagcacctgaagcacgagaacgtgatcggcctgctggacgtgttcacccccgccaccagcatcgaggacttcagcgaggtgtacctggtgaccaccctgatgggcgccgacctgaacaacatcgtgaagtgccaggccctgagcgacgagcacgtgcagttcctggtgtaccagctgctgagaggcctgaagtacatccacagcgccggcatcatccacagagacctgaagcccagcaacgtggccgtgaacgaggactgcgagctgagaatcctggacttcggcctggccagacaggccgacgaggagatgaccggctacgtggccaccagatggtacagagcccccgagatcatgctgaactggatgcactacaaccagaccgtggacatctggagcgtgggctgcatcatggccgagctgctgcagggcaaggccctgttccccggcagcgactacatcgaccagctgaagagaatcatggaggtggtgggcacccccagccccgaggtgctggccaagatcagcagcgagcacgccagaacctacatccagagcctgccccccatgccccagaaggacctgagcagcatcttcagaggcgccaaccccctggccatcgacctgctgggcagaatgctggtgctggacagcgaccagagagtgagcgccgccgaggccctggcccacgcctacttcagccagtaccacgaccccgaggacgagcccgaggccgagccctacgacgagagcgtggaggccaaggagagaaccctggaggagtggaaggagctgacctaccaggaggtgctgagcttcaagccccccgagccccccaagccccccggcagcctggagatcgagcagtag

SEQ ID NO: 11529 - DNA, 1095 bp, Artificial Sequence; identical to SEQ ID NO: 11528
  Description of Artificial Sequence: Synthetic coding sequence

SEQ ID NO: 11530 - DNA, 642 bp, Artificial Sequence
  Description of Artificial Sequence: Synthetic coding sequence
atgggcgccgacctgaacaacatcgtgaagtgccaggccctgagcgacgagcacgtgcagttcctggtgtaccagctgctgagaggcctgaagtacatccacagcgccggcatcatccacagagacctgaagcccagcaacgtggccgtgaacgaggactgcgagctgagaatcctggacttcggcctggccagacaggccgacgaggagatgaccggctacgtggccaccagatggtacagagcccccgagatcatgctgaactggatgcactacaaccagaccggcgccggcggcagaccctggggcgacgagggccagggccccagactggccctggactggctgtgcatgcccggcctgagaggccaggccagaagccccagaatgtgggacccccacagcaaggtggccctgcagagacccctggagcacgacggctgctggccccccctggccgtgcagctgtggaccagcccctgcctgggcggcctgggcatggccgaggagggcgtgtgccccagctggggcctggacgtgaccgtgggcctgctggaggagggcagaggcgtgggcaccctgatggaggtgcccagccccagccacagcggctacctggtgagaggcctgcaccacggctag

SEQ ID NO: 11531 - DNA, 1149 bp, Artificial Sequence
  Description of Artificial Sequence: Synthetic coding sequence
atggacttcggcctggccctgctgctggccggcctgctgggcctgctgctgggccagagcctgcaggtgaagcccctgcaggtggagccccccgagcccgtggtggccgtggccctgggcgccagcagacagctgacctgcagactggcctgcgccgacagaggcgccagcgtgcagtggagaggcctggacaccagcctgggcgccgtgcagagcgacaccggcagaagcgtgctgaccgtgagaaacgccagcctgagcgccgccggcaccagagtgtgcgtgggcagctgcggcggcagaaccttccagcacaccgtgcagctgctggtgtacgccttccccgaccagctgaccgtgagccccgccgccctggtgcccggcgaccccgaggtggcctgcaccgcccacaaggtgacccccgtggaccccaacgccctgagcttcagcctgctggtgggcggccaggagctggagggcgcccaggccctgggccccgaggtgcaggaggaggaggaggagccccagggcgacgaggacgtgctgttcagagtgaccgagagatggagactgccccccctgggcacccccgtgccccccgccctgtactgccaggccaccatgagactgcccggcctggagctgagccacagacaggccatccccgtgctgcacagccccaccagccccgagccccccgacaccaccagccccgagagccccgacaccaccagccccgagagccccgacaccaccagccaggagccccccgacaccaccagccccgagccccccgacaagaccagccccgagcccgccccccagcagggcagcacccacacccccagaagccccggcagcaccagaaccagaagacccgagatcagccaggccggccccacccagggcgaggtgatccccaccggcagcagcaagcccgccggcgaccagctgcccgccgccctgtggaccagcagcgccgtgctgggcctgctgctgctggccctgcccacctaccacctgtggaagagatgcagacacctggccgaggacgacacccacccccccgccagcctgagactgctgccccaggtgagcgcctgggccggcctgagaggcaccggccaggtgggcatcagccccagctag

SEQ ID NO: 11532 - DNA, 1074 bp, Artificial Sequence
  Description of Artificial Sequence: Synthetic coding sequence
atgagcagccccccccccgccagaagcggcttctacagacaggaggtgaccaagaccgcctgggaggtgagagccgtgtacagagacctgcagcccgtgggcagcggcgcctacggcgccgtgtgcagcgccgtggacggcagaaccggcgccaaggtggccatcaagaagctgtacagacccttccagagcgagctgttcgccaagagagcctacagagagctgagactgctgaagcacatgagacacgagaacgtgatcggcctgctggacgtgttcacccccgacgagaccctggacgacttcaccgacttctacctggtgatgcccttcatgggcaccgacctgggcaagctgatgaagcacgagaagctgggcgaggacagaatccagttcctggtgtaccagatgctgaagggcctgagagacctgaagcccggcaacctggccgtgaacgaggactgcgagctgaagatcctggacttcggcctggccagacaggccgacagcgagatgaccggctacgtggtgaccagatggtacagagcccccgaggtgatcctgaactggatgagatacacccagaccgtggacatctggagcgtgggctgcatcatggccgagatgatcaccggcaagaccctgttcaagggcagcgaccacctggaccagctgaaggagatcatgaaggtgaccggcaccccccccgccgagttcgtgcagagactgcagagcgacgaggccaagaactacatgaagggcctgcccgagctggagaagaaggacttcgccagcatcctgaccaacgccagccccctggccgtgaacctgctggagaagatgctggtgctggacgccgagcagagagtgaccgccggcgaggccctggcccacccctacttcgagagcctgcacgacaccgaggacgagccccaggtgcagaagtacgacgacagcttcgacgacgtggacagaaccctggacgagtggaagagagtgacctacaaggaggtgctgagcttcaagccccccagacagctgggcgccagagtgagcaaggagacccccctgtag

SEQ ID NO: 11533 - DNA, 837 bp, Artificial Sequence
  Description of Artificial Sequence: Synthetic coding sequence
atggccctgctgcccgtgctgttcctggtgaccgtgctgctgcccagcctgcccgccgagggcaaggaccccgccttcaccgccctgctgaccacccagctgcaggtgcagagagagatcgtgaacaagcacaacgagctgagaaaggccgtgagcccccccgccagcaacatgctgaagatggagtggagcagagaggtgaccaccaacgcccagagatgggccaacaagtgcaccctgcagcacagcgaccccgaggacagaaagaccagcaccagatgcggcgagaacctgtacatgagcagcgaccccaccagctggagcagcgccatccagagctggtacgacgagatcctggacttcgtgtacggcgtgggccccaagagccccaacgccgtggtgggccactacacccagctggtgtggtacagcacctaccaggtgggctgcggcatcgcctactgccccaaccaggacagcctgaagtactactacgtgtgccagtactgccccgccatgaagacctacctgaacaagagagagggcatcaacgtgtggaagtgcttcctgagactgagacacttccagctgctgagaggcgagcagctgctgaccttcagcggcaacaacatgaacagaaagaacaccccctaccagcagggcaccccctgcgccggctgccccgacgactgcgacaagggcctgtgcaccaacagctgccagtaccaggacctgctgagcaactgcgacagcctgaagaacaccgccggctgcgagcacgagctgctgaaggagaagtgcaaggccacctgcctgtgcgagaacaagatctactag

SEQ ID NO: 11534 - DNA, 459 bp, Artificial Sequence
  Description of Artificial Sequence: Synthetic coding sequence
atgcagcacgagaacgtgatcggcctgctggacgtgttcacccccgccagcagcctgagaaacttctacgacttctacctggtgatgcccttcatgcagaccgacctgcagaagatcatgggcatggagttcagcgaggagaagatccagtacctggtgtaccagatgctgaagggcctgaagtacatccacagcgccggcgtggtgcacagagacctgaagcccggcaacctggccgtgaacgaggactgcgagctgaagatcctggacttcggcctggccagacacgccgacgccgagatgaccggctacgtggtgaccagatggtacagagcccccgaggtgatcctgagctggatgcactacaaccagaccggccagatcctgcaccccgtgcccgccaccgacccccaggagggcttccacagcgccgtgcccaccggccagccccccggctag

SEQ ID NO: 11535 - DNA, 1068 bp, Artificial Sequence
  Description of Artificial Sequence: Synthetic coding sequence
atgagcctgatcagaaagaagggcttctacaagcaggacgtgaacaagaccgcctgggagctgcccaagacctacgtgagccccacccacgtgggcagcggcgcctacggcagcgtgtgcagcgccatcgacaagagaagcggcgagaaggtggccatcaagaagctgagcagacccttccagagcgagatcttcgccaagagagcctacagagagctgctgctgctgaagcacatgcagcacgagaacgtgatcggcctgctggacgtgttcacccccgccagcagcctgagaaacttctacgacttctacctggtgatgcccttcatgcagaccgacctgcagaagatcatgggcatggagttcagcgaggagaagatccagtacctggtgtaccagatgctgaagggcctgaaggacctgaagcccggcaacctggccgtgaacgaggactgcgagctgaagatcctggacttcggcctggccagacacgccgacgccgagatgaccggctacgtggtgaccagatggtacagagcccccgaggtgatcctgagctggatgcactacaaccagaccgtggacatctggagcgtgggctgcatcatggccgagatgctgaccggcaagaccctgttcaagggcaaggactacctggaccagctgacccagatcctgaaggtgaccggcgtgcccggcaccgagttcgtgcagaagctgaacgacaaggccgccaagagctacatccagagcctgccccagacccccagaaaggacttcacccagctgttccccagagccagcccccaggccgccgacctgctggagaagatgctggagctggacgtggacaagagactgaccgccgcccaggccctgacccaccccttcttcgagcccttcagagaccccgaggaggagaccgaggcccagcagcccttcgacgacagcctggagcacgagaagctgaccgtggacgagtggaagcagcacatctacaaggagatcgtgaacttcagccccatcgccagaaaggacagcagaagaagaagcggcatgaagctgtag

SEQ ID NO: 11536 - DNA, 774 bp, Artificial Sequence
  Description of Artificial Sequence: Synthetic coding sequence
atgagcctgatcagaaagaagggcttctacaagcaggacgtgaacaagaccgcctgggagctgcccaagacctacgtgagccccacccacgtgggcagcggcgcctacggcagcgtgtgcagcgccatcgacaagagaagcggcgagaaggtggccatcaagaagctgagcagacccttccagagcgagatcttcgccaagagagcctacagagagctgctgctgctgaagcacatgcagcacgagaacgtgatcggcctgctggacgtgttcacccccgccagcagcctgagaaacttctacgacttctacctggtgatgcccttcatgcagaccgacctgcagaagatcatgggcatggagttcagcgaggagaagatccagtacctggtgtaccagatgctgaagggcctgaagtacatccacagcgccggcgtggtgcacagagacctgaagcccggcaacctggccgtgaacgaggactgcgagctgaagatcctggacttcggcctggccagacacgccgacgccgagatgaccggctacgtggtgaccagatggtacagagcccccgaggtgatcctgagctggatgcactacaaccagaccggccagatcctgcaccccgtgcccgccaccgacccccaggagggcttccacagcgccgtgcccaccggccagccccccggctgcggccccgccggcgaggacgccggcgccagaagaggccaggcccccgacggcagagccggcccccaccccagcctgctgtag

SEQ ID NO: 11537 - DNA, 933 bp, Artificial Sequence
  Description of Artificial Sequence: Synthetic coding sequence
atgagcctgatcagaaagaagggcttctacaagcaggacgtgaacaagaccgcctgggagctgcccaagacctacgtgagccccacccacgtgggcagcggcgcctacggcagcgtgtgcagcgccatcgacaagagaagcggcgagaaggtggccatcaagaagctgagcagacccttccagagcgagatcttcgccaagagagcctacagagagctgctgctgctgaagcacatgcagcacgagaacgtgatcggcctgctggacgtgttcacccccgccagcagcctgagaaacttctacgacttctacctggtgatgcccttcatgcagaccgacctgcagaagatcatgggcatggagttcagcgaggagaagatccagtacctggtgtaccagatgctgaagggcctgaagtacatccacagcgccggcgtggtgcacagagacctgaagcccggcaacctggccgtgaacgaggactgcgagctgaagatcctggacttcggcctggccagacacgccgacgccgagatgaccggctacgtggtgaccagatggtacagagcccccgaggtgatcctgagctggatgcactacaaccagaccgtggacatctggagcgtgggctgcatcatggccgagatgctgaccggcaagaccctgttcaagggcaaggactacctgctggagaagatgctggagctggacgtggacaagagactgaccgccgcccaggccctgacccaccccttcttcgagcccttcagagaccccgaggaggagaccgaggcccagcagcccttcgacgacagcctggagcacgagaagctgaccgtggacgagtggaagcagcacatctacaaggagatcgtgaacttcagccccatcgccagaaaggacagcagaagaagaagcggcatgaagctgtag

SEQ ID NO: 11538 - DNA, 1629 bp, Artificial Sequence
  Description of Artificial Sequence: Synthetic coding sequence
atgcccctgagagacgagaccctgagagaggtgtgggccagcgacagcggccacgaggaggagagcctgagccccgaggcccccagaagacccaagcagagacccgcccccgcccagagactgagaaagaagagaaccgaggcccccgagagcccctgccccaccggcagcaagcccagaaagcccggcgccggcagaaccggcagacccagagaggagcccagccccgaccccgcccaggccagagccccccagaccgtgtacgccagattcctgagagaccccgaggccaagaagagagaccccagagagaccttcctggtggccagagcccccgacgccgaggacgaggaggaggaggaggaggaggacgaggaggacgaggaggaggaggccgaggagaagaaggagaagatcctgctgccccccaagaagcccctgagagagaagagcagcgccgacctgaaggagagaagagccaaggcccagggccccagaggcgacctgggcagccccgaccccccccccaagcccctgagagtgagaaacaaggaggcccccgccggcgagggcaccaagatgagaaagaccaagaagaagggcagcggcgaggccgacaaggaccccagcggcagccccgccagcgccagaaagagccccgccgccatgttcctggtgggcgagggcagccccgacaagaaggccctgaagaagaagggcacccccaagggcgccagaaaggaggaggaggaggaggaggaggccgccaccgtgatcaagaagagcaaccagaagggcaaggccaagggcaagggcaagaagaaggccaaggaggagagagcccccagcccccccgtggaggtggacgagcccagagagttcgtgctgagacccgccccccagggcagaaccgtgagatgcagactgaccagagacaagaagggcatggacagaggcatgtaccccagctacttcctgcacctggacaccgagaagaaggtgttcctgctggccggcagaaagagaaagagaagcaagaccgccaactacctgatcagcatcgaccccaccaacctgagcagaggcggcgagaacttcatcggcaagctgagaagcaacctgctgggcaacagattcaccgtgttcgacaacggccagaacccccagagaggctacagcaccaacgtggccagcctgagacaggagctggccgccgtgatctacgagaccaacgtgctgggcttcagaggccccagaagaatgaccgtgatcatccccggcatgagcgccgagaacgagagagtgcccatcagacccagaaacgccagcgacggcctgctggtgagatggcagaacaagaccctggagagcctgatcgagctgcacaacaagccccccgtgtggaacgacgacagcggcagctacaccctgaacttccagggcagagtgacccaggccagcgtgaagaacttccagatcgtgcacgccgacgaccccgactacatcgtgctgcagttcggcagagtggccgaggacgccttcaccctggactacagataccccctgtgcgccctgcaggccttcgccatcgccctgagcagcttcgacggcaagctggcctgcgagtag

SEQ ID NO: 11539 - DNA, 1083 bp, Artificial Sequence
  Description of Artificial Sequence: Synthetic coding sequence
atgagccaggagagacccaccttctacagacaggagctgaacaagaccatctgggaggtgcccgagagataccagaacctgagccccgtgggcagcggcgcctacggcagcgtgtgcgccgccttcgacaccaagaccggcctgagagtggccgtgaagaagctgagcagacccttccagagcatcatccacgccaagagaacctacagagagctgagactgctgaagcacatgaagcacgagaacgtgatcggcctgctggacgtgttcacccccgccagaagcctggaggagttcaacgacgtgtacctggtgacccacctgatgggcgccgacctgaacaacatcgtgaagtgccagaagctgaccgacgaccacgtgcagttcctgatctaccagatcctgagaggcctgaagtacatccacagcgccgacatcatccacagagacctgaagcccagcaacctggccgtgaacgaggactgcgagctgaagatcctggacttcggcctggccagacacaccgacgacgagatgaccggctacgtggccaccagatggtacagagcccccgagatcatgctgaactggatgcactacaaccagaccgtggacatctggagcgtgggctgcatcatggccgagctgctgaccggcagaaccctgttccccggcaccgaccacatcgaccagctgaagctgatcctgagactggtgggcacccccggcgccgagctgctgaagaagatcagcagcgagagcgccagaaactacatccagagcctgacccagatgcccaagatgaacttcgccaacgtgttcatcggcgccaaccccctggccgtggacctgctggagaagatgctggtgctggacagcgacaagagaatcaccgccgcccaggccctggcccacgcctacttcgcccagtaccacgaccccgacgacgagcccgtggccgacccctacgaccagagcttcgagagcagagacctgctgatcgacgagtggaagagcctgacctacgacgaggtgatcagcttcgtgcccccccccctggaccaggaggagatggagagctag

SEQ ID NO: 11540 - DNA, 924 bp, Artificial Sequence
  Description of Artificial Sequence: Synthetic coding sequence
atgagccaggagagacccaccttctacagacaggagctgaacaagaccatctgggaggtgcccgagagataccagaacctgagccccgtgggcagcggcgcctacggcagcgtgtgcgccgccttcgacaccaagaccggcctgagagtggccgtgaagaagctgagcagacccttccagagcatcatccacgccaagagaacctacagagagctgagactgctgaagcacatgaagcacgagaacgtgatcggcctgctggacgtgttcacccccgccagaagcctggaggagttcaacgacgtgtacctggtgacccacctgatgggcgccgacctgaacaacatcgtgaagtgccagaagctgaccgacgaccacgtgcagttcctgatctaccagatcctgagaggcctgaagtacatccacagcgccgacatcatccacagagacctgaagcccagcaacctggccgtgaacgaggactgcgagctgaagatcctggacttcggcctggccagacacaccgacgacgagatgaccggctacgtggccaccagatggtacagagcccccgagatcatgctgaactggatgcactacaaccagaccgtggacatctggagcgtgggctgcatcatggccgagctgctgaccggcagaaccctgttccccggcaccgaccacatcgaccagctgaagctgatcctgagactggtgggcacccccggcgccgagctgctgaagaagatcagcagcgagagcctgagcacctgctggagaagatgcctgtactggacccagatcagagagctgcagagacccaagcccctgcacatgcccaccctgctgagcaccaccatcctgatgatgaaccagtggcccatcctgatgatcagccccctgaaggccggcaccagcctgtag

SEQ ID NO: 11541 - DNA, 852 bp, Artificial Sequence
  Description of Artificial Sequence: Synthetic coding sequence
atgaagcacgagaacgtgatcggcctgctggacgtgttcacccccgccagaagcctggaggagttcaacgacgtgtacctggtgacccacctgatgggcgccgacctgaacaacatcgtgaagtgccagaagctgaccgacgaccacgtgcagttcctgatctaccagatcctgagaggcctgaagtacatccacagcgccgacatcatccacagagacctgaagcccagcaacctggccgtgaacgaggactgcgagctgaagatcctggacttcggcctggccagacacaccgacgacgagatgaccggctacgtggccaccagatggtacagagcccccgagatcatgctgaactggatgcactacaaccagaccgtggacatctggagcgtgggctgcatcatggccgagctgctgaccggcagaaccctgttccccggcaccgaccacatcgaccagctgaagctgatcctgagactggtgggcacccccggcgccgagctgctgaagaagatcagcagcgagagcgccagaaactacatccagagcctgacccagatgcccaagatgaacttcgccaacgtgttcatcggcgccaaccccctggccgtggacctgctggagaagatgctggtgctggacagcgacaagagaatcaccgccgcccaggccctggcccacgcctacttcgcccagtaccacgaccccgacgacgagcccgtggccgacccctacgaccagagcttcgagagcagagacctgctgatcgacgagtggaagagcctgacctacgacgaggtgatcagcttcgtgcccccccccctggaccaggaggagatggagagctag

SEQ ID NO: 11542 - DNA, 1140 bp, Artificial Sequence
  Description of Artificial Sequence: Synthetic coding sequence
atggccgccgccgccgcccagggcggcggcggcggcgagcccagaagaaccgagggcgtgggccccggcgtgcccggcgaggtggagatggtgaagggccagcccttcgacgtgggccccagatacacccagctgcagtacatcggcgagggcgcctacggcatggtgagcagcgcctacgaccacgtgagaaagaccagagtggccatcaagaagatcagccccttcgagcaccagacctactgccagagaaccctgagagagatccagatcctgctgagattcagacacgagaacgtgatcggcatcagagacatcctgagagccagcaccctggaggccatgagagacgtgtacatcgtgcaggacctgatggagaccgacctgtacaagctgctgaagagccagcagctgagcaacgaccacatctgctacttcctgtaccagatcctgagaggcctgaagtacatccacagcgccaacgtgctgcacagagacctgaagcccagcaacctgctgatcaacaccacctgcgacctgaagatctgcgacttcggcctggccagaatcgccgaccccgagcacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacatgaaggccagaaactacctgcagagcctgcccagcaagaccaaggtggcctgggccaagctgttccccaagagcgacagcaaggccctggacctgctggacagaatgctgaccttcaaccccaacaagagaatcaccgtggaggaggccctggcccacccctacctggagcagtactacgaccccaccgacgagcccgtggccgaggagcccttcaccttcgccatggagctggacgacctgcccaaggagagactgaaggagctgatcttccaggagaccgccagattccagcccggcgtgctggaggccccctag

SEQ ID NO: 11543 - DNA, 1008 bp, Artificial Sequence
  Description of Artificial Sequence: Synthetic coding sequence
atggccgccgccgccgcccagggcggcggcggcggcgagcccagaagaaccgagggcgtgggccccggcgtgcccggcgaggtggagatggtgaagggccagcccttcgacgtgggccccagatacacccagctgcagtacatcggcgagggcgcctacggcatggtgagcagcgcctacgaccacgtgagaaagaccagagtggccatcaagaagatcagccccttcgagcaccagacctactgccagagaaccctgagagagatccagatcctgctgagattcagacacgagaacgtgatcggcatcagagacatcctgagagccagcaccctggaggccatgagagacgtgtacatcgtgcaggacctgatggagaccgacctgtacaagctgctgaagagccagcagctgagcaacgaccacatctgctacttcctgtaccagatcctgagaggcctgaagtacatccacagcgccaacgtgctgcacagagacctgaagcccagcaacctgctgatcaacaccacctgcgacctgaagatctgcgacttcggcctggccagaatcgccgaccccgagcacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctggccctggacctgctggacagaatgctgaccttcaaccccaacaagagaatcaccgtggaggaggccctggcccacccctacctggagcagtactacgaccccaccgacgagcccgtggccgaggagcccttcaccttcgccatggagctggacgacctgcccaaggagagactgaaggagctgatcttccaggagaccgccagattccagcccggcgtgctggaggccccctag

SEQ ID NO: 11544 - DNA, 936 bp, Artificial Sequence
  Description of Artificial Sequence: Synthetic coding sequence
atggtgaagggccagcccttcgacgtgggccccagatacacccagctgcagtacatcggcgagggcgcctacggcatggtgagcagcgcctacgaccacgtgagaaagaccagagtggccatcaagaagatcagccccttcgagcaccagacctactgccagagaaccctgagagagatccagatcctgctgagattcagacacgagaacgtgatcggcatcagagacatcctgagagccagcaccctggaggccatgagagacgtgtacatcgtgcaggacctgatggagaccgacctgtacaagctgctgaagagccagcagctgagcaacgaccacatctgctacttcctgtaccagatcctgagaggcctgaagtacatccacagcgccaacgtgctgcacagagacctgaagcccagcaacctgctgatcaacaccacctgcgacctgaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacatgaaggccagaaactacctgcagagcctgcccagcaagaccaaggtggcctgggccaagctgttccccaagagcgacagcaaggccctggacctgctggacagaatgctgaccttcaaccccaacaagagaatcaccgtggaggaggccctggcccacccctacctggagcagtactacgaccccaccgacgagcccgtggccgaggagcccttcaccttcgccatggagctggacgacctgcccaaggagagactgaaggagctgatcttccaggagaccgccagattccagcccggcgtgctggaggccccctag

SEQ ID NO: 11545 - DNA, 1008 bp, Artificial Sequence; identical to SEQ ID NO: 11543
  Description of Artificial Sequence: Synthetic coding sequence

SEQ ID NO: 11546 - DNA, 1074 bp, Artificial Sequence
  Description of Artificial Sequence: Synthetic coding sequence
atggccgccgccgccgcccagggcggcggcggcggcgagcccagaagaaccgagggcgtgggccccggcgtgcccggcgaggtggagatggtgaagggccagcccttcgacgtgggccccagatacacccagctgcagtacatcggcgagggcgcctacggcatggtgagcagcgcctacgaccacgtgagaaagaccagagtggccatcaagaagatcagccccttcgagcaccagacctactgccagagaaccctgagagagatccagatcctgctgagattcagacacgagaacgtgatcggcatcagagacatcctgagagccagcaccctggaggccatgagagacgtgtacatcgtgcaggacctgatggagaccgacctgtacaagctgctgaagagccagcagctgagcaacgaccacatctgctacttcctgtaccagatcctgagaggcctgaagtacatccacagcgccaacgtgctgcacagagacctgaagcccagcaacctgctgatcaacaccacctgcgacctgaagatctgcgacttcggcctggccagaatcgccgaccccgagcacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacatgaaggccagaaactacctgcagagcctgcccagcaagaccaaggtggcctgggccaagctgttccccaagagcgacagcaaggccctggacctgctggacagaatgctgaccttcaaccccaacaagagaatcaccgtggaggaggccctggcccacccctacctggagcagtactacgaccccaccgacgaggtgggccagagccccgccgccgtgggcctgggcgccggcgagcagggcggcacctag

SEQ ID NO: 11547 - DNA, 798 bp, Artificial Sequence
  Description of Artificial Sequence: Synthetic coding sequence
atgagagacgtgtacatcgtgcaggacctgatggagaccgacctgtacaagctgctgaagagccagcagctgagcaacgaccacatctgctacttcctgtaccagatcctgagaggcctgaagtacatccacagcgccaacgtgctgcacagagacctgaagcccagcaacctgctgatcaacaccacctgcgacctgaagatctgcgacttcggcctggccagaatcgccgaccccgagcacgaccacaccggcttcctgaccgagtacgtggccaccagatggtacagagcccccgagatcatgctgaacagcaagggctacaccaagagcatcgacatctggagcgtgggctgcatcctggccgagatgctgagcaacagacccatcttccccggcaagcactacctggaccagctgaaccacatcctgggcatcctgggcagccccagccaggaggacctgaactgcatcatcaacatgaaggccagaaactacctgcagagcctgcccagcaagaccaaggtggcctgggccaagctgttccccaagagcgacagcaaggccctggacctgctggacagaatgctgaccttcaaccccaacaagagaatcaccgtggaggaggccctggcccacccctacctggagcagtactacgaccccaccgacgagcccgtggccgaggagcccttcaccttcgccatggagctggacgacctgcccaaggagagactgaaggagctgatcttccaggagaccgccagattccagcccggcgtgctggaggccccctag

SEQ ID NO: 11548 - DNA, 1284 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacctgtggagcgtgggctgcatcatgggcgagatggtgtgccacaagatcctgttccccggcagagactacatcgaccagtggaacaaggtgatcgagcagctgggcaccccctgccccgagttcatgaagaagctgcagcccaccgtgagaacctacgtggagaacagacccaagtacgccggctacagcttcgagaagctgttccccgacgtgctgttccccgccgacagcgagcacaacaagctgaaggccagccaggccagagacctgctgagcaagatgctggtgatcgacgccagcaagagaatcagcgtggacgaggccctgcagcacccctacatcaacgtgtggtacgaccccagcgaggccgaggcccccccccccaagatccccgacaagcagctggacgagagagagcacaccatcgaggagtggaaggagctgatctacaaggaggtgatggacctggaggagagaaccaagaacggcgtgatcagaggccagcccagccccctgggcgccgccgtgatcaacggcagccagcaccccagcagcagcagcagcgtgaacgacgtgagcagcatgagcaccgaccccaccctggccagcgacaccgacagcagcctggaggccgccgccggccccctgggctgctgcagatag

SEQ ID NO: 11549 - DNA, 657 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacggcggcagaatgggcaagggcatcttcaccagactgcagtag

SEQ ID NO: 11550 - DNA, 1284 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatgatcaagggcggcgtgctgttccccggcaccgaccacatcgaccagtggaacaaggtgatcgagcagctgggcaccccctgccccgagttcatgaagaagctgcagcccaccgtgagaacctacgtggagaacagacccaagtacgccggctacagcttcgagaagctgttccccgacgtgctgttccccgccgacagcgagcacaacaagctgaaggccagccaggccagagacctgctgagcaagatgctggtgatcgacgccagcaagagaatcagcgtggacgaggccctgcagcacccctacatcaacgtgtggtacgaccccagcgaggccgaggcccccccccccaagatccccgacaagcagctggacgagagagagcacaccatcgaggagtggaaggagctgatctacaaggaggtgatggacctggaggagagaaccaagaacggcgtgatcagaggccagcccagccccctgggcgccgccgtgatcaacggcagccagcaccccagcagcagcagcagcgtgaacgacgtgagcagcatgagcaccgaccccaccctggccagcgacaccgacagcagcctggaggccgccgccggccccctgggctgctgcagatag

SEQ ID NO: 11551 - DNA, 1155 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacatctggagcgtgggctgcatcatgggcgagatgatcaagggcggcgtgctgttccccggcaccgaccacatcgaccagtggaacaaggtgatcgagcagctgggcaccccctgccccgagttcatgaagaagctgcagcccaccgtgagaacctacgtggagaacagacccaagtacgccggctacagcttcgagaagctgttccccgacgtgctgttccccgccgacagcgagcacaacaagctgaaggccagccaggccagagacctgctgagcaagatgctggtgatcgacgccagcaagagaatcagcgtggacgaggccctgcagcacccctacatcaacgtgtggtacgaccccagcgaggccgaggcccccccccccaagatccccgacaagcagctggacgagagagagcacaccatcgaggagtggaaggagctgatctacaaggaggtgatggacctggaggagagaaccaagaacggcgtgatcagaggccagcccagccccctggcccaggtgcagcagtag

SEQ ID NO: 11552 - DNA, 1155 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgtggacctgtggagcgtgggctgcatcatgggcgagatggtgtgccacaagatcctgttccccggcagagactacatcgaccagtggaacaaggtgatcgagcagctgggcaccccctgccccgagttcatgaagaagctgcagcccaccgtgagaacctacgtggagaacagacccaagtacgccggctacagcttcgagaagctgttccccgacgtgctgttccccgccgacagcgagcacaacaagctgaaggccagccaggccagagacctgctgagcaagatgctggtgatcgacgccagcaagagaatcagcgtggacgaggccctgcagcacccctacatcaacgtgtggtacgaccccagcgaggccgaggcccccccccccaagatccccgacaagcagctggacgagagagagcacaccatcgaggagtggaaggagctgatctacaaggaggtgatggacctggaggagagaaccaagaacggcgtgatcagaggccagcccagccccctggcccaggtgcagcagtag

SEQ ID NO: 11553 - DNA, 1284 bp, Artificial Sequence; identical to SEQ ID NO: 11548
  Description of Artificial Sequence: Synthetic coding sequence

SEQ ID NO: 11554 - DNA, 927 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttcatgatgaccccctacgtggtgaccagatactacagagcccccgaggtgatcctgggcatgggctacaaggagaacgccgacagcgagcacaacaagctgaaggccagccaggccagagacctgctgagcaagatgctggtgatcgacgccagcaagagaatcagcgtggacgaggccctgcagcacccctacatcaacgtgtggtacgaccccagcgaggccgaggcccccccccccaagatccccgacaagcagctggacgagagagagcacaccatcgaggagtggaaggagctgatctacaaggaggtgatggacctggaggagagaaccaagaacggcgtgatcagaggccagcccagccccctggcccaggtgcagcagtag

SEQ ID NO: 11555 - DNA, 429 bp, Artificial Sequence
  Description of Artificial Sequence: Synthetic coding sequence
atgagcagaagcaagagagacaacaacttctacagcgtggagatcggcgacagcaccttcaccgtgctgaagagataccagaacctgaagcccatcggcagcggcgcccagggcatcgtgtgcgccgcctacgacgccatcctggagagaaacgtggccatcaagaagctgagcagacccttccagaaccagacccacgccaagagagcctacagagagctggtgctgatgaagtgcgtgaaccacaagaacatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgtag

SEQ ID NO: 11556 - DNA, 294 bp, Artificial Sequence
  Description of Artificial Sequence: Synthetic coding sequence
atgatcatcggcctgctgaacgtgttcaccccccagaagagcctggaggagttccaggacgtgtacatcgtgatggagctgatggacgccaacctgtgccaggtgatccagatggagctggaccacgagagaatgagctacctgctgtaccagatgctgtgcggcatcaagcacctgcacagcgccggcatcatccacagagacctgaagcccagcaacatcgtggtgaagagcgactgcaccctgaagatcctggacttcggcctggccagaaccgccggcaccagcttctag

SEQ ID NO: 11557 - DNA, 429 bp, Artificial Sequence; identical to SEQ ID NO: 11555
  Description of Artificial Sequence: Synthetic coding sequence

SEQ ID NO: 11558 - DNA, 1182 bp, Artificial Sequence
  Description of Artificial Sequence: Synthetic coding sequence
atgcccaagaagaagcccacccccatccagctgaaccccgcccccgacggcagcgccgtgaacggcaccagcagcgccgagaccaacctggaggccctgcagaagaagctggaggagctggagctggacgagcagcagagaaagagactggaggccttcctgacccagaagcagaaggtgggcgagctgaaggacgacgacttcgagaagatcagcgagctgggcgccggcaacggcggcgtggtgttcaaggtgagccacaagcccagcggcctggtgatggccagaaagctgatccacctggagatcaagcccgccatcagaaaccagatcatcagagagctgcaggtgctgcacgagtgcaacagcccctacatcgtgggcttctacggcgccttctacagcgacggcgagatcagcatctgcatggagcacatggacggcggcagcctggaccaggtgctgaagaaggccggcagaatccccgagcagatcctgggcaaggtgagcatcgccgtgatcaagggcctgacctacctgagagagaagcacaagatcatgcacagagacgtgaagcccagcaacatcctggtgaacagcagaggcgagatcaagctgtgcgacttcggcgtgagcggccagctgatcgacagcatggccaacagcttcgtgggcaccagaagctacatgagccccgagagactgcagggcacccactacagcgtgcagagcgacatctggagcatgggcctgagcctggtggagatggccgtgggcagataccccatccccccccccgacgccaaggagctggagctgatgttcggctgccaggtggagggcgacgccgccgagaccccccccagacccagaacccccggcagacccctgagcagctacggcatggacagcagaccccccatggccatcttcgagctgctggactacatcgtgaacgagcccccccccaagctgcccagcggcgtgttcagcctggagttccaggacttcgtgaacaagtgcctgatcaagaaccccgccgagagagccgacctgaagcagctgatggtgcacgccttcatcaagagaagcgacgccgaggaggtggacttcgccggctggctgtgcagcaccatcggcctgaaccagcccagcacccccacccacgccgccggcgtgtag

SEQ ID NO: 11559 - DNA, 1203 bp, Artificial Sequence
  Description of Artificial Sequence: Synthetic coding sequence
atgctggccagaagaaagcccgtgctgcccgccctgaccatcaaccccaccatcgccgagggccccagccccaccagcgagggcgccagcgaggccaacctggtggacctgcagaagaagctggaggagctggagctggacgagcagcagaagaagagactggaggccttcctgacccagaaggccaaggtgggcgagctgaaggacgacgacttcgagagaatcagcgagctgggcgccggcaacggcggcgtggtgaccaaggtgcagcacagacccagcggcctgatcatggccagaaagctgatccacctggagatcaagcccgccatcagaaaccagatcatcagagagctgcaggtgctgcacgagtgcaacagcccctacatcgtgggcttctacggcgccttctacagcgacggcgagatcagcatctgcatggagcacatggacggcggcagcctggaccaggtgctgaaggaggccaagagaatccccgaggagatcctgggcaaggtgagcatcgccgtgctgagaggcctggcctacctgagagagaagcaccagatcatgcacagagacgtgaagcccagcaacatcctggtgaacagcagaggcgagatcaagctgtgcgacttcggcgtgagcggccagctgatcgacagcatggccaacagcttcgtgggcaccagaagctacatggcccccgagagactgcagggcacccactacagcgtgcagagcgacatctggagcatgggcctgagcctggtggagctggccgtgggcagataccccatccccccccccgacgccaaggagctggaggccatcttcggcagacccgtggtggacggcgaggagggcgagccccacagcatcagccccagacccagaccccccggcagacccgtgagcggccacggcatggacagcagacccgccatggccatcttcgagctgctggactacatcgtgaacgagcccccccccaagctgcccaacggcgtgttcacccccgacttccaggagttcgtgaacaagtgcctgatcaagaaccccgccgagagagccgacctgaagatgctgaccaaccacaccttcatcaagagaagcgaggtggaggaggtggacttcgccggctggctgtgcaagaccctgagactgaaccagcccggcacccccaccagaaccgccgtgtag

SEQ ID NO: 11560 - DNA, 1056 bp, Artificial Sequence
  Description of Artificial Sequence: Synthetic coding sequence
atgggcgtgcagggcaccctgatgagcagagaccagaccccccacctgctgagcatcctgggcaagagcaagagaaagaaggacctgagaatcagctgcatgagcaagccccccgcccccaaccccaccccccccagaaacctggacagcagaaccttcatcaccatcggcgacagaaacttcgaggtggaggccgacgacctggtgaccatcagcgagctgggcagaggcgcctacggcgtggtggagaaggtgagacacgcccagagcggcaccatcatggccgtgaagagaatcagagccaccgtgaacagccaggagcagaagagactgctgatggacctggacatcaacatgagaaccgtggactgcttctacaccgtgaccttctacggcgccctgttcagagagggcgacgtgtggatctgcatggagctgatggacaccagcctggacaagttctacagaaaggtgctggacaagaacatgaccatccccgaggacatcctgggcgagatcgccgtgagcatcgtgagagccctggagcacctgcacagcaagctgagcgtgatccacagagacgtgaagcccagcaacgtgctgatcaacaaggagggccacgtgaagatgtgcgacttcggcatcagcggctacctggtggacagcgtggccaagaccatggacgccggctgcaagccctacatggcccccgagagaatcaaccccgagctgaaccagaagggctacaacgtgaagagcgacgtgtggagcctgggcatcaccatgatcgagatggccatcctgagattcccctacgagagctggggcacccccttccagcagctgaagcaggtggtggaggagcccagcccccagctgcccgccgacagattcagccccgagttcgtggacttcaccgcccagtgcctgagaaagaaccccgccgagagaatgagctacctggagctgatggagcaccccttcttcaccctgcacaagaccaagaagaccgacatcgccgccttcgtgaaggagatcctgggcgaggacagctag

SEQ ID NO: 11561 - DNA, 1044 bp, Artificial Sequence
  Description of Artificial Sequence: Synthetic coding sequence
atggagagccccgccagcagccagcccgccagcatgccccagagcaagggcaagagcaagagaaagaaggacctgagaatcagctgcatgagcaagccccccgcccccaaccccaccccccccagaaacctggacagcagaaccttcatcaccatcggcgacagaaacttcgaggtggaggccgacgacctggtgaccatcagcgagctgggcagaggcgcctacggcgtggtggagaaggtgagacacgcccagagcggcaccatcatggccgtgaagagaatcagagccaccgtgaacagccaggagcagaagagactgctgatggacctggacatcaacatgagaaccgtggactgcttctacaccgtgaccttctacggcgccctgttcagagagggcgacgtgtggatctgcatggagctgatggacaccagcctggacaagttctacagaaaggtgctggacaagaacatgaccatccccgaggacatcctgggcgagatcgccgtgagcatcgtgagagccctggagcacctgcacagcaagctgagcgtgatccacagagacgtgaagcccagcaacgtgctgatcaacaaggagggccacgtgaagatgtgcgacttcggcatcagcggctacctggtggacagcgtggccaagaccatggacgccggctgcaagccctacatggcccccgagagaatcaaccccgagctgaaccagaagggctacaacgtgaagagcgacgtgtggagcctgggcatcaccatgatcgagatggccatcctgagattcccctacgagagctggggcacccccttccagcagctgaagcaggtggtggaggagcccagcccccagctgcccgccgacagattcagccccgagttcgtggacttcaccgcccagtgcctgagaaagaaccccgccgagagaatgagctacctggagctgatggagcaccccttcttcaccctgcacaagaccaagaagaccgacatcgccgccttcgtgaaggagatcctgggcgaggacagctag

SEQ ID NO: 11562 - DNA, 957 bp, Artificial Sequence
  Description of Artificial Sequence: Synthetic coding sequence
atgagcaagccccccgcccccaaccccaccccccccagaaacctggacagcagaaccttcatcaccatcggcgacagaaacttcgaggtggaggccgacgacctggtgaccatcagcgagctgggcagaggcgcctacggcgtggtggagaaggtgagacacgcccagagcggcaccatcatggccgtgaagagaatcagagccaccgtgaacagccaggagcagaagagactgctgatggacctggacatcaacatgagaaccgtggactgcttctacaccgtgaccttctacggcgccctgttcagagagggcgacgtgtggatctgcatggagctgatggacaccagcctggacaagttctacagaaaggtgctggacaagaacatgaccatccccgaggacatcctgggcgagatcgccgtgagcatcgtgagagccctggagcacctgcacagcaagctgagcgtgatccacagagacgtgaagcccagcaacgtgctgatcaacaaggagggccacgtgaagatgtgcgacttcggcatcagcggctacctggtggacagcgtggccaagaccatggacgccggctgcaagccctacatggcccccgagagaatcaaccccgagctgaaccagaagggctacaacgtgaagagcgacgtgtggagcctgggcatcaccatgatcgagatggccatcctgagattcccctacgagagctggggcacccccttccagcagctgaagcaggtggtggaggagcccagcccccagctgcccgccgacagattcagccccgagttcgtggacttcaccgcccagtgcctgagaaagaaccccgccgagagaatgagctacctggagctgatggagcaccccttcttcaccctgcacaagaccaagaagaccgacatcgccgccttcgtgaaggagatcctgggcgaggacagctag

SEQ ID NO: 11563 - DNA, 1113 bp, Artificial Sequence
  Description of Artificial Sequence: Synthetic coding sequence
atgctgagcaacagccagggccagagcccccccgtgcccttccccgcccccgccccccccccccagccccccacccccgccctgccccacccccccgcccagcccccccccccccccccccagcagttcccccagttccacgtgaagagcggcctgcagatcaagaagaacgccatcatcgacgactacaaggtgaccagccaggtgctgggcctgggcatcaacggcaaggtgctgcagatcttcaacaagagaacccaggagaagttcgccctgaagatgctgcaggactgccccaaggccagaagagaggtggagctgcactggagagccagccagtgcccccacatcgtgagaatcgtggacgtgtacgagaacctgtacgccggcagaaagtgcctgctgatcgtgatggagtgcctggacggcggcgagctgttcagcagaatccaggacagaggcgaccaggccttcaccgagagagaggccagcgagatcatgaagagcatcggcgaggccatccagtacctgcacagcatcaacatcgcccacagagacgtgaagcccgagaacctgctgtacaccagcaagagacccaacgccatcctgaagctgaccgacttcggcttcgccaaggagaccaccagccacaacagcctgaccaccccctgctacaccccctactacgtggcccccgaggtgctgggccccgagaagtacgacaagagctgcgacatgtggagcctgggcgtgatcatgtacatcctgctgtgcggctacccccccttctacagcaaccacggcctggccatcagccccggcatgaagaccagaatcagaatgggccagtacgagttccccaaccccgagtggagcgaggtgagcgaggaggtgaagatgctgatcagaaacctgctgaagaccgagcccacccagagaatgaccatcaccgagttcatgaaccacccctggatcatgcagagcaccaaggtgccccagacccccctgcacaccagcagagtgctgaaggaggacaaggagagatgggaggacgtgaagggctgcctgcacgacaagaacagcgaccaggccacctggctgaccagactgtag

SEQ ID NO: 11564 - DNA, 1203 bp, Artificial Sequence
  Description of Artificial Sequence: Synthetic coding sequence
atgctgagcaacagccagggccagagcccccccgtgcccttccccgcccccgccccccccccccagccccccacccccgccctgccccacccccccgcccagcccccccccccccccccccagcagttcccccagttccacgtgaagagcggcctgcagatcaagaagaacgccatcatcgacgactacaaggtgaccagccaggtgctgggcctgggcatcaacggcaaggtgctgcagatcttcaacaagagaacccaggagaagttcgccctgaagatgctgcaggactgccccaaggccagaagagaggtggagctgcactggagagccagccagtgcccccacatcgtgagaatcgtggacgtgtacgagaacctgtacgccggcagaaagtgcctgctgatcgtgatggagtgcctggacggcggcgagctgttcagcagaatccaggacagaggcgaccaggccttcaccgagagagaggccagcgagatcatgaagagcatcggcgaggccatccagtacctgcacagcatcaacatcgcccacagagacgtgaagcccgagaacctgctgtacaccagcaagagacccaacgccatcctgaagctgaccgacttcggcttcgccaaggagaccaccagccacaacagcctgaccaccccctgctacaccccctactacgtggcccccgaggtgctgggccccgagaagtacgacaagagctgcgacatgtggagcctgggcgtgatcatgtacatcctgctgtgcggctacccccccttctacagcaaccacggcctggccatcagccccggcatgaagaccagaatcagaatgggccagtacgagttccccaaccccgagtggagcgaggtgagcgaggaggtgaagatgctgatcagaaacctgctgaagaccgagcccacccagagaatgaccatcaccgagttcatgaaccacccctggatcatgcagagcaccaaggtgccccagacccccctgcacaccagcagagtgctgaaggaggacaaggagagatgggaggacgtgaaggaggagatgaccagcgccctggccaccatgagagtggactacgagcagatcaagatcaagaagatcgaggacgccagcaaccccctgctgctgaagagaagaaagaaggccagagccctggaggccgccgccctggcccactag

SEQ ID NO: 11565 - DNA, 1149 bp, Artificial Sequence
  Description of Artificial Sequence: Synthetic coding sequence
atggacggcgagaccgccgaggagcagggcggccccgtgcccccccccgtggcccccggcggccccggcctgggcggcgcccccggcggcagaagagagcccaagaagtacgccgtgaccgacgactaccagctgagcaagcaggtgctgggcctgggcgtgaacggcaaggtgctggagtgcttccacagaagaaccggccagaagtgcgccctgaagctgctgtacgacagccccaaggccagacaggaggtggaccaccactggcaggccagcggcggcccccacatcgtgtgcatcctggacgtgtacgagaacatgcaccacggcaagagatgcctgctgatcatcatggagtgcatggagggcggcgagctgttcagcagaatccaggagagaggcgaccaggccttcaccgagagagaggccgccgagatcatgagagacatcggcaccgccatccagttcctgcacagccacaacatcgcccacagagacgtgaagcccgagaacctgctgtacaccagcaaggagaaggacgccgtgctgaagctgaccgacttcggcttcgccaaggagaccacccagaacgccctgcagaccccctgctacaccccctactacgtggcccccgaggtgctgggccccgagaagtacgacaagagctgcgacatgtggagcctgggcgtgatcatgtacatcctgctgtgcggcttcccccccttctacagcaacaccggccaggccatcagccccggcatgaagagaagaatcagactgggccagtacggcttccccaaccccgagtggagcgaggtgagcgaggacgccaagcagctgatcagactgctgctgaagaccgaccccaccgagagactgaccatcacccagttcatgaaccacccctggatcaaccagagcatggtggtgccccagacccccctgcacaccgccagagtgctgcaggaggacaaggaccactgggacgaggtgaaggaggagatgaccagcgccctggccaccatgagagtggactacgaccaggtgaagatcaaggacctgaagaccagcaacaacagactgctgaacaagagaagaaagaagcaggccggcagcagcagcgccagccagggctgcaacaaccagtag

SEQ ID NO: 11566 - DNA, 999 bp, Artificial Sequence
  Description of Artificial Sequence: Synthetic coding sequence
atggacggcgagaccgccgaggagcagggcggccccgtgcccccccccgtggcccccggcggccccggcctgggcggcgcccccggcggcagaagagagcccaagaagtacgccgtgaccgacgactaccagctgagcaagcaggtgctgggcctgggcgtgaacggcaaggtgctggagtgcttccacagaagaaccggccagaagtgcgccctgaagctgctgtacgacagccccaaggccagacaggaggtggaccaccactggcaggccagcggcggcccccacatcgtgtgcatcctggacgtgtacgagaacatgcaccacggcaagagatgcctgctgatcatcatggagtgcatggagggcggcgagctgttcagcagaatccaggagagaggcgaccaggccttcaccgagagagaggccgccgagatcatgagagacatcggcaccgccatccagttcctgcacagccacaacatcgcccacagagacgtgaagcccgagaacctgctgtacaccagcaaggagaaggacgccgtgctgaagctgaccgacttcggcttcgccaaggagaccacccagaacgccctgcagaccccctgctacaccccctactacgtggcccccgaggtgctgggccccgagaagtacgacaagagctgcgacatgtggagcctgggcgtgatcatgtacatcctgctgtgcggcttcccccccttctacagcaacaccggccaggccatcagccccggcatgaagagaagaatcagactgggccagtacggcttccccaaccccgagtggagcgaggtgagcgaggacgccaagcagctgatcagactgctgctgaagaccgaccccaccgagagactgaccatcacccagttcatgaaccacccctggatcaaccagagcatggtggtgccccagacccccctgcacaccgccagagtgctgcaggaggacaaggaccactgggacgaggtgaagtag

SEQ ID NO: 11567 - DNA, 1149 bp, Artificial Sequence; identical to SEQ ID NO: 11565
  Description of Artificial Sequence: Synthetic coding sequence

SEQ ID NO: 11568 - DNA, 360 bp, Artificial Sequence
  Description of Artificial Sequence: Synthetic coding sequence
atggacggcgagaccgccgaggagcagggcggccccgtgcccccccccgtggcccccggcggccccggcctgggcggcgcccccggcggcagaagagagcccaagaagtacgccgtgaccgacgactaccagctgagcaagcaggtgctgggcctgggcgtgaacggcaaggtgctggagtgcttccacagaagaaccggccagaagtgcgccctgaagctgctgtacgacagccccaaggccagacaggaggtggaccaccactggcaggccagcggcggcccccacatcgtgtgcatcctggacgtgtacgagaacatgcaccacggcaagagatgcctgctgatcatcatggagtag

SEQ ID NO: 11569 - DNA, 1422 bp, Artificial Sequence
  Description of Artificial Sequence: Synthetic coding sequence
atgagcgaggagagcgacatggacaaggccatcaaggagaccagcatcctggaggagtacagcatcaactggacccagaagctgggcgccggcatcagcggccccgtgagagtgtgcgtgaagaagagcacccaggagagattcgccctgaagatcctgctggacagacccaaggccagaaacgaggtgagactgcacatgatgtgcgccacccaccccaacatcgtgcagatcatcgaggtgttcgccaacagcgtgcagttcccccacgagagcagccccagagccagactgctgatcgtgatggagatgatggagggcggcgagctgttccacagaatcagccagcacagacacttcaccgagaagcaggccagccaggtgaccaagcagatcgccctggccctgagacactgccacctgctgaacatcgcccacagagacctgaagcccgagaacctgctgttcaaggacaacagcctggacgcccccgtgaagctgtgcgacttcggcttcgccaagatcgaccagggcgacctgatgaccccccagttcaccccctactacgtggccccccaggtgctggaggcccagagaagacaccagaaggagaagagcggcatcatccccaccagccccaccccctacacctacaacaagagctgcgacctgtggagcctgggcgtgatcatctacgtgatgctgtgcggctacccccccttctacagcaagcaccacagcagaaccatccccaaggacatgagaagaaagatcatgaccggcagcttcgagttccccgaggaggagtggagccagatcagcgagatggccaaggacgtggtgagaaagctgctgaaggtgaagcccgaggagagactgaccatcgagggcgtgctggaccacccctggctgaacagcaccgaggccctggacaacgtgctgcccagcgcccagctgatgatggacaaggccgtggtggccggcatccagcaggcccacgccgagcagctggccaacatgagaatccaggacctgaaggtgagcctgaagcccctgcacagcgtgaacaaccccatcctgagaaagagaaagctgctgggcaccaagcccaaggacagcgtgtacatccacgaccacgagaacggcgccgaggacagcaacgtggccctggagaagctgagagacgtgatcgcccagtgcatcctgccccaggccggcaagggcgagaacgaggacgagaagctgaacgaggtgatgcaggaggcctggaagtacaacagagagtgcaagctgctgagagacaccctgcagagcttcagctggaacggcagaggcttcaccgacaaggtggacagactgaagctggccgagatcgtgaagcaggtgatcgaggagcagaccaccagccacgagagccagtag

SEQ ID NO: 11570 - DNA, 1416 bp, Artificial Sequence
  Description of Artificial Sequence: Synthetic coding sequence
atgagcgaggagagcgacatggacaaggccatcaaggagaccagcatcctggaggagtacagcatcaactggacccagaagctgggcgccggcatcagcggccccgtgagagtgtgcgtgaagaagagcacccaggagagattcgccctgaagatcctgctggacagacccaaggccagaaacgaggtgagactgcacatgatgtgcgccacccaccccaacatcgtgcagatcatcgaggtgttcgccaacagcgtgcagttcccccacgagagcagccccagagccagactgctgatcgtgatggagatgatggagggcggcgagctgttccacagaatcagccagcacagacacttcaccgagaagcaggccagccaggtgaccaagcagatcgccctggccctgagacactgccacctgctgaacatcgcccacagagacctgaagcccgagaacctgctgttcaaggacaacagcctggacgcccccgtgaagctgtgcgacttcggcttcgccaagatcgaccagggcgacctgatgaccccccagttcaccccctactacgtggccccccaggtgctggaggcccagagaagacaccagaaggagaagagcggcatcatccccaccagccccaccccctacacctacaacaagagctgcgacctgtggagcctgggcgtgatcatctacgtgatgctgtgcggctacccccccttctacagcaagcaccacagcagaaccatccccaaggacatgagaagaaagatcatgaccggcagcttcgagttccccgaggaggagtggagccagatcagcgagatggccaaggacgtggtgagaaagctgctgaaggtgaagcccgaggagagactgaccatcgagggcgtgctggaccacccctggctgaacagcaccgaggccctggacaacgtgctgcccagcgcccagctgatgatggacaaggccgtggtggccggcatccagcaggcccacgccgagcagctggccaacatgagaatccaggacctgaaggtgagcctgaagcccctgcacagcgtgaacaaccccatcctgagaaagagaaagctgctgggcaccaagcccaaggacagcgtgtacatccacgaccacgagaacggcgccgaggacagcaacgtggccctggagaagctgagagacgtgatcgcccagtgcatcctgccccaggccggcgagaacgaggacgagaagctgaacgaggtgatgcaggaggcctggaagtacaacagagagtgcaagctgctgagagacaccctgcagagcttcagctggaacggcagaggcttcaccgacaaggtggacagactgaagctggccgagatcgtgaagcaggtgatcgaggagcagaccaccagccacgagagccagtag

SEQ ID NO: 11571 - DNA, 1416 bp, Artificial Sequence
  Description of Artificial Sequence: Synthetic coding sequence
atgagcgaggagagcgacatggacaaggccatcaaggagaccagcatcctggaggagtacagcatcaactggacccagaagctgggcgccggcatcagcggccccgtgagagtgtgcgtgaagaagagcacccaggagagattcgccctgaagatcctgctggacagacccaaggccagaaacgaggtgagactgcacatgatgtgcgccacccaccccaacatcgtgcagatcatcgaggtgttcgccaacagcgtgcagttcccccacgagagcagccccagagccagactgctgatcgtgatggagatgatggagggcggcgagctgttccacagaatcagccagcacagacacttcaccgagaagcaggccagccaggtgaccaagcaggccaccctggccctgagacactgccacctgctgaacatcgcccacagagacctgaagcccgagaacctgctgttcaaggacaacagcctggacgcccccgtgaagctgtgcgacttcggcttcgccaagatcgaccagggcgacctgatgaccccccagttcaccccctactacgtggccccccaggtgctggaggcccagagaagacaccagaaggagaagagcggcatcatccccaccagccccaccccctacacctacaacaagagctgcgacctgtggagcctgggcgtgatcatctacgtgatgctgtgcggctacccccccttctacagcaagcaccacagcagaaccatccccaaggacatgagaagaaagatcatgaccggcagcttcgagttccccgaggaggagtggagccagatcagcgagatggccaaggacgtggtgagaaagctgctgaaggtgaagcccgaggagagactgaccatcgagggcgtgctggaccacccctggctgaacagcaccgaggccctggacaacgtgctgcccagcgcccagctgatgatggacaaggccgtggtggccggcatccagcaggcccacgccgagcagctggccaacatgagaatccaggacctgaaggtgagcctgaagcccctgcacagcgtgaacaaccccatcctgagaaagagaaagctgctgggcaccaagcccaaggacagcgtgtacatccacgaccacgagaacggcgccgaggacagcaacgtggccctggagaagctgagagacgtgatcgcccagtgcatcctgccccaggccggcgagaacgaggacgagaagctgaacgaggtgatgcaggaggcctggaagtacaacagagagtgcaagctgctgagagacaccctgcagagcttcagctggaacggcagaggcttcaccgacaaggtggacagactgaagctggccgagatcgtgaagcaggtgatcgaggagcagaccaccagccacgagagccagtag

SEQ ID NO: 11572 - DNA, 1422 bp, Artificial Sequence
  Description of Artificial Sequence: Synthetic coding sequence
atgagcgaggagagcgacatggacaaggccatcaaggagaccagcatcctggaggagtacagcatcaactggacccagaagctgggcgccggcatcagcggccccgtgagagtgtgcgtgaagaagagcacccaggagagattcgccctgaagatcctgctggacagacccaaggccagaaacgaggtgagactgcacatgatgtgcgccacccaccccaacatcgtgcagatcatcgaggtgttcgccaacagcgtgcagttcccccacgagagcagccccagagccagactgctgatcgtgatggagatgatggagggcggcgagctgttccacagaatcagccagcacagacacttcaccgagaagcaggccagccaggtgaccaagcaggccaccctggccctgagacactgccacctgctgaacatcgcccacagagacctgaagcccgagaacctgctgttcaaggacaacagcctggacgcccccgtgaagctgtgcgacttcggcttcgccaagatcgaccagggcgacctgatgaccccccagttcaccccctactacgtggccccccaggtgctggaggcccagagaagacaccagaaggagaagagcggcatcatccccaccagccccaccccctacacctacaacaagagctgcgacctgtggagcctgggcgtgatcatctacgtgatgctgtgcggctacccccccttctacagcaagcaccacagcagaaccatccccaaggacatgagaagaaagatcatgaccggcagcttcgagttccccgaggaggagtggagccagatcagcgagatggccaaggacgtggtgagaaagctgctgaaggtgaagcccgaggagagactgaccatcgagggcgtgctggaccacccctggctgaacagcaccgaggccctggacaacgtgctgcccagcgcccagctgatgatggacaaggccgtggtggccggcatccagcaggcccacgccgagcagctggccaacatgagaatccaggacctgaaggtgagcctgaagcccctgcacagcgtgaacaaccccatcctgagaaagagaaagctgctgggcaccaagcccaaggacagcgtgtacatccacgaccacgagaacggcgccgaggacagcaacgtggccctggagaagctgagagacgtgatcgcccagtgcatcctgccccaggccggcaagggcgagaacgaggacgagaagctgaacgaggtgatgcaggaggcctggaagtacaacagagagtgcaagctgctgagagacaccctgcagagcttcagctggaacggcagaggcttcaccgacaaggtggacagactgaagctggccgagatcgtgaagcaggtgatcgaggagcagaccaccagccacgagagccagtag

SEQ ID NO: 11573 - DNA, 2799 bp, Artificial Sequence
  Description of Artificial Sequence: Synthetic coding sequence
atggccgccgccgccgccgtggaggccgccgcccccatgggcgccctgtggggcctggtgcacgacttcgtggtgggccagcaggagggccccgccgaccaggtggccgccgacgtgaagagcggcaactacaccgtgctgcaggtggtggaggccctgggcagcagcctggagaaccccgagcccagaaccagagccagagccatccagctgctgagccaggtgctgctgcactgccacaccctgctgctggagaaggaggtggtgcacctgatcctgttctacgagaacagactgaaggaccaccacctggtgatccccagcgtgctgcagggcctgaaggccctgagcctgtgcgtggccctgccccccggcctggccgtgagcgtgctgaaggccatcttccaggaggtgcacgtgcagagcctgccccaggtggacagacacaccgtgtacaacatcatcaccaacttcatgagaaccagagaggaggagctgaagagcctgggcgccgacttcaccttcggcttcatccaggtgatggacggcgagaaggaccccagaaacctgctggtggccttcagaatcgtgcacgacctgatcagcagagactacagcctgggccccttcgtggaggagctgttcgaggtgaccagctgctacttccccatcgacttcacccccccccccaacgacccccacggcatccagagagaggacctgatcctgagcctgagagccgtgctggccagcacccccagattcgccgagttcctgctgcccctgctgatcgagaaggtggacagcgaggtgctgagcgccaagctggacagcctgcagaccctgaacgcctgctgcgccgtgtacggccagaaggagctgaaggacttcctgcccagcctgtgggccagcatcagaagagagagcagccagagaagaaccatcctggagatgctgctgggcttcctgaagctgcagcagaagtggagctacgaggacaaggaccagagacccctgaacggcttcaaggaccagctgtgcagcctggtgttcatggccctgaccgaccccagcacccagctgcagctggtgggcatcagaaccctgaccgtgctgggcgcccagcccgacctgctgagctacgaggacctggagctggccgtgggccacctgtacagactgagcttcctgaaggaggacagccagagctgcagagtggccgccctggaggccagcggcaccctggccgccctgtaccccgtggccttcagcagccacctggtgcccaagctggccgaggagctgagagtgggcgagagcaacctgaccaacggcgacgagcccacccagtgcagcagacacctgtgctgcctgcaggccctgagcgccgtgagcacccaccccagcatcgtgaaggagaccctgcccctgctgctgcagcacctgtggcaggtgaacagaggcaacatggtggcccagagcagcgacgtgatcgccgtgtgccagagcctgagacagatggccgagaagtgccagcaggaccccgagagctgctggtacttccaccagaccgccatcccctgcctgctggccctggccgtgcaggccagcatgcccgagaaggagcccagcgtgctgagaaaggtgctgctggaggacgaggtgctggccgccatggtgagcgtgatcggcaccgccaccacccacctgagccccgagctggccgcccagagcgtgacccacatcgtgcccctgttcctggacggcaacgtgagcttcctgcccgagaacagcttccccagcagattccagcccttccaggacggcagcagcggccagagaagactgatcgccctgctgatggccttcgtgtgcagcctgcccagaaacgtggagatcccccagctgaaccagctgatgagagagctgctggagctgagctgctgccacagctgccccttcagcagcaccgccgccgccaagtgcttcgccggcctgctgaacaagcaccccgccggccagcagctggacgagttcctgcagctggccgtggacaaggtggaggccggcctgggcagcggcccctgcagaagccaggccttcaccctgctgctgtgggtgaccaaggccctggtgctgagataccaccccctgagcagctgcctgaccgccagactgatgggcctgctgagcgaccccgagctgggccccgccgccgccgacggcttcagcctgctgatgagcgactgcaccgacgtgctgaccagagccggccacgccgaggtgagaatcatgttcagacagagattcttcaccgacaacgtgcccgccctggtgcagggcttccacgccgccccccaggacgtgaagcccaactacctgaagggcctgagccacgtgctgaacagactgcccaagcccgtgctgctgcccgagctgcccaccctgctgagcctgctgctggaggccctgagctgccccgactgcgtggtgcagctgagcaccctgagctgcctgcagcccctgctgctggaggccccccaggtgatgagcctgcacgtggacaccctggtgaccaagttcctgaacctgagcagcagccccagcatggccgtgagaatcgccgccctgcagtgcatgcacgccctgaccagactgcccacccccgtgctgctgccctacaagccccaggtgatcagagccctggccaagcccctggacgacaagaagagactggtgagaaaggaggccgtgagcgccagaggcgagtggttcctgctgggcagccccggcagctag

SEQ ID NO: 11574 - DNA, 1092 bp, Artificial Sequence
  Description of Artificial Sequence: Synthetic coding sequence
atgctgctgggcttcctgaagctgcagcagaagtggagctacgaggacaaggaccagagacccctgaacggcttcaaggaccagctgtgcagcctggtgttcatggccctgaccgaccccagcacccagctgcagctggtgggcatcagaaccctgaccgtgctgggcgcccagcccgacctgctgagctacgaggacctggagctggccgtgggccacctgtacagactgagcttcctgaaggaggacagccagagctgcagagtggccgccctggaggccagcggcaccctggccgccctgtaccccgtggccttcagcagccacctggtgcccaagctggccgaggagctgagagtgggcgagagcaacctgaccaacggcgacgagcccacccagtgcagcagacacctgtgctgcctgcaggccctgagcgccgtgagcacccaccccagcatcgtgaaggagaccctgcccctgctgctgcagcacctgtggcaggtgaacagaggcaacatggtggcccagagcagcgacgtgatcgccgtgtgccagagcctgagacagatggccgagaagtgccagcaggaccccgagagctgctggtacttccaccagaccgccatcccctgcctgctggccctggccgtgcaggccagcatgcccgagaaggagcccagcgtgctgagaaaggtgctgctggaggacgaggtgctggccgccatggtgagcgtgatcggcaccgccaccacccacctgagccccgagctggccgcccagagcgtgacccacatcgtgcccctgttcctggacggcaacgtgagcttcctgcccgagaacagcttccccagcagattccagcccttccaggacggcagcagcggccagagaagactgatcgccctgctgatggccttcgtgtgcagcctgcccagaaacgtggagatcccccagctgaaccagctgatgagagagctgctggagctgagctgcaccgccgcccccttcctgccccccctgctgcccagcgccctgcaggacagcagcaccagcaccctgcagggcagcagctggatgaacagctacagctag

SEQ ID NO: 11575 - DNA, 1128 bp, Artificial Sequence
  Description of Artificial Sequence: Synthetic coding sequence
atgaagctggtgtggcccagcgccaagctgctgcaggccgccgccggcgccagcgccagagcctgcgacagcgtgaccagcaacgtgctgcccctgctgctggagcagttccacaagcacagccagagcagccagagaagaaccatcctggagatgctgctgggcttcctgaagctgcagcagaagtggagctacgaggacaaggaccagagacccctgaacggcttcaaggaccagctgtgcagcctggtgttcatggccctgaccgaccccagcacccagctgcagctggtgggcatcagaaccctgaccgtgctgggcgcccagcccgacctgctgagctacgaggacctggagctggccgtgggccacctgtacagactgagcttcctgaaggaggacagccagagctgcagagtggccgccctggaggccagcggcaccctggccgccctgtaccccgtggccttcagcagccacctggtgcccaagctggccgaggagctgagagtgggcgagagcaacctgaccaacggcgacgagcccacccagtgcagcagacacctgtgctgcctgcaggccctgagcgccgtgagcacccaccccagcatcgtgaaggagaccctgcccctgctgctgcagcacctgtggcaggtgaacagaggcaacatggtggcccagagcagcgacgtgatcgccgtgtgccagagcctgagacagatggccgagaagtgccagcaggaccccgagagctgctggtacttccaccagaccgccatcccctgcctgctggccctggccgtgcaggccagcatgcccgagaaggagcccagcgtgctgagaaaggtgctgctggaggacgaggtgctggccgccatggtgagcgtgatcggcaccgccaccacccacctgagccccgagctggccgcccagagcgtgacccacatcgtgcccctgttcctggacggcaacgtgagcttcctgcccgagaacagcttccccagcagattccagcccttccaggtgaccgacggcagcagcggccagagaagactgatcgccctgctgatggccttcgtgtgcagcctgcccagaaacggcagcagctggatgaacagctacagctag

SEQ ID NO: 11576 - DNA, 1128 bp, Artificial Sequence; identical to SEQ ID NO: 11575
  Description of Artificial Sequence: Synthetic coding sequence

SEQ ID NO: 11577 - DNA, 2964 bp, Artificial Sequence
  Description of Artificial Sequence: Synthetic coding sequence
atggccgccgccgccgccgtggaggccgccgcccccatgggcgccctgtggggcctggtgcacgacttcgtggtgggccagcaggagggccccgccgaccaggtggccgccgacgtgaagagcggcaactacaccgtgctgcaggtggtggaggccctgggcagcagcctggagaaccccgagcccagaaccagagccagagccatccagctgctgagccaggtgctgctgcactgccacaccctgctgctggagaaggaggtggtgcacctgatcctgttctacgagaacagactgaaggaccaccacctggtgatccccagcgtgctgcagggcctgaaggccctgagcctgtgcgtggccctgccccccggcctggccgtgagcgtgctgaaggccatcttccaggaggtgcacgtgcagagcctgccccaggtggacagacacaccgtgtacaacatcatcaccaacttcatgagaaccagagaggagggccccttcgtggaggagctgttcgaggtgaccagctgctacttccccatcgacttcacccccccccccaacgacccccacggcatccagagagaggacctgatcctgagcctgagagccgtgctggccagcacccccagattcgccgagttcctgctgcccctgctgatcgagaaggtggacagcgaggtgctgagcgccaagctggacagcctgcagaccctgaacgcctgctgcgccgtgtacggccagaaggagctgaaggacttcctgcccagcctgtgggccagcatcagaagagaggtgttccagaccgccagcgagagagtggaggccgagggcctggccgccctgcacagcctgaccgcctgcctgagcagaagcgtgctgagagccgacgccgaggacctgctggacagcttcctgagcaacatcctgcaggactgcagacaccacctgtgcgagcccgacatgaagctggtgtggcccagcgccaagctgctgcaggccgccgccggcgccagcgccagagcctgcgacagcgtgaccagcaacgtgctgcccctgctgctggagcagttccacaagcacagccagagcagccagagaagaaccatcctggagatgctgctgggcttcctgaagctgcagcagaagtggagctacgaggacaaggaccagagacccctgaacggcttcaaggaccagctgtgcagcctggtgttcatggccctgaccgaccccagcacccagctgcagctggtgggcatcagaaccctgaccgtgctgggcgcccagcccgacctgctgagctacgaggacctggagctggccgtgggccacctgtacagactgagcttcctgaaggaggacagccagagctgcagagtggccgccctggaggccagcggcaccctggccgccctgtaccccgtggccttcagcagccacctggtgcccaagctggccgaggagctgagagtgggcgagagcaacctgaccaacggcgacgagcccacccagtgcagcagacacctgtgctgcctgcaggccctgagcgccgtgagcacccaccccagcatcgtgaaggagaccctgcccctgctgctgcagcacctgtggcaggtgaacagaggcaacatggtggcccagagcagcgacgtgatcgccgtgtgccagagcctgagacagatggccgagaagtgccagcaggaccccgagagctgctggtacttccaccagaccgccatcccctgcctgctggccctggccgtgcaggccagcatgcccgagaaggagcccagcgtgctgagaaaggtgctgctggaggacgaggtgctggccgccatggtgagcgtgatcggcaccgccaccacccacctgagccccgagctggccgcccagagcgtgacccacatcgtgcccctgttcctggacggcaacgtgagcttcctgcccgagaacagcttccccagcagattccagcccttccaggacggcagcagcggccagagaagactgatcgccctgctgatggccttcgtgtgcagcctgcccagaaacgtggagatcccccagctgaaccagctgatgagagagctgctggagctgagctgctgccacagctgccccttcagcagcaccgccgccgccaagtgcttcgccggcctgctgaacaagcaccccgccggccagcagctggacgagttcctgcagctggccgtggacaaggtggaggccggcctgggcagcggcccctgcagaagccaggccttcaccctgctgctgtgggtgaccaaggccctggtgctgagataccaccccctgagcagctgcctgaccgccagactgatgggcctgctgagcgaccccgagctgggccccgccgccgccgacggcttcagcctgctgatgagcgactgcaccgacgtgctgaccagagccggccacgccgaggtgagaatcatgttcagacagagattcttcaccgacaacgtgcccgccctggtgcagggcttccacgccgccccccaggacgtgaagcccaactacctgaagggcctgagccacgtgctgaacagactgcccaagcccgtgctgctgcccgagctgcccaccctgctgagcctgctgctggaggccctgagctgccccgactgcgtggtgcagctgagcaccctgagctgcctgcagcccctgctgctggaggccccccaggtgatgagcctgcacgtggacaccctggtgaccaagttcctgaacctgagcagcagccccagcatggccgtgagaatcgccgccctgcagtgcatgcacgccctgaccagactgcccacccccgtgctgctgccctacaagccccaggtgatcagagccctggccaagcccctggacgacaagaagagactggtgagaaaggaggccgtgagcgccagaggcgagtggttcctgctgggcagccccggcagctag

SEQ ID NO: 11578 - DNA, 3093 bp, Artificial Sequence
  Description of Artificial Sequence: Synthetic coding sequence
atggccgccgccgccgccgtggaggccgccgcccccatgggcgccctgtggggcctggtgcacgacttcgtggtgggccagcaggagggccccgccgaccaggtggccgccgacgtgaagagcggcaactacaccgtgctgcaggtggtggaggccctgggcagcagcctggagaaccccgagcccagaaccagagccagagccatccagctgctgagccaggtgctgctgcactgccacaccctgctgctggagaaggaggtggtgcacctgatcctgttctacgagaacagactgaaggaccaccacctggtgatccccagcgtgctgcagggcctgaaggccctgagcctgtgcgtggccctgccccccggcctggccgtgagcgtgctgaaggccatcttccaggaggtgcacgtgcagagcctgccccaggtggacagacacaccgtgtacaacatcatcaccaacttcatgagaaccagagaggaggagctgaagagcctgggcgccgacttcaccttcggcttcatccaggtgatggacggcgagaaggaccccagaaacctgctggtggccttcagaatcgtgcacgacctgatcagcagagactacagcctgggccccttcgtggaggagctgttcgaggtgaccagctgctacttccccatcgacttcacccccccccccaacgacccccacggcatccagagagaggacctgatcctgagcctgagagccgtgctggccagcacccccagattcgccgagttcctgctgcccctgctgatcgagaaggtggacagcgaggtgctgagcgccaagctggacagcctgcagaccctgaacgcctgctgcgccgtgtacggccagaaggagctgaaggacttcctgcccagcctgtgggccagcatcagaagagaggtgttccagaccgccagcgagagagtggaggccgagggcctggccgccctgcacagcctgaccgcctgcctgagcagaagcgtgctgagagccgacgccgaggacctgctggacagcttcctgagcaacatcctgcaggactgcagacaccacctgtgcgagcccgacatgaagctggtgtggcccagcgccaagctgctgcaggccgccgccggcgccagcgccagagcctgcgacagcgtgaccagcaacgtgctgcccctgctgctggagcagttccacaagcacagccagagcagccagagaagaaccatcctggagatgctgctgggcttcctgaagctgcagcagaagtggagctacgaggacaaggaccagagacccctgaacggcttcaaggaccagctgtgcagcctggtgttcatggccctgaccgaccccagcacccagctgcagctggtgggcatcagaaccctgaccgtgctgggcgcccagcccgacctgctgagctacgaggacctggagctggccgtgggccacctgtacagactgagcttcctgaaggaggacagccagagctgcagagtggccgccctggaggccagcggcaccctggccgccctgtaccccgtggccttcagcagccacctggtgcccaagctggccgaggagctgagagtgggcgagagcaacctgaccaacggcgacgagcccacccagtgcagcagacacctgtgctgcctgcaggccctgagcgccgtgagcacccaccccagcatcgtgaaggagaccctgcccctgctgctgcagcacctgtggcaggtgaacagaggcaacatggtggcccagagcagcgacgtgatcgccgtgtgccagagcctgagacagatggccgagaagtgccagcaggaccccgagagctgctggtacttccaccagaccgccatcccctgcctgctggccctggccgtgcaggccagcatgcccgagaaggagcccagcgtgctgagaaaggtgctgctggaggacgaggtgctggccgccatggtgagcgtgatcggcaccgccaccacccacctgagccccgagctggccgcccagagcgtgacccacatcgtgcccctgttcctggacggcaacgtgagcttcctgcccgagaacagcttccccagcagattccagcccttccaggacggcagcagcggccagagaagactgatcgccctgctgatggccttcgtgtgcagcctgcccagaaacgtggagatcccccagctgaaccagctgatgagagagctgctggagctgagctgctgccacagctgccccttcagcagcaccgccgccgccaagtgcttcgccggcctgctgaacaagcaccccgccggccagcagctggacgagttcctgcagctggccgtggacaaggtggaggccggcctgggcagcggcccctgcagaagccaggccttcaccctgctgctgtgggtgaccaaggccctggtgctgagataccaccccctgagcagctgcctgaccgccagactgatgggcctgctgagcgaccccgagctgggccccgccgccgccgacggcttcagcctgctgatgagcgactgcaccgacgtgctgaccagagccggccacgccgaggtgagaatcatgttcagacagagattcttcaccgacaacgtgcccgccctggtgcagggcttccacgccgccccccaggacgtgaagcccaactacctgaagggcctgagccacgtgctgaacagactgcccaagcccgtgctgctgcccgagctgcccaccctgctgagcctgctgctggaggccctgagctgccccgactgcgtggtgcagctgagcaccctgagctgcctgcagcccctgctgctggaggccccccaggtgatgagcctgcacgtggacaccctggtgaccaagttcctgaacctgagcagcagccccagcatggccgtgagaatcgccgccctgcagtgcatgcacgccctgaccagactgcccacccccgtgctgctgccctacaagccccaggtgatcagagccctggccaagcccctggacgacaagaagagactggtgagaaaggaggccgtgagcgccagaggcgagtggttcctgctgggcagccccggcagctag

SEQ ID NO: 11579 - DNA, 3030 bp, Artificial Sequence
  Description of Artificial Sequence: Synthetic coding sequence
atggccgccgccgccgccgtggaggccgccgcccccatgggcgccctgtggggcctggtgcacgacttcgtggtgggccagcaggagggccccgccgaccaggtggccgccagcagcctggagaaccccgagcccagaaccagagccagagccatccagctgctgagccaggtgctgctgcactgccacaccctgctgctggagaaggaggtggtgcacctgatcctgttctacgagaacagactgaaggaccaccacctggtgatccccagcgtgctgcagggcctgaaggccctgagcctgtgcgtggccctgccccccggcctggccgtgagcgtgctgaaggccatcttccaggaggtgcacgtgcaggtggacagacacaccgtgtacaacatcatcaccaacttcatgagaaccagagaggaggagctgaagagcctgggcgccgacttcaccttcggcttcatccaggtgatggacggcgagaaggaccccagaaacctgctggtggccttcagaatcgtgcacgacctgatcagcagagactacagcctgggccccttcgtggaggagctgttcgaggtgaccagctgctacttccccatcgacttcacccccccccccaacgacccccacggcatccagagagaggacctgatcctgagcctgagagccgtgctggccagcacccccagattcgccgagttcctgctgcccctgctgatcgagaaggtggacagcgaggtgctgagcgccaagctggacagcctgcagaccctgaacgcctgctgcgccgtgtacggccagaaggagctgaaggacttcctgcccagcctgtgggccagcatcagaagagaggtgttccagaccgccagcgagagagtggaggccgagggcctggccgccctgcacagcctgaccgcctgcctgagcagaagcgtgctgagagccgacgccgaggacctgctggacagcttcctgagcaacatcctgcaggactgcagacaccacctgtgcgagcccgacatgaagctggtgtggcccagcgccaagctgctgcaggccgccgccggcgccagcgccagagcctgcgacagcgtgaccagcaacgtgctgcccctgctgctggagcagttccacaagcacagccagagcagccagagaagaaccatcctggagatgctgctgggcttcctgaagctgcagcagaagtggagctacgaggacaaggaccagagacccctgaacggcttcaaggaccagctgtgcagcctggtgttcatggccctgaccgaccccagcacccagctgcagctggtgggcatcagaaccctgaccgtgctgggcgcccagcccgacctgctgagctacgaggacctggagctggccgtgggccacctgtacagactgagcttcctgaaggaggacagccagagctgcagagtggccgccctggaggccagcggcaccctggccgccctgtaccccgtggccttcagcagccacctggtgcccaagctggccgaggagctgagagtgggcgagagcaacctgaccaacggcgacgagcccacccagtgcagcagacacctgtgctgcctgcaggccctgagcgccgtgagcacccaccccagcatcgtgaaggagaccctgcccctgctgctgcagcacctgtggcaggtgaacagaggcaacatggtggcccagagcagcgacgtgatcgccgtgtgccagagcctgagacagatggccgagaagtgccagcaggaccccgagagctgctggtacttccaccagaccgccatcccctgcctgctggccctggccgtgcaggccagcatgcccgagaaggagcccagcgtgctgagaaaggtgctgctggaggacgaggtgctggccgccatggtgagcgtgatcggcaccgccaccacccacctgagccccgagctggccgcccagagcgtgacccacatcgtgcccctgttcctggacggcaacgtgagcttcctgcccgagaacagcttccccagcagattccagcccttccaggacggcagcagcggccagagaagactgatcgccctgctgatggccttcgtgtgcagcctgcccagaaacgtggagatcccccagctgaaccagctgatgagagagctgctggagctgagctgctgccacagctgccccttcagcagcaccgccgccgccaagtgcttcgccggcctgctgaacaagcaccccgccggccagcagctggacgagttcctgcagctggccgtggacaaggtggaggccggcctgggcagcggcccctgcagaagccaggccttcaccctgctgctgtgggtgaccaaggccctggtgctgagataccaccccctgagcagctgcctgaccgccagactgatgggcctgctgagcgaccccgagctgggccccgccgccgccgacggcttcagcctgctgatgagcgactgcaccgacgtgctgaccagagccggccacgccgaggtgagaatcatgttcagacagagattcttcaccgacaacgtgcccgccctggtgcagggcttccacgccgccccccaggacgtgaagcccaactacctgaagggcctgagccacgtgctgaacagactgcccaagcccgtgctgctgcccgagctgcccaccctgctgagcctgctgctggaggccctgagctgccccgactgcgtggtgcagctgagcaccctgagctgcctgcagcccctgctgctggaggccccccaggtgatgagcctgcacgtggacaccctggtgaccaagttcctgaacctgagcagcagccccagcatggccgtgagaatcgccgccctgcagtgcatgcacgccctgaccagactgcccacccccgtgctgctgccctacaagccccaggtgatcagagccctggccaagcccctggacgacaagaagagactggtgagaaaggaggccgtgagcgccagaggcgagtggttcctgctgggcagccccggcagctag

SEQ ID NO: 11580 - DNA, 3093 bp, Artificial Sequence; identical to SEQ ID NO: 11578
  Description of Artificial Sequence: Synthetic coding sequence

SEQ ID NO: 11581 - DNA, 1734 bp, Artificial Sequence
  Description of Artificial Sequence: Synthetic coding sequence
atgcccaagaccatcagcgtgagagtgaccaccatggacgccgagctggagttcgccatccagcccaacaccaccggcaagcagctgttcgaccaggtggtgaagaccatcggcctgagagaggtgtggttcttcggcctgcagtaccaggacaccaagggcttcagcacctggctgaagctgaacaagaaggtgaccgcccaggacgtgagaaaggagagccccctgctgttcaagttcagagccaagttctaccccgaggacgtgagcgaggagctgatccaggacatcacccagagactgttcttcctgcaggtgaaggagggcatcctgaacgacgacatctactgcccccccgagaccgccgtgctgctggccagctacgccgtgcagagcaagtacggcgacttcaacaaggaggtgcacaagagcggctacctggccggcgacaagctgctgccccagagagtgctggagcagcacaagctgaacaaggaccagtgggaggagagaatccaggtgtggcacgaggagcacagaggcatgctgagagaggacgccgtgctggagtacctgaagatcgcccaggacctggagatgtacggcgtgaactacttcagcatcaagaacaagaagggcagcgagctgtggctgggcgtggacgccctgggcctgaacatctacgagcagaacgacagactgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctggccctgtgcatgggcaaccacgagctgtacatgagaagaagaaagcccgacaccatcgaggtgcagcagatgaaggcccaggccagagaggagaagcaccagaagcagatggagagagccatgctggagaacgagaagaagaagagagagatggccgagaaggagaaggagaagatcgagagagagaaggaggagctgatggagagactgaagcagatcgaggagcagaccaagaaggcccagcaggagctggaggagcagaccagaagagccctggagctggagcaggagagaaagagagcccagagcgaggccgagaagctggccaaggagagacaggaggccgaggaggccaaggaggccctgctgcaggccagcagagaccagaagaagacccaggagcagctggccctggagatggccgagctgaccgccagaatcagccagctggagatggccagacagaagaaggagagcgaggccgtggagtggcagcagaaggcccagatggtgcaggaggacctggagaagaccagagccgagctgaagaccgccatgagcaccccccacgtggccgagcccgccgagaacgagcaggacgagcaggacgagaacggcgccgaggccagcgccgacctgagagccgacgccatggccaaggacagaagcgaggaggagagaaccaccgaggccgagaagaacgagagagtgcagaagcacctgaaggccctgaccagcgagctggccaacgccagagacgagagcaagaagaccgccaacgacatgatccacgccgagaacatgagactgggcagagacaagtacaagaccctgagacagatcagacagggcaacaccaagcagagaatcgacgagttcgagagcatgtag

SEQ ID NO: 11582 - DNA, 717 bp, Artificial Sequence
  Description of Artificial Sequence: Synthetic coding sequence
atgagattcaagaacagattccagagattcatgaaccacagagcccccgccaacggcagatacaagcccacctgctacgagcacgccgccaactgctacacccacgccttcctgatcgtgcccgccatcgtgggcagcgccctgctgcacagactgagcgacgactgctgggagaagatcaccgcctggatctacggcatgggcctgtgcgccctgttcatcgtgagcaccgtgttccacatcgtgagctggaagaagagccacctgagaaccgtggagcactgcttccacatgtgcgacagaatggtgatctacttcttcatcgccgccagctacgccccctggctgaacctgagagagctgggccccctggccagccacatgagatggttcatctggctgatggccgccggcggcaccatctacgtgttcctgtaccacgagaagtacaaggtggtggagctgttcttctacctgaccatgggcttcagccccgccctggtggtgaccagcatgaacaacaccgacggcctgcaggagctggcctgcggcggcctgatctactgcctgggcgtggtgttcttcaagagcgacggcatcatccccttcgcccacgccatctggcacctgttcgtggccaccgccgccgccgtgcactactacgccatctggaagtacctgtacagaagccccaccgacttcatgagacacctgtag

SEQ ID NO: 11583 - DNA, 2127 bp, Artificial Sequence
  Description of Artificial Sequence: Synthetic coding sequence
atgagcaccgccgacgccctggacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactaccaggacggcaacctgaacatcagcatccccgtgttcagcatccacggcaaccacgacgaccccaccggcgccgacgccctgtgcgccctggacatcctgagctgcgccggcttcgtgaaccacttcggcagaagcatgagcgtggagaagatcgacatcagccccgtgctgctgcagaagggcagcaccaagatcgccctgtacggcctgggcagcatccccgacgagagactgtacagaatgttcgtgaacaagaaggtgaccatgctgagacccaaggaggacgagaacagctggttcaacctgttcgtgatccaccagaacagaagcaagcacggcagcaccaacttcatccccgagcagttcctggacgacttcatcgacctggtgatctggggccacgagcacgagtgcaagatcgcccccaccaagaacgagcagcagctgttctacatcagccagcccggcagcagcgtggtgaccagcctgagccccggcgaggccgtgaagaagcacgtgggcctgctgagaatcaagggcagaaagatgaacatgcacaagatccccctgcacaccgtgagacagttcttcatggaggacatcgtgctggccaaccaccccgacatcttcaaccccgacaaccccaaggtgacccaggccatccagagcttctgcctggagaagatcgaggagatgctggagaacgccgagagagagagactgggcaacagccaccagcccgagaagcccctggtgagactgagagtggactacagcggcggcttcgagcccttcagcgtgctgagattcagccagaagttcgtggacagagtggccaaccccaaggacatcatccacttcttcagacacagagagcagaaggagaagaccggcgaggagatcaacttcggcaagctgatcaccaagcccagcgagggcaccaccctgagagtggaggacctggtgaagcagtacttccagaccgccgagaagaacgtgcagctgagcctgctgaccgagagaggcatgggcgaggccgtgcaggagttcgtggacaaggaggagaaggacgccatcgaggagctggtgaagtaccagctggagaagacccagagattcctgaaggagagacacatcgacgccctggaggacaagatcgacgaggaggtgagaagattcagagagaccagacagaagaacaccaacgaggaggacgacgaggtgagagaggccatgaccagagccagagccctgagaagccagagcgaggagagcgccagcgccttcagcgccgacgacctgatgagcatcgacctggccgagcagatggccaacgacagcgacgacagcatcagcgccgccaccaacaagggcagaggcagaggcagaggcagaagaggcggcagaggccagaacagcgccagcagaggcggcagccagagaggcagagccgacaccggcctggagaccagcaccagaagcagaaacagcaagaccgccgtgagcgccagcagaaacatgagcatcatcgacgccttcaagagcaccagacagcagcccagcagaaacgtgaccaccaagaactacagcgaggtgatcgaggtggacgagagcgacgtggaggaggacatcttccccaccaccagcaagaccgaccagagatggagcagcaccagcagcagcaagatcatgagccagagccaggtgagcaagggcgtggacttcgagagcagcgaggacgacgacgacgaccccttcatgaacaccagcagcctgagaagaaacagaagatag

SEQ ID NO: 11584 - DNA, 2043 bp, Artificial Sequence
  Description of Artificial Sequence: Synthetic coding sequence
atgagcaccgccgacgccctggacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactaccaggacggcaacctgaacatcagcatccccgtgttcagcatccacggcaaccacgacgaccccaccggcgccgacgccctgtgcgccctggacatcctgagctgcgccggcttcgtgaaccacttcggcagaagcatgagcgtggagaagatcgacatcagccccgtgctgctgcagaagggcagcaccaagatcgccctgtacggcctgggcagcatccccgacgagagactgtacagaatgttcgtgaacaagaaggtgaccatgctgagacccaaggaggacgagaacagctggttcaacctgttcgtgatccaccagaacagaagcaagcacggcagcaccaacttcatccccgagcagttcctggacgacttcatcgacctggtgatctggggccacgagcacgagtgcaagatcgcccccaccaagaacgagcagcagctgttctacatcagccagcccggcagcagcgtggtgaccagcctgagccccggcgaggccgtgaagaagcacgtgggcctgctgagaatcaagggcagaaagatgaacatgcacaagatccccctgcacaccgtgagacagttcttcatggaggacatcgtgctggccaaccaccccgacatcttcaaccccgacaaccccaaggtgacccaggccatccagagcttctgcctggagaagatcgaggagatgctggagaacgccgagagagagagactgggcaacagccaccagcccgagaagcccctggtgagactgagagtggactacagcggcggcttcgagcccttcagcgtgctgagattcagccagaagttcgtggacagagtggccaaccccaaggacatcatccacttcttcagacacagagagcagaaggagaagaccggcgaggagatcaacttcggcaagctgatcaccaagcccagcgagggcaccaccctgagagtggaggacctggtgaagcagtacttccagaccgccgagaagaacgtgcagctgagcctgctgaccgagagaggcatgggcgaggccgtgcaggagttcgtggacaaggaggagaaggacgccatcgaggagctggtgaagtaccagctggagaagacccagagattcctgaaggagagacacatcgacgccctggaggacaagatcgacgaggaggtgagaagattcagagagaccagacagaagaacaccaacgaggaggacgacgaggtgagagaggccatgaccagagccagagccctgagaagccagagcgaggagagcgccagcgccttcagcgccgacgacctgatgagcatcgacctggccgagcagatggccaacgacagcgacgacagcatcagcgccgccaccaacaagggcagaggcagaggcagaggcagaagaggcggcagaggccagaacagcgccagcagaggcggcagccagagaggcagagccttcaagagcaccagacagcagcccagcagaaacgtgaccaccaagaactacagcgaggtgatcgaggtggacgagagcgacgtggaggaggacatcttccccaccaccagcaagaccgaccagagatggagcagcaccagcagcagcaagatcatgagccagagccaggtgagcaagggcgtggacttcgagagcagcgaggacgacgacgacgaccccttcatgaacaccagcagcctgagaagaaacagaagatag

SEQ ID NO: 11585 - DNA, 2124 bp, Artificial Sequence
  Description of Artificial Sequence: Synthetic coding sequence
atgagcaccgccgacgccctggacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactaccaggacggcaacctgaacatcagcatccccgtgttcagcatccacggcaaccacgacgaccccaccggcgccgacgccctgtgcgccctggacatcctgagctgcgccggcttcgtgaaccacttcggcagaagcatgagcgtggagaagatcgacatcagccccgtgctgctgcagaagggcagcaccaagatcgccctgtacggcctgggcagcatccccgacgagagactgtacagaatgttcgtgaacaagaaggtgaccatgctgagacccaaggaggacgagaacagctggttcaacctgttcgtgatccaccagaacagaagcaagcacggcagcaccaacttcatccccgagcagttcctggacgacttcatcgacctggtgatctggggccacgagcacgagtgcaagatcgcccccaccaagaacgagcagcagctgttctacatcagccagcccggcagcagcgtggtgaccagcctgagccccggcgaggccgtgaagaagcacgtgggcctgctgagaatcaagggcagaaagatgaacatgcacaagatccccctgcacaccgtgagacagttcttcatggaggacatcgtgctggccaaccaccccgacatcttcaaccccgacaaccccaaggtgacccaggccatccagagcttctgcctggagaagatcgaggagatgctggagaacgccgagagagagagactgggcaacagccaccagcccgagaagcccctggtgagactgagagtggactacagcggcggcttcgagcccttcagcgtgctgagattcagccagaagttcgtggacagagtggccaaccccaaggacatcatccacttcttcagacacagagagcagaaggagaagaccggcgaggagatcaacttcggcaagctgatcaccaagcccagcgagggcaccaccctgagagtggaggacctggtgaagcagtacttccagaccgccgagaagaacgtgcagctgagcctgctgaccgagagaggcatgggcgaggccgtgcaggagttcgtggacaaggaggagaaggacgccatcgaggagctggtgaagtaccagctggagaagacccagagattcctgaaggagagacacatcgacgccctggaggacaagatcgacgaggaggtgagaagattcagagagaccagacagaagaacaccaacgaggaggacgacgaggtgagagaggccatgaccagagccagagccctgagaagccagagcgaggagagcgccagcgccttcagcgccgacgacctgatgagcatcgacctggccgagcagatggccaacgacagcgacgacagcatcagcgccgccaccaacaagggcagaggcagaggcagaggcagaagaggcggcagaggccagaacagcgccagcagaggcggcagccagagaggcagagacaccggcctggagaccagcaccagaagcagaaacagcaagaccgccgtgagcgccagcagaaacatgagcatcatcgacgccttcaagagcaccagacagcagcccagcagaaacgtgaccaccaagaactacagcgaggtgatcgaggtggacgagagcgacgtggaggaggacatcttccccaccaccagcaagaccgaccagagatggagcagcaccagcagcagcaagatcatgagccagagccaggtgagcaagggcgtggacttcgagagcagcgaggacgacgacgacgaccccttcatgaacaccagcagcctgagaagaaacagaagatag

SEQ ID NO: 11586 - DNA, 2136 bp, Artificial Sequence
  Description of Artificial Sequence: Synthetic coding sequence
atgaacagaaacatcagccaccagaagggcgacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactaccaggacggcaacctgaacatcagcatccccgtgttcagcatccacggcaaccacgacgaccccaccggcgccgacgccctgtgcgccctggacatcctgagctgcgccggcttcgtgaaccacttcggcagaagcatgagcgtggagaagatcgacatcagccccgtgctgctgcagaagggcagcaccaagatcgccctgtacggcctgggcagcatccccgacgagagactgtacagaatgttcgtgaacaagaaggtgaccatgctgagacccaaggaggacgagaacagctggttcaacctgttcgtgatccaccagaacagaagcaagcacggcagcaccaacttcatccccgagcagttcctggacgacttcatcgacctggtgatctggggccacgagcacgagtgcaagatcgcccccaccaagaacgagcagcagctgttctacatcagccagcccggcagcagcgtggtgaccagcctgagccccggcgaggccgtgaagaagcacgtgggcctgctgagaatcaagggcagaaagatgaacatgcacaagatccccctgcacaccgtgagacagttcttcatggaggacatcgtgctggccaaccaccccgacatcttcaaccccgacaaccccaaggtgacccaggccatccagagcttctgcctggagaagatcgaggagatgctggagaacgccgagagagagagactgggcaacagccaccagcccgagaagcccctggtgagactgagagtggactacagcggcggcttcgagcccttcagcgtgctgagattcagccagaagttcgtggacagagtggccaaccccaaggacatcatccacttcttcagacacagagagcagaaggagaagaccggcgaggagatcaacttcggcaagctgatcaccaagcccagcgagggcaccaccctgagagtggaggacctggtgaagcagtacttccagaccgccgagaagaacgtgcagctgagcctgctgaccgagagaggcatgggcgaggccgtgcaggagttcgtggacaaggaggagaaggacgccatcgaggagctggtgaagtaccagctggagaagacccagagattcctgaaggagagacacatcgacgccctggaggacaagatcgacgaggaggtgagaagattcagagagaccagacagaagaacaccaacgaggaggacgacgaggtgagagaggccatgaccagagccagagccctgagaagccagagcgaggagagcgccagcgccttcagcgccgacgacctgatgagcatcgacctggccgagcagatggccaacgacagcgacgacagcatcagcgccgccaccaacaagggcagaggcagaggcagaggcagaagaggcggcagaggccagaacagcgccagcagaggcggcagccagagaggcagagccgacaccggcctggagaccagcaccagaagcagaaacagcaagaccgccgtgagcgccagcagaaacatgagcatcatcgacgccttcaagagcaccagacagcagcccagcagaaacgtgaccaccaagaactacagcgaggtgatcgaggtggacgagagcgacgtggaggaggacatcttccccaccaccagcaagaccgaccagagatggagcagcaccagcagcagcaagatcatgagccagagccaggtgagcaagggcgtggacttcgagagcagcgaggacgacgacgacgaccccttcatgaacaccagcagcctgagaagaaacagaagatag

SEQ ID NO: 11587 - DNA, 384 bp, Artificial Sequence
  Description of Artificial Sequence: Synthetic coding sequence
atgagcaccgccgacgccctggacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactaccaggacggcaacctgaacatcagcatccccgtgttcagcatccacggctag

SEQ ID NO: 11588 - DNA, 336 bp, Artificial Sequence
  Description of Artificial Sequence: Synthetic coding sequence
atgagcaccgccgacgccctggacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactactag

SEQ ID NO: 11589 - DNA, 666 bp, Artificial Sequence
  Description of Artificial Sequence: Synthetic coding sequence
atgagcaccgccgacgccctggacgacgagaacaccttcaagatcctggtggccaccgacatccacctgggcttcatggagaaggacgccgtgagaggcaacgacaccttcgtgaccctggacgagatcctgagactggcccaggagaacgaggtggacttcatcctgctgggcggcgacctgttccacgagaacaagcccagcagaaagaccctgcacacctgcctggagctgctgagaaagtactgcatgggcgacagacccgtgcagttcgagatcctgagcgaccagagcgtgaacttcggcttcagcaagttcccctgggtgaactaccaggacggcaacctgaacatcagcatccccgtgttcagcatccacggcaaccacgacgaccccaccggcgccgacgccctgtgcgccctggacatcctgagctgcgccggcttcgtgaaccacttcggcagaagcatgagcgtggagaagatcgacatcagccccgtgctgctgcagaagggcagcaccaagatcgccctgtacggcctgggcagcatccccgacgagagactgtacagaatgttcgtgaacaagaaggtgaccatgctgagacccaaggaggacgagaacagctggttcaacctgttcgtgatccaccagaacagagtgtag

SEQ ID NO: 11590 - DNA, 822 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccctgagcaccggcgtgagcttcttcttcctgagcttccacatcagcaacctgcagttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11591 - DNA, 675 bp, Artificial Sequence
  Description of Artificial Sequence: Synthetic coding sequence
atgacccccggcacccagagccccttcttcctgctgctgctgctgaccgtgctgaccgccaccaccgcccccaagcccgccaccgtggtgaccggcagcggccacgccagcagcacccccggcggcgagaaggagaccagcgccacccagagaagcagcgtgcccagcagcaccgagaagaacgccttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11592 - DNA, 501 bp, Artificial Sequence
  Description of Artificial Sequence: Synthetic coding sequence
atgacccccggcacccagagccccttcttcctgctgctgctgctgaccgtgctgaccgccaccaccgcccccaagcccgccaccgtggtgaccggcagcggccacgccagcagcacccccggcggcgagaaggagaccagcgccacccagagaagcagcgtgcccagcagcaccgagaagaacgccagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11593 - DNA, 612 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccatccccgcccccaccaccaccaagagctgcagagagaccttcctgaagtgcttctgcagattcatcaacaagggcgtgttctgggccagccccatcctgagcagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11594 - DNA, 507 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccctgagcaccggcgtgagcttcttcttcctgagcttccacatcagcaacctgcagttcaacagcagcctggaggaccccagcaccgactactaccaggagctgcagagagacatcagcgagatggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11595 - DNA, 768 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11596 - DNA, 795 bp, Artificial Sequence
  Description of Artificial Sequence: Synthetic coding sequence
atgacccccggcacccagagccccttcttcctgctgctgctgctgaccgtgctgaccgccaccaccgcccccaagcccgccaccgtggtgaccggcagcggccacgccagcagcacccccggcggcgagaaggagaccagcgccacccagagaagcagcgtgcccagcagcaccgagaagaacgccttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11597 - DNA, 597 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccctgagcaccggcgtgagcttcttcttcctgagcttccacatcagcaacctgcagttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcggctgcctgagcgtgccccccaaggagctgagagccgccggccacctgagcagccccggctacctgcccagctacgagagagtgccccacctgccccacccctgggccctgtgcgccccctag

SEQ ID NO: 11598 - DNA, 1428 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccgtgagcatgaccagcagcgtgctgagcagccacagccccggcagcggcagcagcaccacccagggccaggacgtgaccctggcccccgccaccgagcccgccagcggcagcgccgccacctggggccaggacgtgaccagcgtgcccgtgaccagacccgccctgggcagcaccaccccccccgcccacgacgtgaccagcgcccccgacaacaagcccgcccccggcagcaccgccccccccgcccacggcgtgaccagcgcccccgacaccagacccgcccccggcagcaccgccccccccgcccacggcgtgaccagcgcccccgacaacagacccgccctgggcagcaccgccccccccgtgcacaacgtgaccagcgccagcggcagcgccagcggcagcgccagcaccctggtgcacaacggcaccagcgccagagccaccaccacccccgccagcaagagcacccccttcagcatccccagccaccacagcgacacccccaccaccctggccagccacagcaccaagaccgacgccagcagcacccaccacagcaccgtgccccccctgaccagcagcaaccacagcaccagcccccagctgagcaccggcgtgagcttcttcttcctgagcttccacatcagcaacctgcagttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11599 - DNA, 480 bp, Artificial Sequence
  Description of Artificial Sequence: Synthetic coding sequence
atgacccccggcacccagagccccttcttcctgctgctgctgctgaccgtgctgaccgccaccaccgcccccaagcccgccaccgtggtgaccggcagcggccacgccagcagcacccccggcggcgagaaggagaccagcgccacccagagaagcagcgtgcccagcagcaccgagaagaacgccttcaacagcagcctggaggaccccagcaccgactactaccaggagctgcagagagacatcagcgagatggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11600 - DNA, 693 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccatccccgcccccaccaccaccaagagctgcagagagaccttcctgaagtggcccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11601 - DNA, 1686 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccgtgagcatgaccagcagcgtgctgagcagccacagccccggcagcggcagcagcaccacccagggccaggacgtgaccctggcccccgccaccgagcccgccagcggcagcgccgccacctggggccaggacgtgaccagcgtgcccgtgaccagacccgccctgggcagcaccaccccccccgcccacgacgtgaccagcgcccccgacaccagacccgcccccggcagcaccgccccccccgcccacggcgtgaccagcgcccccgacaccagacccgcccccggcagcaccgccccccccgcccacggcgtgaccagcgcccccgacaccagacccgcccccggcagcaccgccccccccgcccacggcgtgaccagcgcccccgacaccagacccgcccccggcagcaccgccccccccgcccacggcgtgaccagcgcccccgacaccagaagagcccccggcagcacccccgcccccggcagcaccgccccccccgcccacggcgtgaccagcgcccccgacaccagacccgcccccggcagcaccgccccccccgcccacggcgtgaccagcgcccccgacaacagacccgccctgggcagcaccgccccccccgtgcacaacgtgaccagcgccagcggcagcgccagcggcagcgccagcaccctggtgcacaacggcaccagcgccagagccaccaccacccccgccagcaagagcacccccttcagcatccccagccaccacagcgacacccccaccaccctggccagccacagcaccaagaccgacgccagcagcacccaccacagcaccgtgccccccctgaccagcagcaaccacagcaccagcccccagctgagcaccggcgtgagcttcttcttcctgagcttccacatcagcaacctgcagttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11602 - DNA, 690 bp, Artificial Sequence
  Description of Artificial Sequence: Synthetic coding sequence
atgacccccggcacccagagccccttcttcctgctgctgctgctgaccgtgctgaccgtggtgaccggcagcggccacgccagcagcacccccggcggcgagaaggagaccagcgccacccagagaagcagcgtgcccagcagcaccgagaagaacgccatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaaggtgagcgccggcaacggcggcagcagcctgagctacaccaaccccgccgtggccgccaccagcgccaacctgtag

SEQ ID NO: 11603 - DNA, 780 bp, Artificial Sequence
  Description of Artificial Sequence: Synthetic coding sequence
atgacccccggcacccagagccccttcttcctgctgctgctgctgaccgtgctgaccgccaccaccgcccccaagcccgccaccgtggtgaccggcagcggccacgccagcagcacccccggcggcgagaaggagaccagcgccacccagagaagcagcgtgcccagcagcaccgagaagaacgccttcaacagcagcctggaggaccccagcaccgactactaccaggagctgcagagagacatcagcgagatgttcctgcagatctacaagcagggcggcttcctgggcctgagcaacatcaagttcagacccggcagcgtggtggtgcagctgaccctggccttcagagagggcaccatcaacgtgcacgacgtggagacccagttcaaccagtacaagaccgaggccgccagcagatacaacctgaccatcagcgacgtgagcgtgagcgacgtgcccttccccttcagcgcccagagcggcgccggcgtgcccggctggggcatcgccctgctggtgctggtgtgcgtgctggtggccctggccatcgtgtacctgatcgccctggccgtgtgccagtgcagaagaaagaactacggccagctggacatcttccccgccagagacacctaccaccccatgagcgagtaccccacctaccacacccacggcagatacgtgccccccagcagcaccgacagaagcccctacgagaagagacagaacggctggagcaccatgcccagaggcgccctgcccgaggagagccagggctag

SEQ ID NO: 11604 - DNA, 1833 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggcaccaagctggacagcagcggcgtggccttcgccgtggtgggcgcctgccaggccctgggcctgagagacgtgcacctggccctgagcgaggaccacgcctgggtggtgttcggccccaacggcgagcagaccgccgaggtgacctggcacggcaagggcaacgaggacagaagaggccagaccgtgaacgccggcgtggccgagagaagctggctgtacctgaagggcagctacatgagatgcgacagaaagatggaggtggccttcatggtgtgcgccatcaaccccagcatcgacctgcacaccgacagcctggagctgctgcagctgcagcagaagctgctgtggctgctgtacgacctgggccacctggagagataccccatggccctgggcaacctggccgacctggaggagctggagcccacccccggcagacccgaccccctgaccctgtaccacaagggcatcgccagcgccaagacctactacagagacgagcacatctacccctacatgtacctggccggctaccactgcagaaacagaaacgtgagagaggccctgcaggcctgggccgacaccgccaccgtgatccaggactacaactactgcagagaggacgaggagatctacaaggagttcttcgaggtggccaacgacgtgatccccaacctgctgaaggaggccgccagcctgctggaggccggcgaggagagacccggcgagcagagccagggcacccagagccagggcagcgccctgcaggaccccgagtgcttcgcccacctgctgagattctacgacggcatctgcaagtgggaggagggcagccccacccccgtgctgcacgtgggctgggccaccttcctggtgcagagcctgggcagattcgagggccaggtgagacagaaggtgagaatcgtgagcagagaggccgaggccgccgaggccgaggagccctggggcgaggaggccagagagggcagaagaagaggccccagaagagagagcaagcccgaggagccccccccccccaagaagcccgccctggacaagggcctgggcaccggccagggcgccgtgagcggcccccccagaaagccccccggcaccgtggccggcaccgccagaggccccgagggcggcagcaccgcccaggtgcccgcccccaccgccagccccccccccgagggccccgtgctgaccttccagagcgagaagatgaagggcatgaaggagctgctggtggccaccaagatcaacagcagcgccatcaagctgcagctgaccgcccagagccaggtgcagatgaagaagcagaaggtgagcacccccagcgactacaccctgagcttcctgaagagacagagaaagggcctgtag

SEQ ID NO: 11605 - DNA, 1833 bp, Artificial Sequence; identical to SEQ ID NO: 11604
  Description of Artificial Sequence: Synthetic coding sequence

SEQ ID NO: 11606 - DNA, 1848 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggctggagccccgtgggcaccaagctggacagcagcggcgtggccttcgccgtggtgggcgcctgccaggccctgggcctgagagacgtgcacctggccctgagcgaggaccacgcctgggtggtgttcggccccaacggcgagcagaccgccgaggtgacctggcacggcaagggcaacgaggacagaagaggccagaccgtgaacgccggcgtggccgagagaagctggctgtacctgaagggcagctacatgagatgcgacagaaagatggaggtggccttcatggtgtgcgccatcaaccccagcatcgacctgcacaccgacagcctggagctgctgcagctgcagcagaagctgctgtggctgctgtacgacctgggccacctggagagataccccatggccctgggcaacctggccgacctggaggagctggagcccacccccggcagacccgaccccctgaccctgtaccacaagggcatcgccagcgccaagacctactacagagacgagcacatctacccctacatgtacctggccggctaccactgcagaaacagaaacgtgagagaggccctgcaggcctgggccgacaccgccaccgtgatccaggactacaactactgcagagaggacgaggagatctacaaggagttcttcgaggtggccaacgacgtgatccccaacctgctgaaggaggccgccagcctgctggaggccggcgaggagagacccggcgagcagagccagggcacccagagccagggcagcgccctgcaggaccccgagtgcttcgcccacctgctgagattctacgacggcatctgcaagtgggaggagggcagccccacccccgtgctgcacgtgggctgggccaccttcctggtgcagagcctgggcagattcgagggccaggtgagacagaaggtgagaatcgtgagcagagaggccgaggccgccgaggccgaggagccctggggcgaggaggccagagagggcagaagaagaggccccagaagagagagcaagcccgaggagccccccccccccaagaagcccgccctggacaagggcctgggcaccggccagggcgccgtgagcggcccccccagaaagccccccggcaccgtggccggcaccgccagaggccccgagggcggcagcaccgcccaggtgcccgcccccaccgccagccccccccccgagggccccgtgctgaccttccagagcgagaagatgaagggcatgaaggagctgctggtggccaccaagatcaacagcagcgccatcaagctgcagctgaccgcccagagccaggtgcagatgaagaagcagaaggtgagcacccccagcgactacaccctgagcttcctgaagagacagagaaagggcctgtag

SEQ ID NO: 11607 - DNA, 1848 bp, Artificial Sequence; identical to SEQ ID NO: 11606
  Description of Artificial Sequence: Synthetic coding sequence

SEQ ID NO: 11608 - DNA, 1668 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggcaccaagctggacagcagcggcgtggccttcgccgtggtgggcgcctgccaggccctgggcctgagagacgtgcacctggccctgagcgaggaccacgcctgggtggtgttcggccccaacggcgagcagaccgccgaggtgacctggcacggcaagggcaacgaggacagaagaggccagaccgtgaacgccggcgtggccgagagaagctggctgtacctgaagggcagctacatgagatgcgacagaaagatggaggtggccttcatggtgtgcgccatcaaccccagcatcgacctgcacaccgacagcctggagctgctgcagctgcagcagaagctgctgtggctgctgtacgacctgggccacctggagagataccccatggccctgggcaacctggccgacctggaggagctggagcccacccccggcagacccgaccccctgaccctgtaccacaagggcatcgccagcgccaagacctactacagagacgagcacatctacccctacatgtacctggccggctaccactgcagaaacagaaacgtgagagaggccctgcaggcctgggccgacaccgccaccgtgatccaggactacaactactgcagagaggacgaggagatctacaaggagttcttcgaggtggccaacgacgtgatccccaacctgctgaaggaggccgccagcctgctggaggccggcgaggagagacccggcgagcagagccaggtgagacagaaggtgagaatcgtgagcagagaggccgaggccgccgaggccgaggagccctggggcgaggaggccagagagggcagaagaagaggccccagaagagagagcaagcccgaggagccccccccccccaagaagcccgccctggacaagggcctgggcaccggccagggcgccgtgagcggcccccccagaaagccccccggcaccgtggccggcaccgccagaggccccgagggcggcagcaccgcccaggtgcccgcccccaccgccagccccccccccgagggccccgtgctgaccttccagagcgagaagatgaagggcatgaaggagctgctggtggccaccaagatcaacagcagcgccatcaagctgcagctgaccgcccagagccaggtgcagatgaagaagcagaaggtgagcacccccagcgactacaccctgagcttcctgaagagacagagaaagggcctgtag

SEQ ID NO: 11609 - DNA, 1728 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggcaccaagctggacagcagcggcgtggccttcgccgtggtgggcgcctgccaggccctgggcctgagagacgtgcacctggccctgagcgaggaccacgcctggagctggctgtacctgaagggcagctacatgagatgcgacagaaagatggaggtggccttcatggtgtgcgccatcaaccccagcatcgacctgcacaccgacagcctggagctgctgcagctgcagcagaagctgctgtggctgctgtacgacctgggccacctggagagataccccatggccctgggcaacctggccgacctggaggagctggagcccacccccggcagacccgaccccctgaccctgtaccacaagggcatcgccagcgccaagacctactacagagacgagcacatctacccctacatgtacctggccggctaccactgcagaaacagaaacgtgagagaggccctgcaggcctgggccgacaccgccaccgtgatccaggactacaactactgcagagaggacgaggagatctacaaggagttcttcgaggtggccaacgacgtgatccccaacctgctgaaggaggccgccagcctgctggaggccggcgaggagagacccggcgagcagagccagggcacccagagccagggcagcgccctgcaggaccccgagtgcttcgcccacctgctgagattctacgacggcatctgcaagtgggaggagggcagccccacccccgtgctgcacgtgggctgggccaccttcctggtgcagagcctgggcagattcgagggccaggtgagacagaaggtgagaatcgtgagcagagaggccgaggccgccgaggccgaggagccctggggcgaggaggccagagagggcagaagaagaggccccagaagagagagcaagcccgaggagccccccccccccaagaagcccgccctggacaagggcctgggcaccggccagggcgccgtgagcggcccccccagaaagccccccggcaccgtggccggcaccgccagaggccccgagggcggcagcaccgcccaggtgcccgcccccaccgccagccccccccccgagggccccgtgctgaccttccagagcgagaagatgaagggcatgaaggagctgctggtggccaccaagatcaacagcagcgccatcaagctgcagctgaccgcccagagccaggtgcagatgaagaagcagaaggtgagcacccccagcgactacaccctgagcttcctgaagagacagagaaagggcctgtag

SEQ ID NO: 11610 - DNA, 1833 bp, Artificial Sequence; identical to SEQ ID NO: 11604
  Description of Artificial Sequence: Synthetic coding sequence

SEQ ID NO: 11611 - DNA, 1848 bp, Artificial Sequence; identical to SEQ ID NO: 11606
  Description of Artificial Sequence: Synthetic coding sequence

SEQ ID NO: 11612 - DNA, 1848 bp, Artificial Sequence; identical to SEQ ID NO: 11606
  Description of Artificial Sequence: Synthetic coding sequence

SEQ ID NO: 11613 - DNA, 786 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggcaccaagctggacagcagcggcgtggccttcgccgtggtgggcgcctgccaggccctgggcctgagagacgtgcacctggccctgagcgaggaccacgcctgggtggtgttcggccccaacggcgagcagaccgccgaggtgacctggcacggcaagggcaacgaggacagaagaggccagaccgtgaacgccggcgtggccgagagaagctggctgtacctgaagggcagctacatgagatgcgacagaaagatggaggtggccttcatggtgtgcgccatcaaccccagcatcgacctgcacaccgacagcctggagctgctgcagctgcagcagtag

SEQ ID NO: 11614 - DNA, 441 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttctag

SEQ ID NO: 11615 - DNA, 441 bp, Artificial Sequence; identical to SEQ ID NO: 11614
  Description of Artificial Sequence: Synthetic coding sequence

SEQ ID NO: 11616 - DNA, 1041 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggcaccaagctggacagcagcggcgtggccttcgccgtggtgggcgcctgccaggccctgggcctgagagacgtgcacctggccctgagcgaggaccacgcctgggtggtgttcggccccaacggcgagcagaccgccgaggtgacctggcacggcaagggcaacgaggacagaagaggccagaccgtgaacgccggcgtggccgagagaagctggctgtacctgaagggcagctacatgagatgcgacagaaagatggaggtggccttcatggtgtgcgccatcaaccccagcatcgacctgcacaccgacagcctggagctgctgcagctgcagcagaagctgctgtggctgctgtacgacctgggccacctggagagataccccatggccctgggcaacctggccgacctggaggagctggagcccacccccggcagacccgaccccctgaccctgtaccacaagggcatcgccagcgccaagacctactacagagacgagcacatctacccctacatgtacctggccggctaccactgcagaaacagaaacgtgagagaggccctgcaggcctgggccgacaccgccacctag

SEQ ID NO: 11617 - DNA, 1848 bp, Artificial Sequence; identical to SEQ ID NO: 11606
  Description of Artificial Sequence: Synthetic coding sequence

SEQ ID NO: 11618 - DNA, 846 bp, Artificial Sequence
  Description of Artificial Sequence: Synthetic coding sequence
atgggcctgaaggccgcccagaagaccctgttccccctgagaagcatcgacgacgtggtgagactgttcgccgccgagctgggcagagaggagcccgacctggtgctgctgagcctggtgctgggcttcgtggagcacttcctggccgtgaacagagtgatccccaccaacgtgcccgagctgaccttccagcccagccccgcccccgacccccccggcggcctgacctacttccccgtggccgacctgagcatcatcgccgccctgtacgccagattcaccgcccagatcagaggcgccgtggacctgagcctgtaccccagagagggcggcgtgagcagcagagagctggtgaagaaggtgagcgacgtgatctggaacagcctgagcagaagctacttcaaggacagagcccacatccagagcctgttcagcttcatcaccggcaccaagctggacagcagcggcgtggccttcgccgtggtgggcgcctgccaggccctgggcctgagagacgtgcacctggccctgagcgaggaccacgcctgggtggtgttcggccccaacggcgagcagaccgccgaggtgacctggcacggcaagggcaacgaggacagaagaggccagaccgtgaacgccggcgtggccgagagaagctggctgtacctgaagggcagctacatgagatgcgacagaaagatggaggtggccttcatggtgtgcgccatcaaccccagcatcgacctgcacaccgacagcctggagctgctgcagctgcagcagaagctgctgtggctgctgtacgacctgggccacctggagagataccccatggccctgggctag

SEQ ID NO: 11619 - DNA, 1656 bp, Artificial Sequence
  Description of Artificial Sequence: Synthetic coding sequence
atggccgcccccgtgagactgggcagaaagagacccctgcccgcctgccccaaccccctgttcgtgagatggctgaccgagtggagagacgaggccaccagaagcagaagaagaaccagattcgtgttccagaaggccctgagaagcctgagaagataccccctgcccctgagaagcggcaaggaggccaagatcctgcagcacttcggcgacggcctgtgcagaatgctggacgagagactgcagagacacagaaccagcggcggcgaccacgcccccgacagccccagcggcgagaacagccccgccccccagggcagactggccgaggtgcaggacagcagcatgcccgtgcccgcccagcccaaggccggcggcagcggcagctactggcccgccagacacagcggcgccagagtgatcctgctggtgctgtacagagagcacctgaaccccaacggccaccacttcctgaccaaggaggagctgctgcagagatgcgcccagaagagccccagagtggcccccggcagcgccagaccctggcccgccctgagaagcctgctgcacagaaacctggtgctgagaacccaccagcccgccagatacagcctgacccccgagggcctggagctggcccagaagctggccgagagcgagggcctgagcctgctgaacgtgggcatcggccccaaggagccccccggcgaggagaccgccgtgcccggcgccgccagcgccgagctggccagcgaggccggcgtgcagcagcagcccctggagctgagacccggcgagtacagagtgctgctgtgcgtggacatcggcgagaccagaggcggcggccacagacccgagctgctgagagagctgcagagactgcacgtgacccacaccgtgagaaagctgcacgtgggcgacttcgtgtgggtggcccaggagaccaaccccagagaccccgccaaccccggcgagctggtgctggaccacatcgtggagagaaagagactggacgacctgtgcagcagcatcatcgacggcagattcagagagcagaagttcagactgaagagatgcggcctggagagaagagtgtacctggtggaggagcacggcagcgtgcacaacctgagcctgcccgagagcaccctgctgcaggccgtgaccaacacccaggtgatcgacggcttcttcgtgaagagaaccgccgacatcaaggagagcgccgcctacctggccctgctgaccagaggcctgcagagactgtaccagggccacaccctgagaagcagaccctggggcacccccggcaaccccgagagcggcgccatgaccagccccaaccccctgtgcagcctgctgaccttcagcgacttcaacgccggcgccatcaagaacaaggcccagagcgtgagagaggtgttcgccagacagctgatgcaggtgagaggcgtgagcggcgagaaggccgccgccctggtggacagatacagcacccccgccagcctgctggccgcctacgacgcctgcgccacccccaaggagcaggagaccctgctgagcaccatcaagtgcggcagactgcagagaaacctgggccccgccctgagcagaaccctgagccagctgtactgcagctacggccccctgacctag

SEQ ID NO: 11620 - DNA, 1656 bp, Artificial Sequence; identical to SEQ ID NO: 11619
  Description of Artificial Sequence: Synthetic coding sequence

SEQ ID NO: 11621 - DNA, 2490 bp, Artificial Sequence
  Description of Artificial Sequence: Synthetic coding sequence
atgaacagcggcgtggccatgaagtacggcaacgacagcagcgccgagctgagcgagctgcacagcgccgccctggccagcctgaagggcgacatcgtggagctgaacaagagactgcagcagaccgagagagagagagacctgctggagaagaagctggccaaggcccagtgcgagcagagccacctgatgagagagcacgaggacgtgcaggagagaaccaccctgagatacgaggagagaatcaccgagctgcacagcgtgatcgccgagctgaacaagaagatcgacagactgcagggcaccaccatcagagaggaggacgagtacagcgagctgagaagcgagctgagccagagccagcacgaggtgaacgaggacagcagaagcatggaccaggaccagaccagcgtgagcatccccgagaaccagagcaccatggtgaccgccgacatggacaactgcagcgacctgaacagcgagctgcagagagtgctgaccggcctggagaacgtggtgtgcggcagaaagaagagcagctgcagcctgagcgtggccgaggtggacaagcacatcgagcagctgaccaccgccagcgagcactgcgacctggccatcaagaccgtggaggagatcgagggcgtgctgggcagagacctgtaccccaacctggccgaggagagaagcagatgggagaaggagctggccggcctgagagaggagaacgagagcctgaccgccatgctgtgcagcaaggaggaggagctgaacagaaccaaggccaccatgaacgccatcagagaggagagagacagactgagaagaagagtgagagagctgcagaccagactgcagagcgtgcaggccaccggccccagcagccccggcagactgaccagcaccaacagacccatcaaccccagcaccggcgagctgagcaccagcagcagcagcaacgacatccccatcgccaagatcgccgagagagtgaagctgagcaagaccagaagcgagagcagcagcagcgacagacccgtgctgggcagcgagatcagcagcatcggcgtgagcagcagcgtggccgagcacctggcccacagcctgcaggactgcagcaacatccaggagatcttccagaccctgtacagccacggcagcgccatcagcgagagcaagatcagagagttcgaggtggagaccgagagactgaacagcagaatcgagcacctgaagagccagaacgacctgctgaccatcaccctggaggagtgcaagagcaacgccgagagaatgagcatgctggtgggcaagtacgagagcaacgccaccgccctgagactggccctgcagtacagcgagcagtgcatcgaggcctacgagctgctgctggccctggccgagagcgagcagagcctgatcctgggccagttcagagccgccggcgtgggcagcagccccggcgaccagagcggcgacgagaacatcacccagatgctgaagagagcccacgactgcagaaagaccgccgagaacgccgccaaggccctgctgatgaagctggacggcagctgcggcggcgccttcgccgtggccggctgcagcgtgcagccctgggagagcctgagcagcaacagccacaccagcaccaccagcagcaccgccagcagctgcgacaccgagttcaccaaggaggacgagcagagactgaaggactacatccagcagctgaagaacgacagagccgccgtgaagctgaccatgctggagctggagagcatccacatcgaccccctgagctacgacgtgaagcccagaggcgacagccagagactggacctggagaacgccgtgctgatgcaggagctgatggccatgaaggaggagatggccgagctgaaggcccagctgtacctgctggagaaggagaagaaggccctggagctgaagctgagcaccagagaggcccaggagcaggcctacctggtgcacatcgagcacctgaagagcgaggtggaggagcagaaggagcagagaatgagaagcctgagcagcaccagcagcggcagcaaggacaagcccggcaaggagtgcgccgacgccgccagccccgccctgagcctggccgagctgagaaccacctgcagcgagaacgagctggccgccgagttcaccaacgccatcagaagagagaagaagctgaaggccagagtgcaggagctggtgagcgccctggagagactgaccaagagcagcgagatcagacaccagcagagcgccgagttcgtgaacgacctgaagagagccaacagcaacctggtggccgcctacgagaaggccaagaagaagcaccagaacaagctgaagaagctggagagccagatgatggccatggtggagagacacgagacccaggtgagaatgctgaagcagagaatcgccctgctggaggaggagaacagcagaccccacaccaacgagaccagcctgtag

SEQ ID NO: 11622 - DNA, 2133 bp, Artificial Sequence
  Description of Artificial Sequence: Synthetic coding sequence
atgaagctggtgttcctggtgctgctgttcctgggcgccctgggcctgtgcctggccggcagaagaagaagcgtgcagtggtgcgccgtgagccagcccgaggccaccaagtgcttccagtggcagagaaacatgagaaaggtgagaggcccccccgtgagctgcatcaagagagacagccccatccagtgcatccaggccatcgccgagaacagagccgacgccgtgaccctggacggcggcttcatctacgaggccggcctggccccctacaagctgagacccgtggccgccgaggtgtacggcaccgagagacagcccagaacccactactacgccgtggccgtggtgaagaagggcggcagcttccagctgaacgagctgcagggcctgaagagctgccacaccggcctgagaagaaccgccggctggaacgtgcccatcggcaccctgagacccttcctgaactggaccggcccccccgagcccatcgaggccgccgtggccagattcttcagcgccagctgcgtgcccggcgccgacaagggccagttccccaacctgtgcagactgtgcgccggcaccggcgagaacaagtgcgccttcagcagccaggagccctacttcagctacagcggcgccttcaagtgcctgagagacggcgccggcgacgtggccttcatcagagagagcaccgtgttcgaggacctgagcgacgaggccgagagagacgagtacgagctgctgtgccccgacaacaccagaaagcccgtggacaagttcaaggactgccacctggccagagtgcccagccacgccgtggtggccagaagcgtgaacggcaaggaggacgccatctggaacctgctgagacaggcccaggagaagttcggcaaggacaagagccccaagttccagctgttcggcagccccagcggccagaaggacctgctgttcaaggacagcgccatcggcttcagcagagtgccccccagaatcgacagcggcctgtacctgggcagcggctacttcaccgccatccagaacctgagaaagagcgaggaggaggtggccgccagaagagccagagtggtgtggtgcgccgtgggcgagcaggagctgagaaagtgcaaccagtggagcggcctgagcgagggcagcgtgacctgcagcagcgccagcaccaccgaggactgcatcgccctggtgctgaagggcgaggccgacgccatgagcctggacggcggctacgtgtacaccgccggcaagtgcggcctggtgcccgtgctggccgagaactacaagagccagcagagcagcgaccccgaccccaactgcgtggacagacccgtggagggctacctggccgtggccgtggtgagaagaagcgacaccagcctgacctggaacagcgtgaagggcaagaagagctgccacaccgccgtggacagaaccgccggctggaacatccccatgggcctgctgttcaaccagaccggcagctgcaagttcgacgagtacttcagccagagctgcgcccccggcagcgaccccagaagcaacctgtgcgccctgtgcatcggcgacgagcagggcgagaacaagtgcgtgcccaacagcaacgagagatactacggctacaccggcgccttcagatgcctggccgagaacgccggcgacgtggccttcgtgaaggacgtgaccgtgctgcagaacaccgacggcaacaacaacgaggcctgggccaaggacctgaagctggccgacttcgccctgctgtgcctggacggcaagagaaagcccgtgaccgaggccagaagctgccacctggccatggcccccaaccacgccgtggtgagcagaatggacaaggtggagagactgaagcaggtgctgctgcaccagcaggccaagttcggcagaaacggcagcgactgccccgacaagttctgcctgttccagagcgagaccaagaacctgctgttcaacgacaacaccgagtgcctggccagactgcacggcaagaccacctacgagaagtacctgggcccccagtacgtggccggcatcaccaacctgaagaagtgcagcaccagccccctgctggaggcctgcgagttcctgagaaagtag

SEQ ID NO: 11623 - DNA, 1656 bp, Artificial Sequence
  Description of Artificial Sequence: Synthetic coding sequence
aagcccctgctgaaccacgtgctggccatcaagggccccagaagcagatggagaaccttctacaacatcgccaccagaagaaaggccctgaagaaccccagcgaggagtacggcaagatcctggaggtggtgggcagatacagcgtgcacaacgccggcatcagcttcagcgtgaagaagcagggcgagaccgtggccgacgtgagaaccctgcccaacgccagcaccgtggacaacatcagaagcatcttcggcaacgccgtgagcagagagctgatcgagatcggctgcgaggacaagaccctggccttcaagatgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaccctgctgcccggcctggccggccccagcggcgagatggtgaagagcaccaccagcctgaccagcagcagcaccagcggcagcagcgacaaggtgtacgcccaccagatggtgagaaccgacagcagagagcagaagctggacgccttcctgcagcccctgagcaagcccctgagcagccagccccaggccatcgtgaccgaggacaagaccgacatcagcagcggcagagccagacagcaggacgaggagatgctggagctgcccgcccccgccgaggtggccgccaagaaccagagcctggagggcgacaccaccaagggcaccagcgagatgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagcgaggagctgttctaccagatcctgatctacgacttcgccaacttcggcgtgctgagactgagcgagcccgcccccctgttcgacctggccatgctggccctggacagccccgagagcggctggaccgaggaggacggccccaaggagggcctggccgagtacatcgtggagttcctgaagaagaaggccgagatgctggccgactacttcagcctggagatcgacgagagcgaggtgcccggcagcatccccaacagctggaagtggaccgtggagcacatcgtgtacaaggccctgagaagccacatcctgccccccaagcacttcaccgaggacggcaacatcctgcagctggccaacctgcccgacctgtacaaggtgttcgagagatgctag

SEQ ID NO: 11624 - DNA, 351 bp, Artificial Sequence
  Description of Artificial Sequence: Synthetic coding sequence
atgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagagtgaagtgcctggcccccttccagacccccggcagcggcctgtggaacacctag

SEQ ID NO: 11625 - DNA, 525 bp, Artificial Sequence
  Description of Artificial Sequence: Synthetic coding sequence
atgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagccctggcacagcatcaagcccagctacaccttcagcaccccccccagcttcagcgaggagctgttctaccagatcctgatctacgacttcgccaacttcggcgtgctgagactgagcagcgaggtgcccggcagcatccccaacagctggaagtggaccgtggagcacatcgtgtacaaggccctgagaagccacatcctgccccccaagcacttcaccgaggacggcaacatcctgcagctggccaacctgcccgacctgtacaaggtgttcgagagatgctag

SEQ ID NO: 11626 - DNA, 1977 bp, Artificial Sequence
  Description of Artificial Sequence: Synthetic coding sequence
atggccttcgaggccctggccagcatcagccacgtggcccacgtgaccatcaccaccaagaccgccgacggcaagtgcgcctacagagccagctacagcgacggcaagctgaaggccccccccaagccctgcgccggcaaccagggcacccagatcaccgtggaggacctgttctacaacatcgccaccagaagaaaggccctgaagaaccccagcgaggagtacggcaagatcctggaggtggtgggcagatacagcgtgcacaacgccggcatcagcttcagcgtgaagaagcagggcgagaccgtggccgacgtgagaaccctgcccaacgccagcaccgtggacaacatcagaagcatcttcggcaacgccgtgagcagagagctgatcgagatcggctgcgaggacaagaccctggccttcaagatgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaccctgctgcccggcctggccggccccagcggcgagatggtgaagagcaccaccagcctgaccagcagcagcaccagcggcagcagcgacaaggtgtacgcccaccagatggtgagaaccgacagcagagagcagaagctggacgccttcctgcagcccctgagcaagcccctgagcagccagccccaggccatcgtgaccgaggacaagaccgacatcagcagcggcagagccagacagcaggacgaggagatgctggagctgcccgcccccgccgaggtggccgccaagaaccagagcctggagggcgacaccaccaagggcaccagcgagatgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagcgaggagctgttctaccagatcctgatctacgacttcgccaacttcggcgtgctgagactgagcgagcccgcccccctgttcgacctggccatgctggccctggacagccccgagagcggctggaccgaggaggacggccccaaggagggcctggccgagtacatcgtggagttcctgaagaagaaggccgagatgctggccgactacttcagcctggagatcgacgaggagggcaacctgatcggcctgcccctgctgatcgacaactacgtgccccccctggagggcctgcccatcttcatcctgagactggccaccgaggtgaactgggacgaggagaaggagtgcttcgagagcctgagcaaggagtgcgccatgttctacagcatcagaaagcagtacatcagcgaggagagcaccctgagcggccagcagagcgaggtgcccggcagcatccccaacagctggaagtggaccgtggagcacatcgtgtacaaggccctgagaagccacatcctgccccccaagcacttcaccgaggacggcaacatcctgcagctggccaacctgcccgacctgtacaaggtgttcgagagatgctag

SEQ ID NO: 11627 - DNA, 960 bp, Artificial Sequence
  Description of Artificial Sequence: Synthetic coding sequence
atgatcgagaactgcctggacgccaagagcaccagcatccaggtgatcgtgaaggagggcggcctgaagctgatccagatccaggacaacggcaccggcatcagaaaggaggacctggacatcgtgtgcgagagattcaccaccagcaagctgcagagcttcgaggacctggccagcatcagcacctacggcttcagaggcgaggccctggccagcatcagccacgtggcccacgtgaccatcaccaccaagaccgccgacggcaagtgcgcctacagagccagctacagcgacggcaagctgaaggccccccccaagccctgcgccggcaaccagggcacccagatcaccgtggaggacctgttctacaacatcgccaccagaagaaaggccctgaagaaccccagcgaggagtacggcaagatcctggaggtggtgggcagatacagcgtgcacaacgccggcatcagcttcagcgtgaagaagcagggcgagaccgtggccgacgtgagaaccctgcccaacgccagcaccgtggacaacatcagaagcatcttcggcaacgccgtgagcagagagctgatcgagatcggctgcgaggacaagaccctggccttcaagatgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaaggagaccagcggcagattctag

SEQ ID NO: 11628 - DNA, 1548 bp, Artificial Sequence
  Description of Artificial Sequence: Synthetic coding sequence
atgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaccctgctgcccggcctggccggccccagcggcgagatggtgaagagcaccaccagcctgaccagcagcagcaccagcggcagcagcgacaaggtgtacgcccaccagatggtgagaaccgacagcagagagcagaagctggacgccttcctgcagcccctgagcaagcccctgagcagccagccccaggccatcgtgaccgaggacaagaccgacatcagcagcggcagagccagacagcaggacgaggagatgctggagctgcccgcccccgccgaggtggccgccaagaaccagagcctggagggcgacaccaccaagggcaccagcgagatgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagcgaggagctgttctaccagatcctgatctacgacttcgccaacttcggcgtgctgagactgagcgagcccgcccccctgttcgacctggccatgctggccctggacagccccgagagcggctggaccgaggaggacggccccaaggagggcctggccgagtacatcgtggagttcctgaagaagaaggccgagatgctggccgactacttcagcctggagatcgacgaggagggcaacctgatcggcctgcccctgctgatcgacaactacgtgccccccctggagggcctgcccatcttcatcctgagactggccaccgaggtgaactgggacgaggagaaggagtgcttcgagagcctgagcaaggagtgcgccatgttctacagcatcagaaagcagtacatcagcgaggagagcaccctgagcggccagcagagcgaggtgcccggcagcatccccaacagctggaagtggaccgtggagcacatcgtgtacaaggccctgagaagccacatcctgccccccaagcacttcaccgaggacggcaacatcctgcagctggccaacctgcccgacctgtacaaggtgttcgagagatgctag

SEQ ID NO: 11629 - DNA, 2040 bp, Artificial Sequence
  Description of Artificial Sequence: Synthetic coding sequence
tgaagactggacgagaccgtggtgaacagaatcgccgccggcgaggtgatccagagacccgccaacgccatcaaggagatgatcgagaactgcctggacgccaagagcaccagcatccaggtgatcgtgaaggagggcggcctgaagctgatccagatccaggacaacggcaccggcatcagaaaggaggacctggacatcgtgtgcgagagattcaccaccagcaagctgcagagcttcgaggacctggccagcatcagcacctacggcttcagaggcgaggccctggccagcatcagccacgtggcccacgtgaccatcaccaccaagaccgccgacggcaagtgcgcctacagagccagctacagcgacggcaagctgaaggccccccccaagccctgcgccggcaaccagggcacccagatcaccgtggaggacctgttctacaacatcgccaccagaagaaaggccctgaagaaccccagcgaggagtacggcaagatcctggaggtggtgggcagatacagcgtgcacaacgccggcatcagcttcagcgtgaagaagcagggcgagaccgtggccgacgtgagaaccctgcccaacgccagcaccgtggacaacatcagaagcatcttcggcaacgccgtgagcagagagctgatcgagatcggctgcgaggacaagaccctggccttcaagatgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaccctgctgcccggcctggccggccccagcggcgagatggtgaagagcaccaccagcctgaccagcagcagcaccagcggcagcagcgacaaggtgtacgcccaccagatggtgagaaccgacagcagagagcagaagctggacgccttcctgcagcccctgagcaagcccctgagcagccagccccaggccatcgtgaccgaggacaagaccgacatcagcagcggcagagccagacagcaggacgaggagatgctggagctgcccgcccccgccgaggtggccgccaagaaccagagcctggagggcgacaccaccaagggcaccagcgagatgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagcgaggagctgttctaccagatcctgatctacgacttcgccaacttcggcgtgctgagactgagcgagcccgcccccctgttcgacctggccatgctggccctggacagccccgagagcggctggaccgaggaggacggccccaaggagggcctggccgagtacatcgtggagttcctgaagaagaaggccgagatgctggccgactacttcagcctggagatcgacgagagcgaggtgcccggcagcatccccaacagctggaagtggaccgtggagcacatcgtgtacaaggccctgagaagccacatcctgccccccaagcacttcaccgaggacggcaacatcctgcagctggccaacctgcccgacctgtacaaggtgttcgagagatgctag

SEQ ID NO: 11630 - DNA, 1548 bp, Artificial Sequence; identical to SEQ ID NO: 11628
  Description of Artificial Sequence: Synthetic coding sequence

SEQ ID NO: 11631 - DNA, 1383 bp, Artificial Sequence
  Description of Artificial Sequence: Synthetic coding sequence
atgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagcctggagatcagcccccagaacgtggacgtgaacgtgcaccccaccaagcacgaggtgcacttcctgcacgaggagagcatcctggagagagtgcagcagcacatcgagagcaagctgctgggcagcaacagcagcagaatgtacttcacccagaccctgctgcccggcctggccggccccagcggcgagatggtgaagagcaccaccagcctgaccagcagcagcaccagcggcagcagcgacaaggtgtacgcccaccagatggtgagaaccgacagcagagagcagaagctggacgccttcctgcagcccctgagcaagcccctgagcagccagccccaggccatcgtgaccgaggacaagaccgacatcagcagcggcagagccagacagcaggacgaggagatgctggagctgcccgcccccgccgaggtggccgccaagaaccagagcctggagggcgacaccaccaagggcaccagcgagatgagcgagaagagaggccccaccagcagcaaccccagaaagagacacagagaggacagcgacgtggagatggtggaggacgacagcagaaaggagatgaccgccgcctgcacccccagaagaagaatcatcaacctgaccagcgtgctgagcctgcaggaggagatcaacgagcagggccacgaggtgctgagagagatgctgcacaaccacagcttcgtgggctgcgtgaacccccagtgggccctggcccagcaccagaccaagctgtacctgctgaacaccaccaagctgagcgaggagctgttctaccagatcctgatctacgacttcgccaacttcggcgtgctgagactgagcgagcccgcccccctgttcgacctggccatgctggccctggacagccccgagagcggctggaccgaggaggacggccccaaggagggcctggccgagtacatcgtggagttcctgaagaagaaggccgagatgctggccgactacttcagcctggagatcgacgaggagggcaacctgatcggcctgcccctgctgatcgacaactacgtgccccccctggagggcctgcccatcttcatcctgagactggccaccgaggtgaactgggacgaggagaaggagtgcttcgagagcctgagcaaggagtgcgccatgttctacagcatcagaaagcagtacatcagcgaggagagcaccctgagcggccagcagtag

SEQ ID NO: 11632 - DNA, 843 bp, Artificial Sequence
  Description of Artificial Sequence: Synthetic coding sequence
atgatcgagaactgcctggacgccaagagcaccagcatccaggtgatcgtgaaggagggcggcctgaagctgatccagatccaggacaacggcaccggcatcagaaaggaggacctggacatcgtgtgcgagagattcaccaccagcaagctgcagagcttcgaggacctggccagcatcagcacctacggcttcagaggcgaggccctggccagcatcagccacgtggcccacgtgaccatcaccaccaagaccgccgacggcaagtgcgcctacagagccagctacagcgacggcaagctgaaggccccccccaagccctgcgccggcaaccagggcacccagatcaccgtggaggacctgttctacaacatcgccaccagaagaaaggccctgaagaaccccagcgaggagtacggcaagatcctggaggtggtgggcagatacagcgtgcacaacgccggcatcagcttcagcgtgaagaagcagggcgagaccgtggccgacgtgagaaccctgcccaacgccagcaccgtggacaacatcagaagcatcttcggcaacgccgtgagcagagagctgatcgagatcggctgcgaggacaagaccctggccttcaagatgaacggctacatcagcaacgccaactacagcgtgaagaagtgcatcttcctgctgttcatcaaccacagactggtggagagcaccagcctgagaaaggccatcgagaccgtgtacgccgcctacctgcccaagaacacccaccccttcctgtacctgagactgtgctaccaggacctgctggcccccctgggcagatggctgaacccccagcaggtgtag

SEQ ID NO: 11633 - DNA, 1548 bp, Artificial Sequence; identical to SEQ ID NO: 11628
  Description of Artificial Sequence: Synthetic coding sequence

SEQ ID NO: 11634 - DNA, 4290 bp, Artificial Sequence
  Description of Artificial Sequence: Synthetic coding sequence
atgatcaagtgcctgagcgtggaggtgcaggccaagctgagaagcggcctggccatcagcagcctgggccagtgcgtggaggagctggccctgaacagcatcgacgccgaggccaagtgcgtggccgtgagagtgaacatggagaccttccaggtgcaggtgatcgacaacggcttcggcatgggcagcgacgacgtggagaaggtgggcaacagatacttcaccagcaagtgccacagcgtgcaggacctggagaaccccagattctacggcttcagaggcgaggccctggccaacatcgccgacatggccagcgccgtggagatcagcagcaagaagaacagaaccatgaagaccttcgtgaagctgttccagagcggcaaggccctgaaggcctgcgaggccgacgtgaccagagccagcgccggcaccaccgtgaccgtgtacaacctgttctaccagctgcccgtgagaagaaagtgcatggaccccagactggagttcgagaaggtgagacagagaatcgaggccctgagcctgatgcaccccagcatcagcttcagcctgagaaacgacgtgagcggcagcatggtgctgcagctgcccaagaccaaggacgtgtgcagcagattctgccagatctacggcctgggcaagagccagaagctgagagagatcagcttcaagtacaaggagttcgagctgagcggctacatcagcagcgaggcccactacaacaagaacatgcagttcctgttcgtgaacaagagactggtgctgagaaccaagctgcacaagctgatcgacttcctgctgagaaaggagagcatcatctgcaagcccaagaacggccccaccagcagacagatgaacagcagcctgagacacagaagcacccccgagctgtacggcatctacgtgatcaacgtgcagtgccagttctgcgagtacgacgtgtgcatggagcccgccaagaccctgatcgagttccagaactgggacaccctgctgttctgcatccaggagggcgtgaagatgttcctgaagcaggagaagctgttcgtggagctgagcggcgaggacatcaaggagttcagcgaggacaacggcttcagcctgttcgacgccaccctgcagaagagagtgaccagcgacgagagaagcaacttccaggaggcctgcaacaacatcctggacagctacgagatgttcaacctgcagagcaaggccgtgaagagaaagaccaccgccgagaacgtgaacacccagagcagcagagacagcgaggccaccagaaagaacaccaacgacgccttcctgtacatctacgagagcggcggccccggccacagcaagatgaccgagcccagcctgcagaacaaggacagcagctgcagcgagagcaagatgctggagcaggagaccatcgtggccagcgaggccggcgagaacgagaagcacaagaagagcttcctggagcacagcagcctggagaacccctgcggcaccagcctggagatgttcctgagccccttccagaccccctgccacttcgaggagagcggccaggacctggagatctggaaggagagcaccaccgtgaacggcatggccgccaacatcctgaagaacaacagaatccagaaccagcccaagagattcaaggacgccaccgaggtgggctgccagcccctgcccttcgccaccaccctgtggggcgtgcacagcgcccagaccgagaaggagaagaagaaggagagcagcaactgcggcagaagaaacgtgttcagctacggcagagtgaagctgtgcagcaccggcttcatcacccacgtggtgcagaacgagaagaccaagagcaccgagaccgagcacagcttcaagaactacgtgagacccggccccaccagagcccaggagaccttcggcaacagaaccagacacagcgtggagacccccgacatcaaggacctggccagcaccctgagcaaggagagcggccagctgcccaacaagaagaactgcagaaccaacatcagctacggcctggagaacgagcccaccgccacctacaccatgttcagcgccttccaggagggcagcaagaagagccagaccgactgcatcctgagcgacaccagccccagcttcccctggtacagacacgtgagcaacgacagcagaaagaccgacaagctgatcggcttcagcaagcccatcgtgagaaagaagctgagcctgagcagccagctgggcagcctggagaagttcaagagacagtacggcaaggtggagaaccccctggacaccgaggtggaggagagcaacggcgtgaccaccaacctgagcctgcaggtggagcccgacatcctgctgaaggacaagaacagactggagaacagcgacgtgtgcaagatcaccaccatggagcacagcgacagcgacagcagctgccagcccgccagccacatcctgaacagcgagaagttccccttcagcaaggacgaggactgcctggagcagcagatgcccagcctgagagagagccccatgaccctgaaggagctgagcctgttcaacagaaagcccctggacctggagaagagcagcgagagcctggccagcaagctgagcagactgaagggcagcgagagagagacccagaccatgggcatgatgagcagattcaacgagctgcccaacagcgacagcagcagaaaggacagcaagctgtgcagcgtgctgacccaggacttctgcatgctgttcaacaacaagcacgagaagaccgagaacggcgtgatccccaccagcgacagcgccacccaggacaacagcttcaacaagaacagcaagacccacagcaacagcaacaccaccgagaactgcgtgatcagcgagacccccctggtgctgccctacaacaacagcaaggtgaccggcaaggacagcgacgtgctgatcagagccagcgagcagcagatcggcagcctggacagccccagcggcatgctgatgaaccccgtggaggacgccaccggcgaccagaacggcatctgcttccagagcgaggagagcaaggccagagcctgcagcgagaccgaggagagcaacacctgctgcagcgactggcagagacacttcgacgtggccctgggcagaatggtgtacgtgaacaagatgaccggcctgagcaccttcatcgcccccaccgaggacatccaggccgcctgcaccaaggacctgaccaccgtggccgtggacgtggtgctggagaacggcagccagtacagatgccagcccttcagaagcgacctggtgctgcccttcctgcccagagccagagccgagagaaccgtgatgagacaggacaacagagacaccgtggacgacaccgtgagcagcgagagcctgcagagcctgttcagcgagtgggacaaccccgtgttcgccagataccccgaggtggccgtggacgtgagcagcggccaggccgagagcctggccgtgaagatccacaacatcctgtacccctacagattcaccaagggcatgatccacagcatgcaggtgctgcagcaggtggacaacaagttcatcgcctgcctgatgagcaccaagaccgaggagaacggcgaggccgacagctacgagaagcagcaggcccagggcagcggcagaaagaagctgctgagcagcaccctgatcccccccctggagatcaccgtgaccgaggagcagagaagactgctgtggtgctaccacaagaacctggaggacctgggcctggagttcgtgttccccgacaccagcgacagcctggtgctggtgggcaaggtgcccctgtgcttcgtggagagagaggccaacgagctgagaagaggcagaagcaccgtgaccaagagcatcgtggaggagttcatcagagagcagctggagctgctgcagaccaccggcggcatccagggcaccctgcccctgaccgtgcagaaggtgctggccagccaggcctgccacggcgccatcaagttcaacgacggcctgagcctgcaggagagctgcagactgatcgaggccctgagcagctgccagctgcccttccagtgcgcccacggcagacccagcatgctgcccctggccgacatcgaccacctggagcaggagaagcagatcaagcccaacctgaccaagctgagaaagatggcccaggcctggagactgttcggcaaggccgagtgcgacaccagacagagcctgcagcagagcatgcccccctgcgagcccccctag

SEQ ID NO: 11635 - DNA, 4362 bp, Artificial Sequence
  Description of Artificial Sequence: Synthetic coding sequence
atgatcaagtgcctgagcgtggaggtgcaggccaagctgagaagcggcctggccatcagcagcctgggccagtgcgtggaggagctggccctgaacagcatcgacgccgaggccaagtgcgtggccgtgagagtgaacatggagaccttccaggtgcaggtgatcgacaacggcttcggcatgggcagcgacgacgtggagaaggtgggcaacagatacttcaccagcaagtgccacagcgtgcaggacctggagaaccccagattctacggcttcagaggcgaggccctggccaacatcgccgacatggccagcgccgtggagatcagcagcaagaagaacagaaccatgaagaccttcgtgaagctgttccagagcggcaaggccctgaaggcctgcgaggccgacgtgaccagagccagcgccggcaccaccgtgaccgtgtacaacctgttctaccagctgcccgtgagaagaaagtgcatggaccccagactggagttcgagaaggtgagacagagaatcgaggccctgagcctgatgcaccccagcatcagcttcagcctgagaaacgacgtgagcggcagcatggtgctgcagctgcccaagaccaaggacgtgtgcagcagattctgccagatctacggcctgggcaagagccagaagctgagagagatcagcttcaagtacaaggagttcgagctgagcggctacatcagcagcgaggcccactacaacaagaacatgcagttcctgttcgtgaacaagagactggtgctgagaaccaagctgcacaagctgatcgacttcctgctgagaaaggagagcatcatctgcaagcccaagaacggccccaccagcagacagatgaacagcagcctgagacacagaagcacccccgagctgtacggcatctacgtgatcaacgtgcagtgccagttctgcgagtacgacgtgtgcatggagcccgccaagaccctgatcgagttccagaactgggacaccctgctgttctgcatccaggagggcgtgaagatgttcctgaagcaggagaagctgttcgtggagctgagcggcgaggacatcaaggagttcagcgaggacaacggcttcagcctgttcgacgccaccctgcagaagagagtgaccagcgacgagagaagcaacttccaggaggcctgcaacaacatcctggacagctacgagatgttcaacctgcagagcaaggccgtgaagagaaagaccaccgccgagaacgtgaacacccagagcagcagagacagcgaggccaccagaaagaacaccaacgacgccttcctgtacatctacgagagcggcggccccggccacagcaagatgaccgagcccagcctgcagaacaaggacagcagctgcagcgagagcaagatgctggagcaggagaccatcgtggccagcgaggccggcgagaacgagaagcacaagaagagcttcctggagcacagcagcctggagaacccctgcggcaccagcctggagatgttcctgagccccttccagaccccctgccacttcgaggagagcggccaggacctggagatctggaaggagagcaccaccgtgaacggcatggccgccaacatcctgaagaacaacagaatccagaaccagcccaagagattcaaggacgccaccgaggtgggctgccagcccctgcccttcgccaccaccctgtggggcgtgcacagcgcccagaccgagaaggagaagaagaaggagagcagcaactgcggcagaagaaacgtgttcagctacggcagagtgaagctgtgcagcaccggcttcatcacccacgtggtgcagaacgagaagaccaagagcaccgagaccgagcacagcttcaagaactacgtgagacccggccccaccagagcccaggagaccttcggcaacagaaccagacacagcgtggagacccccgacatcaaggacctggccagcaccctgagcaaggagagcggccagctgcccaacaagaagaactgcagaaccaacatcagctacggcctggagaacgagcccaccgccacctacaccatgttcagcgccttccaggagggcagcaagaagagccagaccgactgcatcctgagcgacaccagccccagcttcccctggtacagacacgtgagcaacgacagcagaaagaccgacaagctgatcggcttcagcaagcccatcgtgagaaagaagctgagcctgagcagccagctgggcagcctggagaagttcaagagacagtacggcaaggtggagaaccccctggacaccgaggtggaggagagcaacggcgtgaccaccaacctgagcctgcaggtggagcccgacatcctgctgaaggacaagaacagactggagaacagcgacgtgtgcaagatcaccaccatggagcacagcgacagcgacagcagctgccagcccgccagccacatcctgaacagcgagaagttccccttcagcaaggacgaggactgcctggagcagcagatgcccagcctgagagagagccccatgaccctgaaggagctgagcctgttcaacagaaagcccctggacctggagaagagcagcgagagcctggccagcaagctgagcagactgaagggcagcgagagagagacccagaccatgggcatgatgagcagattcaacgagctgcccaacagcgacagcagcagaaaggacagcaagctgtgcagcgtgctgacccaggacttctgcatgctgttcaacaacaagcacgagaagaccgagaacggcgtgatccccaccagcgacagcgccacccaggacaacagcttcaacaagaacagcaagacccacagcaacagcaacaccaccgagaactgcgtgatcagcgagacccccctggtgctgccctacaacaacagcaaggtgaccggcaaggacagcgacgtgctgatcagagccagcgagcagcagatcggcagcctggacagccccagcggcatgctgatgaaccccgtggaggacgccaccggcgaccagaacggcatctgcttccagagcgaggagagcaaggccagagcctgcagcgagaccgaggagagcaacacctgctgcagcgactggcagagacacttcgacgtggccctgggcagaatggtgtacgtgaacaagatgaccggcctgagcaccttcatcgcccccaccgaggacatccaggccgcctgcaccaaggacctgaccaccgtggccgtggacgtggtgctggagaacggcagccagtacagatgccagcccttcagaagcgacctggtgctgcccttcctgcccagagccagagccgagagaaccgtgatgagacaggacaacagagacaccgtggacgacaccgtgagcagcgagagcctgcagagcctgttcagcgagtgggacaaccccgtgttcgccagataccccgaggtggccgtggacgtgagcagcggccaggccgagagcctggccgtgaagatccacaacatcctgtacccctacagattcaccaagggcatgatccacagcatgcaggtgctgcagcaggtggacaacaagttcatcgcctgcctgatgagcaccaagaccgaggagaacggcgaggccggcggcaacctgctggtgctggtggaccagcacgccgcccacgagagaatcagactggagcagctgatcatcgacagctacgagaagcagcaggcccagggcagcggcagaaagaagctgctgagcagcaccctgatcccccccctggagatcaccgtgaccgaggagcagagaagactgctgtggtgctaccacaagaacctggaggacctgggcctggagttcgtgttccccgacaccagcgacagcctggtgctggtgggcaaggtgcccctgtgcttcgtggagagagaggccaacgagctgagaagaggcagaagcaccgtgaccaagagcatcgtggaggagttcatcagagagcagctggagctgctgcagaccaccggcggcatccagggcaccctgcccctgaccgtgcagaaggtgctggccagccaggcctgccacggcgccatcaagttcaacgacggcctgagcctgcaggagagctgcagactgatcgaggccctgagcagctgccagctgcccttccagtgcgcccacggcagacccagcatgctgcccctggccgacatcgaccacctggagcaggagaagcagatcaagcccaacctgaccaagctgagaaagatggcccaggcctggagactgttcggcaaggccgagtgcgacaccagacagagcctgcagcagagcatgcccccctgcgagcccccctag

SEQ ID NO: 11636 - DNA, 1176 bp, Artificial Sequence
  Description of Artificial Sequence: Synthetic coding sequence
atggtgtacgtgaacaagatgaccggcctgagcaccttcatcgcccccaccgaggacatccaggccgcctgcaccaaggacctgaccaccgtggccgtggacgtggtgctggagaacggcagccagtacagatgccagcccttcagaagcgacctggtgctgcccttcctgcccagagccagagccgagagaaccgtgatgagacaggacaacagagacaccgtggacgacaccgtgagcagcgagagcctgcagagcctgttcagcgagtgggacaaccccgtgttcgccagataccccgaggtggccgtggacgtgagcagcggccaggccgagagcctggccgtgaagatccacaacatcctgtacccctacagattcaccaagggcatgatccacagcatgcaggtgctgcagcaggtggacaacaagttcatcgcctgcctgatgagcaccaagaccgaggagaacggcgaggccggcggcaacctgctggtgctggtggaccagcacgccgcccacgagagaatcagactggagcagctgatcatcgacagctacgagaagcagcaggcccagggcagcggcagaaagaagctgctgagcagcaccctgatcccccccctggagatcaccgtgaccgaggagcagagaagactgctgtggtgctaccacaagaacctggaggacctgggcctggagttcgtgttccccgacaccagcgacagcctggtgctggtgggcaaggtgcccctgtgcttcgtggagagagaggccaacgagctgagaagaggcagaagcaccgtgaccaagagcatcgtggagctgctgcagaccaccggcggcatccagggcaccctgcccctgaccgtgcagaaggtgctggccagccaggcctgccacggcgccatcaagttcaacgacggcctgagcctgcaggagagctgcagactgatcgaggccctgagcagctgccagctgcccttccagtgcgcccacggcagacccagcatgctgcccctggccgacatcgaccacctggagcaggagaagcagatcaagcccaacctgaccaagctgagaaagatggcccaggcctggagactgttcggcaaggccgagtgcgacaccagacagagcctgcagcagagcatgcccccctgcgagcccccctag

SEQ ID NO: 11637 - DNA, 597 bp, Artificial Sequence
  Description of Artificial Sequence: Synthetic coding sequence
atgaaccccgtggaggacgccaccggcgaccagaacggcatctgcttccagagcgaggagagcaaggccagagcctgcagcgagaccgaggagagcaacacctgctgcagcgactggcagagacacttcgacgtggccctgggcagaatggtgtacgtgaacaagatgaccggcctgagcaccttcatcgcccccaccgaggacatccaggccgcctgcaccaaggacctgaccaccgtggccgtggacgtggtgctggagaacggcagccagtacagatgccagcccttcagaagcgacctggtgctgcccttcctgcccagagccagagccgagagaaccgtgatgagacaggacaacagagacaccgtggacgacaccgtgagcagcgagagcctgcagagcctgttcagcgagtgggacaaccccgtgttcgccagataccccgaggtgctgcagcaggtggacaacaagttcatcgcctgcctgatgagcaccaagaccgaggagaacggcgaggccgccgagctgatgatgctgcaggacccctgctgcagacagagcagagaggacgagaaccacgagttcagcctgtag

SEQ ID NO: 11638 - DNA, 489 bp, Artificial Sequence
  Description of Artificial Sequence: Synthetic coding sequence
atgatcaagtgcctgagcgtggaggtgcaggccaagctgagaagcggcctggccatcagcagcctgggccagtgcgtggaggagctggccctgaacagcatcgacgccgaggccaagtgcgtggccgtgagagtgaacatggagaccttccaggtgcaggtgatcgacaacggcttcggcatgggcagcgacgacgtggagaaggtgggcaacagatacttcaccagcaagtgccacagcgtgcaggacctggagaaccccagattctacggcttcagaggcgaggccctggccaacatcgccgacatggccagcgccgtggagatcagcagcaagaagaacagaaccatgaagaccttcgtgaagctgttccagagcggcaaggccctgaaggcctgcgaggccgacgtgaccagagccagcgccggcaccaccgtgaccgtgtacaacctgttctaccagctgcccgtgagaagaaagtgcatgtag

SEQ ID NO: 11639 - DNA, 4362 bp, Artificial Sequence; identical to SEQ ID NO: 11635
  Description of Artificial Sequence: Synthetic coding sequence

SEQ ID NO: 11640 - DNA, 321 bp, Artificial Sequence
  Description of Artificial Sequence: Synthetic coding sequence
atgatcaagtgcctgagcgtggaggtgcaggccaagctgagaagcggcctggccatcagcagcctgggccagtgcgtggaggagctggccctgaacagcatcgacgccgaggccaagtgcgtggccgtgagagtgaacatggagaccttccaggtgcaggtgatcgacaacggcttcggcatgggcagcgacgacgtggagaaggtgggcaacagatacttcaccagcaagtgccacagcgtgcaggacctggagaaccccagattctacggcttcagaggcgaggccctggccaacatcgccgacatggccagcgcctag

SEQ ID NO: 11641 - DNA, 135 bp, Artificial Sequence
  Description of Artificial Sequence: Synthetic coding sequence
atggccgacaagcccgacatgggcgagatcgccagcttcgacaaggccaagctgaagaagaccgagacccaggagaagaacaccctgcccaccaaggagaccatcgagcaggagaagagaagcgagatcagctag

SEQ ID NO: 11642 - DNA, 1026 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagacctgctag

SEQ ID NO: 11643 - DNA, 2766 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcctggaccccggcaagcagatcaagctggacagcagcgcccagttcggctactacttcagagtgacctgcaaggaggagaaggtgctgagaaacaacaagaacttcagcaccgtggacatccagaagaacggcgtgaagttcaccaacagcaagctgaccagcctgaacgaggagtacaccaagaacaagaccgagtacgaggaggcccaggacgccatcgtgaaggagatcgtgaacatcagcagcggctacgtggagcccatgcagaccctgaacgacgtgctggcccagctggacgccgtggtgagcttcgcccacgtgagcaacggcgcccccgtgccctacgtgagacccgccatcctggagaagggccagggcagaatcatcctgaaggccagcagacacgcctgcgtggaggtgcaggacgagatcgccttcatccccaacgacgtgtacttcgagaaggacaagcagatgttccacatcatcaccggccccaacatgggcggcaagagcacctacatcagacagaccggcgtgatcgtgctgatggcccagatcggctgcttcgtgccctgcgagagcgccgaggtgagcatcgtggactgcatcctggccagagtgggcgccggcgacagccagctgaagggcgtgagcaccttcatggccgagatgctggagaccgccagcatcctgagaagcgccaccaaggacagcctgatcatcatcgacgagctgggcagaggcaccagcacctacgacggcttcggcctggcctgggccatcagcgagtacatcgccaccaagatcggcgccttctgcatgttcgccacccacttccacgagctgaccgccctggccaaccagatccccaccgtgaacaacctgcacgtgaccgccctgaccaccgaggagaccctgaccatgctgtaccaggtgaagaagggcgtgtgcgaccagagcttcggcatccacgtggccgagctggccaacttccccaagcacgtgatcgagtgcgccaagcagaaggccctggagctggaggagttccagtacatcggcgagagccagggctacgacatcatggagcccgccgccaagaagtgctacctggagagagagaacctgagagtgaccgagcccaaggaccagtgcctgatcctgctgacctggaagagaaagctgagaggcggcaagagaagcgcctgcagcagacccgagagacagaaccagggcagcggcgagctgagctag

SEQ ID NO: 11644 - DNA, 2163 bp, Artificial Sequence
  Description of Artificial Sequence: Synthetic coding sequence
atgatcggcatctggcacatcagactgctgctggccatcagcctgagcctgaagaccttcagcctggtgaccatgatctgccagctgcccctggtgctgtgggtgctgaagtgcccccagctgatggccagagacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcctggaccccggcaagcagatcaagctggacagcagcgcccagttcggctactacttcagagtgacctgcaaggaggagaaggtgctgagaaacaacaagaacttcagcaccgtggacatccagaagaacggcgtgaagttcaccaacagcaagctgaccagcctgaacgaggagtacaccaagaacaagaccgagtacgaggaggcccaggacgccatcgtgaaggagatcgtgaacatcagcagcggctacgtggagcccatgcagaccctgaacgacgtgctggcccagctggacgccgtggtgagcttcgcccacgtgagcaacggcgcccccgtgccctacgtgagacccgccatcctggagaagggccagggcagaatcatcctgaaggccagcagacacgcctgcgtggaggtgcaggacgagatcgccttcatccccaacgacgtgtacttcgagaaggacaagcagatgttccacatcatcaccggccccaacatgggcggcaagagcacctacatcagacagaccggcgtgatcgtgctgatggcccagatcggctgcttcgtgccctgcgagagcgccgaggtgagcatcgtggactgcatcctggccagagtgggcgccggcgacagccagctgaagggcgtgagcaccttcatggccgagatgctggagaccgccagcatcctgagaagcgccaccaaggacagcctgatcatcatcgacgagctgggcagaggcaccagcacctacgacggcttcggcctggcctgggccatcagcgagtacatcgccaccaagatcggcgccttctgcatgttcgccacccacttccacgagctgaccgccctggccaaccagatccccaccgtgaacaacctgcacgtgaccgccctgaccaccgaggagaccctgaccatgctgtaccaggtgaagaagggcgtgtgcgaccagagcttcggcatccacgtggccgagctggccaacttccccaagcacgtgatcgagtgcgccaagcagaaggccctggagctggaggagttccagtacatcggcgagagccagggctacgacatcatggagcccgccgccaagaagtgctacctggagagagagcagggcgagaagatcatccaggagttcctgagcaaggtgaagcagatgcccttcaccgagatgagcgaggagaacatcaccatcaagctgaagcagctgaaggccgaggtgatcgccaagaacaacagcttcgtgaacgagatcatcagcagaatcaaggtgaccacctag

SEQ ID NO: 11645 - DNA, 2433 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcctggaccccggcaagcagatcaagctggacagcagcgcccagttcggctactacttcagagtgacctgcaaggaggagaaggtgctgagaaacaacaagaacttcagcaccgtggacatccagaagaacggcgtgaagttcaccaacagcaagctgaccagcctgaacgaggagtacaccaagaacaagaccgagtacgaggaggcccaggacgccatcgtgaaggagatcgtgaacatcagcagcggctacgtggagcccatgcagaccctgaacgacgtgctggcccagctggacgccgtggtgagcttcgcccacgtgagcaacggcgcccccgtgccctacgtgagacccgccatcctggagaagggccagggcagaatcatcctgaaggccagcagacacgcctgcgtggaggtgcaggacgagatcgccttcatccccaacgacgtgtacttcgagaaggacaagcagatgttccacatcatcaccggccccaacatgggcggcaagagcacctacatcagacagaccggcgtgatcgtgctgatggcccagatcggctgcttcgtgccctgcgagagcgccgaggtgagcatcgtggactgcatcctggccagagtgggcgccggcgacagccagctgaagggcgtgagcaccttcatggccgagatgctggagaccgccagcatcctgagaagcgccaccaaggacagcctgatcatcatcgacgagctgggcagaggcaccagcacctacgacggcttcggcctggcctgggccatcagcgagtacatcgccaccaagatcggcgccttctgcatgttcgccaccatcttcatgaacctgctgccctggcccatcagataccagctgctgatcatctacatgagccagcacagccccctgaagagaccctag

SEQ ID NO: 11646 - DNA, 507 bp, Artificial Sequence
  Description of Artificial Sequence: Synthetic coding sequence
atggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcggcagcctgcagcccagaagcagcagactggcctgcgccacctag

SEQ ID NO: 11647 - DNA, 1602 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcctggaccccggcaagcagatcaagctggacagcagcgcccagttcggctactacttcagagtgacctgcaaggagaagagccccagctag

SEQ ID NO: 11648 - DNA, 1233 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggactacttcgtggacagccagatcctgaccgacctgcccagaagcttcaaggacaagcagcagacctacaagatcgtgaccgacagcatcagagtgtag

SEQ ID NO: 11649 - DNA, 1458 bp, Artificial Sequence
  Description of Artificial Sequence: Synthetic coding sequence
atggccgtgcagcccaaggagaccctgcagctggagagcgccgccgaggtgggcttcgtgagattcttccagggcatgcccgagaagcccaccaccaccgtgagactgttcgacagaggcgacttctacaccgcccacggcgaggacgccctgctggccgccagagaggtgttcaagacccagggcgtgatcaagtacatgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagaaacaacgagtag

SEQ ID NO: 11650 - DNA, 2607 bp, Artificial Sequence
  Description of Artificial Sequence: Synthetic coding sequence
atgggccccgccggcgccaagaacctgcagagcgtggtgctgagcaagatgaacttcgagagcttcgtgaaggacctgctgctggtgagacagtacagagtggaggtgtacaagaacagagccggcaacaaggccagcaaggagaacgactggtacctggcctacaaggccagccccggcaacctgagccagttcgaggacatcctgttcggcaacaacgacatgagcgccagcatcggcgtggtgggcgtgaagatgagcgccgtggacggccagagacaggtgggcgtgggctacgtggacagcatccagagaaagctgggcctgtgcgagttccccgacaacgaccagttcagcaacctggaggccctgctgatccagatcggccccaaggagtgcgtgctgcccggcggcgagaccgccggcgacatgggcaagctgagacagatcatccagagaggcggcatcctgatcaccgagagaaagaaggccgacttcagcaccaaggacatctaccaggacctgaacagactgctgaagggcaagaagggcgagcagatgaacagcgccgtgctgcccgagatggagaaccaggtggccgtgagcagcctgagcgccgtgatcaagttcctggagctgctgagcgacgacagcaacttcggccagttcgagctgaccaccttcgacttcagccagtacatgaagctggacatcgccgccgtgagagccctgaacctgttccagggcagcgtggaggacaccaccggcagccagagcctggccgccctgctgaacaagtgcaagaccccccagggccagagactggtgaaccagtggatcaagcagcccctgatggacaagaacagaatcgaggagagactgaacctggtggaggccttcgtggaggacgccgagctgagacagaccctgcaggaggacctgctgagaagattccccgacctgaacagactggccaagaagttccagagacaggccgccaacctgcaggactgctacagactgtaccagggcatcaaccagctgcccaacgtgatccaggccctggagaagcacgagggcaagcaccagaagctgctgctggccgtgttcgtgacccccctgaccgacctgagaagcgacttcagcaagttccaggagatgatcgagaccaccctggacatggaccaggtggagaaccacgagttcctggtgaagcccagcttcgaccccaacctgagcgagctgagagagatcatgaacgacctggagaagaagatgcagagcaccctgatcagcgccgccagagacctgggcctggaccccggcaagcagatcaagctggacagcagcgcccagttcggctactacttcagagtgacctgcaaggaggagaaggtgctgagaaacaacaagaacttcagcaccgtggacatccagaagaacggcgtgaagttcaccaacagcaagctgaccagcctgaacgaggagtacaccaagaacaagaccgagtacgaggaggcccaggacgccatcgtgaaggagatcgtgaacatcagcagcggctacgtggagcccatgcagaccctgaacgacgtgctggcccagctggacgccgtggtgagcttcgcccacgtgagcaacggcgcccccgtgccctacgtgagacccgccatcctggagaagggccagggcagaatcatcctgaaggccagcagacacgcctgcgtggaggtgcaggacgagatcgccttcatccccaacgacgtgtacttcgagaaggacaagcagatgttccacatcatcaccggccccaacatgggcggcaagagcacctacatcagacagaccggcgtgatcgtgctgatggcccagatcggctgcttcgtgccctgcgagagcgccgaggtgagcatcgtggactgcatcctggccagagtgggcgccggcgacagccagctgaagggcgtgagcaccttcatggccgagatgctggagaccgccagcatcctgagaagcgccaccaaggacagcctgatcatcatcgacgagctgggcagaggcaccagcacctacgacggcttcggcctggcctgggccatcagcgagtacatcgccaccaagatcggcgccttctgcatgttcgccacccacttccacgagctgaccgccctggccaaccagatccccaccgtgaacaacctgcacgtgaccgccctgaccaccgaggagaccctgaccatgctgtaccaggtgaagaagggcgtgtgcgaccagagcttcggcatccacgtggccgagctggccaacttccccaagcacgtgatcgagtgcgccaagcagaaggccctggagctggaggagttccagtacatcggcgagagccagggctacgacatcatggagcccgccgccaagaagtgctacctggagagagagcagggcgagaagatcatccaggagttcctgagcaaggtgaagcagatgcccttcaccgagatgagcgaggagaacatcaccatcaagctgaagcagctgaaggccgaggtgatcgccaagaacaacagcttcgtgaacgagatcatcagcagaatcaaggtgaccacctag

SEQ ID NO: 11651 - DNA, 3414 bp, Artificial Sequence
  Description of Artificial Sequence: Synthetic coding sequence
atgagcagaagaaagcccgccagcggcggcctggccgccagcagcagcgcccccgccagacaggccgtgctgagcagattcttccagagcaccggcagcctgaagagcaccagcagcagcaccggcgccgccgaccaggtggaccccggcgccgccgccgccgccgccgccgccgccgccgccgccccccccgccccccccgcccccgccttccccccccagctgcccccccacatcgccaccgagatcgacagaagaaagaagagacccctggagaacgacggccccgtgaagaagaaggtgaagaaggtgcagcagaaggagggcggcagcgacctgggcatgagcggcaacagcgagcccaagaagtgcctgagaaccagaaacgtgagcaagagcctggagaagctgaaggagttctgctgcgacagcgccctgccccagagcagagtgcagaccgagagcctgcaggagagattcgccgtgctgcccaagtgcaccgacttcgacgacatcagcctgctgcacgccaagaacgccgtgagcagcgaggacagcaagagacagatcaaccagaaggacaccaccctgttcgacctgagccagttcggcagcagcaacaccagccacgagaacctgcagaagaccgccagcaagagcgccaacaagagaagcaagagcatctacacccccctggagctgcagtacatcgagatgaagcagcagcacaaggacgccgtgctgtgcgtggagtgcggctacaagtacagattcttcggcgaggacgccgagatcgccgccagagagctgaacatctactgccacctggaccacaacttcatgaccgccagcatccccacccacagactgttcgtgcacgtgagaagactggtggccaagggctacaaggtgggcgtggtgaagcagaccgagaccgccgccctgaaggccatcggcgacaacagaagcagcctgttcagcagaaagctgaccgccctgtacaccaagagcaccctgatcggcgaggacgtgaaccccctgatcaagctggacgacgccgtgaacgtggacgagatcatgaccgacaccagcaccagctacctgctgtgcatcagcgagaacaaggagaacgtgagagacaagaagaagggcaacatcttcatcggcatcgtgggcgtgcagcccgccaccggcgaggtggtgttcgacagcttccaggacagcgccagcagaagcgagctggagaccagaatgagcagcctgcagcccgtggagctgctgctgcccagcgccctgagcgagcagaccgaggccctgatccacagagccaccagcgtgagcgtgcaggacgacagaatcagagtggagagaatggacaacatctacttcgagtacagccacgccttccaggccgtgaccgagttctacgccaaggacaccgtggacatcaagggcagccagatcatcagcggcatcgtgaacctggagaagcccgtgatctgcagcctggccgccatcatcaagtacctgaaggagttcaacctggagaagatgctgagcaagcccgagaacttcaagcagctgagcagcaagatggagttcatgaccatcaacggcaccaccctgagaaacctggagatcctgcagaaccagaccgacatgaagaccaagggcagcctgctgtgggtgctggaccacaccaagaccagcttcggcagaagaaagctgaagaagtgggtgacccagcccctgctgaagctgagagagatcaacgccagactggacgccgtgagcgaggtgctgcacagcgagagcagcgtgttcggccagatcgagaaccacctgagaaagctgcccgacatcgagagaggcctgtgcagcatctaccacaagaagtgcagcacccaggagttcttcctgatcgtgaagaccctgtaccacctgaagagcgagttccaggccatcatccccgccgtgaacagccacatccagagcgacctgctgagaaccgtgatcctggagatccccgagctgctgagccccgtggagcactacctgaagatcctgaacgagcaggccgccaaggtgggcgacaagaccgagctgttcaaggacctgagcgacttccccctgatcaagaagagaaaggacgagatccagggcgtgatcgacgagatcagaatgcacctgcaggagatcagaaagatcctgaagaaccccagcgcccagtacgtgaccgtgagcggccaggagttcatgatcgagatcaagaacagcgccgtgagctgcatccccaccgactgggtgaaggtgggcagcaccaaggccgtgagcagattccacagccccttcatcgtggagaactacagacacctgaaccagctgagagagcagctggtgctggactgcagcgccgagtggctggacttcctggagaagttcagcgagcactaccacagcctgtgcaaggccgtgcaccacctggccaccgtggactgcatcttcagcctggccaaggtggccaagcagggcgactactgcagacccaccgtgcaggaggagagaaagatcgtgatcaagaacggcagacaccccgtgatcgacgtgctgctgggcgagcaggaccagtacgtgcccaacaacaccgacctgagcgaggacagcgagagagtgatgatcatcaccggccccaacatgggcggcaagagcagctacatcaagcaggtggccctgatcaccatcatggcccagatcggcagctacgtgcccgccgaggaggccaccatcggcatcgtggacggcatcttcaccagaatgggcgccgccgacaacatctacaagggccagagcaccttcatggaggagctgaccgacaccgccgagatcatcagaaaggccaccagccagagcctggtgatcctggacgagctgggcagaggcaccagcacccacgacggcatcgccatcgcctacgccaccctggagtacttcatcagagacgtgaagagcctgaccctgttcgtgacccactacccccccgtgtgcgagctggagaagaactacagccaccaggtgggcaactaccacatgggcttcctggtgagcgaggacgagagcaagctggaccccggcgccgccgagcaggtgcccgacttcgtgaccttcctgtaccagatcaccagaggcatcgccgccagaagctacggcctgaacgtggccaagctggccgacgtgcccggcgagatcctgaagaaggccgcccacaagagcaaggagctggagggcctgatcaacaccaagagaaagagactgaagtacttcgccaagctgtggaccatgcacaacgcccaggacctgcagaagtggaccgaggagttcaacatggaggagacccagaccagcctgctgcactag

SEQ ID NO: 11652 - DNA, 3387 bp, Artificial Sequence
  Description of Artificial Sequence: Synthetic coding sequence
atgagcagaagaaagcccgccagcggcggcctggccgccagcagcagcgcccccgccagacaggccgtgctgagcagattcttccagagcaccggcagcctgaagagcaccagcagcagcaccggcgccgccgaccaggtggaccccggcgccgccgccgccgccgccccccccgcccccgccttccccccccagctgcccccccacatcgccaccgagatcgacagaagaaagaagagacccctggagaacgacggccccgtgaagaagaaggtgaagaaggtgcagcagaaggagggcggcagcgacctgggcatgagcggcaacagcgagcccaagaagtgcctgagaaccagaaacgtgagcaagagcctggagaagctgaaggagttctgctgcgacagcgccctgccccagagcagagtgcagaccgagagcctgcaggagagattcgccgtgctgcccaagtgcaccgacttcgacgacatcagcctgctgcacgccaagaacgccgtgagcagcgaggacagcaagagacagatcaaccagaaggacaccaccctgttcgacctgagccagttcggcagcagcaacaccagccacgagaacctgcagaagaccgccagcaagagcgccaacaagagaagcaagagcatctacacccccctggagctgcagtacatcgagatgaagcagcagcacaaggacgccgtgctgtgcgtggagtgcggctacaagtacagattcttcggcgaggacgccgagatcgccgccagagagctgaacatctactgccacctggaccacaacttcatgaccgccagcatccccacccacagactgttcgtgcacgtgagaagactggtggccaagggctacaaggtgggcgtggtgaagcagaccgagaccgccgccctgaaggccatcggcgacaacagaagcagcctgttcagcagaaagctgaccgccctgtacaccaagagcaccctgatcggcgaggacgtgaaccccctgatcaagctggacgacgccgtgaacgtggacgagatcatgaccgacaccagcaccagctacctgctgtgcatcagcgagaacaaggagaacgtgagagacaagaagaagggcaacatcttcatcggcatcgtgggcgtgcagcccgccaccggcgaggtggtgttcgacagcttccaggacagcgccagcagaagcgagctggagaccagaatgagcagcctgcagcccgtggagctgctgctgcccagcgccctgagcgagcagaccgaggccctgatccacagagccaccagcgtgagcgtgcaggacgacagaatcagagtggagagaatggacaacatctacttcgagtacagccacgccttccaggccgtgaccgagttctacgccaaggacaccgtggacatcaagggcagccagatcatcagcggcatcgtgaacctggagaagcccgtgatctgcagcctggccgccatcatcaagtacctgaaggagttcaacctggagaagatgctgagcaagcccgagaacttcaagcagctgagcagcaagatggagttcatgaccatcaacggcaccaccctgagaaacctggagatcctgcagaaccagaccgacatgaagaccaagggcagcctgctgtgggtgctggaccacaccaagaccagcttcggcagaagaaagctgaagaagtgggtgacccagcccctgctgaagctgagagagatcaacgccagactggacgccgtgagcgaggtgctgcacagcgagagcagcgtgttcggccagatcgagaaccacctgagaaagctgcccgacatcgagagaggcctgtgcagcatctaccacaagaagtgcagcacccaggagttcttcctgatcgtgaagaccctgtaccacctgaagagcgagttccaggccatcatccccgccgtgaacagccacatccagagcgacctgctgagaaccgtgatcctggagatccccgagctgctgagccccgtggagcactacctgaagatcctgaacgagcaggccgccaaggtgggcgacaagaccgagctgttcaaggacctgagcgacttccccctgatcaagaagagaaaggacgagatccagggcgtgatcgacgagatcagaatgcacctgcaggagatcagaaagatcctgaagaaccccagcgcccagtacgtgaccgtgagcggccaggagttcatgatcgagatcaagaacagcgccgtgagctgcatccccaccgactgggtgaaggtgggcagcaccaaggccgtgagcagattccacagccccttcatcgtggagaactacagacacctgaaccagctgagagagcagctggtgctggactgcagcgccgagtggctggacttcctggagaagttcagcgagcactaccacagcctgtgcaaggccgtgcaccacctggccaccgtggactgcatcttcagcctggccaaggtggccaagcagggcgactactgcagacccaccgtgcaggaggagagaaagatcgtgatcaagaacggcagacaccccgtgatcgacgtgctgctgggcgagcaggaccagtacgtgcccaacaacaccgacctgagcgaggacagcgagagagtgatgatcatcaccggccccaacatgggcggcaagagcagctacatcaagcaggtggccctgatcaccatcatggcccagatcggcagctacgtgcccgccgaggaggccaccatcggcatcgtggacggcatcttcaccagaatgggcgccgccgacaacatctacaagggccagagcaccttcatggaggagctgaccgacaccgccgagatcatcagaaaggccaccagccagagcctggtgatcctggacgagctgggcagaggcaccagcacccacgacggcatcgccatcgcctacgccaccctggagtacttcatcagagacgtgaagagcctgaccctgttcgtgacccactacccccccgtgtgcgagctggagaagaactacagccaccaggtgggcaactaccacatgggcttcctggtgagcgaggacgagagcaagctggaccccggcgccgccgagcaggtgcccgacttcgtgaccttcctgtaccagatcaccagaggcatcgccgccagaagctacggcctgaacgtggccaagctggccgacgtgcccggcgagatcctgaagaaggccgcccacaagagcaaggagctggagggcctgatcaacaccaagagaaagagactgaagtacttcgccaagctgtggaccatgcacaacgcccaggacctgcagaagtggaccgaggagttcaacatggaggagacccagaccagcctgctgcactag

SEQ ID NO: 11653 - DNA, 2811 bp, Artificial Sequence
  Description of Artificial Sequence: Synthetic coding sequence
atgctgagacccgagatcagcagcaccagccccagcgcccccgccgtgagccccagcagcggcgagaccagaagcccccagggccccagatacaacttcggcctgcaggagaccccccagagcagacccagcgtgcaggtggtgagcgccagcacctgccccggcaccagcggcgccgccggcgacagaagcagcagcagcagcagcctgccctgccccgcccccaacagcagacccgcccagggcagctacttcggcaacaagagagcctacgccgagaacaccgtggccagcaacttcaccttcggcgccagcagcagcagcgccagagacaccaactacccccagaccctgaagacccccctgagcaccggcaacccccagagaagcggctacaagagctggaccccccaggtgggctacagcgccagcagcagcagcgccatcagcgcccacagccccagcgtgatcgtggccgtggtggagggcagaggcctggccagaggcgagatcggcatggccagcatcgacctgaagaacccccagatcatcctgagccagttcgccgacaacaccacctacgccaaggtgatcaccaagctgaagatcctgagccccctggagatcatcatgagcaacaccgcctgcgccgtgggcaacagcaccaagctgttcaccctgatcaccgagaacttcaagaacgtgaacttcaccaccatccagagaaagtacttcaacgagaccaagggcctggagtacatcgagcagctgtgcatcgccgagttcagcaccgtgctgatggaggtgcagagcaagtactactgcctggccgccgtggccgccctgctgaagtacgtggagttcatccagaacagcgtgtacgcccccaagagcctgaagatctgcttccagggcagcgagcagaccgccatgatcgacagcagcagcgcccagaacctggagctgctgatcaacaaccaggactacagaaacaaccacaccctgttcggcgtgctgaactacaccaagacccccggcggcagcagaagactgagaagcaacatcctggagcccctggtggacatcgagaccatcaacatgagactggactgcgtgcaggagctgctgcaggacgaggagctgttcttcggcctgcagagcgtgatcagcagattcctggacaccgagcagctgctgagcgtgctggtgcagatccccaagcaggacaccgtgaacgccgccgagagcaagatcaccaacctgatctacctgaagcacaccctggagctggtggaccccctgaagatcgccatgaagaactgcaacacccccctgctgagagcctactacggcagcctggaggacaagagattcggcatcatcctggagaagatcaagaccgtgatcaacgacgacgccagatacatgaagggctgcctgaacatgagaacccagaagtgctacgccgtgagaagcaacatcaacgagttcctggacatcgccagaagaacctacaccgagatcgtggacgacatcgccggcatgatcagccagctgggcgagaagtacagcctgcccctgagaaccagcttcagcagcgccagaggcttcttcatccagatgaccaccgactgcatcgccctgcccagcgaccagctgcccagcgagttcatcaagatcagcaaggtgaagaacagctacagcttcaccagcgccgacctgatcaagatgaacgagagatgccaggagagcctgagagagatctaccacatgacctacatgatcgtgtgcaagctgctgagcgagatctacgagcacatccactgcctgtacaagctgagcgacaccgtgagcatgctggacatgctgctgagcttcgcccacgcctgcaccctgagcgactacgtgagacccgagttcaccgacaccctggccatcaagcagggctggcaccccatcctggagaagatcagcgccgagaagcccatcgccaacaacacctacgtgaccgagggcagcaacttcctgatcatcaccggccccaacatgagcggcaagagcacctacctgaagcagatcgccctgtgccagatcatggcccagatcggcagctacgtgcccgccgagtacagcagcttcagaatcgccaagcagatcttcaccagaatcagcaccgacgacgacatcgagaccaacagcagcaccttcatgaaggagatgaaggagatcgcctacatcctgcacaacgccaacgacaagagcctgatcctgatcgacgagctgggcagaggcaccaacaccgaggagggcatcggcatctgctacgccgtgtgcgagtacctgctgagcctgaaggccttcaccctgttcgccacccacttcctggagctgtgccacatcgacgccctgtaccccaacgtggagaacatgcacttcgaggtgcagcacgtgaagaacaccagcagaaacaaggaggccatcctgtacacctacaagctgagcaagggcctgaccgaggagaagaactacggcctgaaggccgccgaggtgagcagcctgccccccagcatcgtgctggacgccaaggagatcaccacccagatcaccagacagatcctgcagaaccagagaagcacccccgagatggagagacagagagccgtgtaccacctggccaccagactggtgcagaccgccagaaacagccagctggaccccgacagcctgagaatctacctgagcaacctgaagaagaagtacaaggaggacttccccagaaccgagcaggtgcccgagaagaccgaggagtag

SEQ ID NO: 11654 - DNA, 813 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgtag

SEQ ID NO: 11655 - DNA, 813 bp, Artificial Sequence; identical to SEQ ID NO: 11654
  Description of Artificial Sequence: Synthetic coding sequence

SEQ ID NO: 11656 - DNA, 585 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagatag

SEQ ID NO: 11657 - DNA, 813 bp, Artificial Sequence; identical to SEQ ID NO: 11654
  Description of Artificial Sequence: Synthetic coding sequence

SEQ ID NO: 11658 - DNA, 864 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccccccccggcgacctgagattcacccccatccccctgctgatccccagccaggtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgtag

SEQ ID NO: 11659 - DNA, 324 bp, Artificial Sequence
  Description of Artificial Sequence: Synthetic coding sequence
aagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagcgtgctgcagatcttcaagagcgagagccaccccagcgtgtacaaggtggccagcggcctgaaggagggcctgagcctgttcggcatcctgaacagatgccactgcaagtggggcgagaagctgctgtag

SEQ ID NO: 11660 - DNA, 765 bp, Artificial Sequence
  Description of Artificial Sequence: Synthetic coding sequence
atggccagcctgggcgccaaccccagaagaaccccccagggccccagacccggcgccgccagcagcggcttccccagccccgcccccgtgcccggccccagagaggccgaggaggaggaggtggaggaggaggaggagctggccgagatccacctgtgcgtgctgtggaacagcggctacctgggcatcgcctactacgacaccagcgacagcaccatccacttcatgcccgacgcccccgaccacgagagcctgaagctgctgcagagagtgctggacgagatcaacccccagagcgtggtgaccagcgccaagcaggacgagaacatgaccagattcctgggcaagctggccagccaggagcacagagagcccaagagacccgagatcatcttcctgcccagcgtggacttcggcctggagatcagcaagcagagactgctgagcggcaactacagcttcatccccgacgccatgaccgccaccgagaagatcctgttcctgagcagcatcatccccttcgactgcctgctgaccgtgagagccctgggcggcctgctgaagttcctgggcagaagaagaatcggcgtggagctggaggactacaacgtgagcgtgcccatcctgggcttcaagaagttcatgctgacccacctggtgaacatcgaccaggacacctacagactggagtgcaacggcgccatcagcgcccagtgcaacctgtgcctgctgggcagcagcgacagccccgccagcgccagctag

SEQ ID NO: 11661 - DNA, 1542 bp, Artificial Sequence
  Description of Artificial Sequence: Synthetic coding sequence
atggccatggagatcgacagcagacccggcggcctgcccggcagcagctgcaacctgggcgccgccagagagcacatgcaggccgtgaccagaaactacatcacccaccccagagtgacctacagaaccgtgtgcagcgtgaacggccccctggtggtgctggacagagtgaagttcgcccagtacgccgagatcgtgcacttcaccctgcccgacggcacccagagaagcggccaggtgctggaggtggccggcaccaaggccatcgtgcaggtgttcgagggcaccagcggcatcgacgccagaaagaccacctgcgagttcaccggcgacatcctgagaacccccgtgagcgaggacatgctgggcagagtgttcaacggcagcggcaagcccatcgacaagggccccgtggtgatggccgaggacttcctggacatcaacggccagcccatcaacccccacagcagaatctaccccgaggagatgatccagaccggcatcagccccatcgacgtgatgaacagcatcgccagaggccagaagatccccatcttcagcgccgccggcctgccccacaacgagatcgccgcccagatctgcagacaggccggcctggtgaagaagagcaaggccgtgctggactaccacgacgacaacttcgccatcgtgttcgccgccatgggcgtgaacatggagaccgccagattcttcaagagcgacttcgagcagaacggcaccatgggcaacgtgtgcctgttcctgaacctggccaacgaccccaccatcgagagaatcatcacccccagactggccctgaccaccgccgagttcctggcctaccagtgcgagaagcacgtgctggtgatcctgaccgacatgagcagctacgccgaggccctgagagaggtgagcgccgccagagaggaggtgcccggcagaagaggcttccccggctacatgtacaccgacctggccaccatctacgagagagccggcagagtggagggcagaggcggcagcatcacccagatccccatcctgaccatgcccaacgacgacatcacccaccccatccccgacctgaccggcttcatcaccgagggccagatctacgtggacagacagctgcacaacagacagatctacccccccatcaacgtgctgcccagcctgagcagactgatgaagagcgccatcggcgagggcatgaccagaaaggaccacggcgacgtgagcaaccagctgtacgcctgctacgccatcggcaaggacgtgcaggccatgaaggccgtggtgggcgaggaggccctgaccagcgaggacctgctgtacctggagttcctgcagaagttcgagaagaacttcatcaaccagggcccctacgagaacagaagcgtgttcgagagcctggacctgggctggaagctgctgagaatcttccccaaggagatgctgaagagaatcccccaggccgtgatcgacgagttctacagcagagagggcgccctgcaggacctggcccccgacaccgccctgtag

SEQ ID NO: 11662 - DNA, 759 bp, Artificial Sequence
  Description of Artificial Sequence: Synthetic coding sequence
atgagcagacagagcaccctgtacagcttcttccccaagagccccgccctgagcgacgccaacaaggccagcgccagagccagcagagagggcggcagagccgccgccgcccccggcgccagccccagccccggcggcgacgccgcctggagcgaggccggccccggccccagacccctggccagaagcgccagcccccccaaggccaagaacctgaacggcggcctgagaagaagcgtggcccccgccgcccccaccagctgcgacttcagccccggcgacctggtgtgggccaagatggagggctacccctggtggccctgcctggtgtacaaccaccccttcgacggcaccttcatcagagagaagggcaagagcgtgagagtgcacgtgcagttcttcgacgacagccccaccagaggctgggtgagcaagagactgctgaagccctacaccggcagcaagagcaaggaggcccagaagggcggccacttctacagcgccaagcccgagatcctgagagccatgcagagagccgacgaggccctgaacaaggacaagatcaagagactggagctggccgtgtgcgacgagcccagcgagcccgaggaggaggaggagatggaggtgggcaccacctacgtgaccgacaagagcgaggaggacaacgagatcgagagcgaggaggaggtgcagcccaagacccagggcagcagaagaagcagcagacagatcaagaagagaagaaagaagagatag

SEQ ID NO: 11663 - DNA, 3177 bp, Artificial Sequence
  Description of Artificial Sequence: Synthetic coding sequence
atggtgaccggcaacggcagcctgaagagaaagagcagcagaaaggagacccccagcgccaccaagcaggccaccagcatcagcagcgagaccaagaacaccctgagagccttcagcgccccccagaacagcgagagccaggcccacgtgagcggcggcggcgacgacagcagcagacccaccgtgtggtaccacgagaccctggagtggctgaaggaggagaagagaagagacgagcacagaagaagacccgaccaccccgacttcgacgccagcaccctgtacgtgcccgaggacttcctgaacagctgcacccccggcatgagaaagtggtggcagatcaagagccagaacttcgacctggtgatctgctacaaggtgggcaagttctacgagctgtaccacatggacgccctgatcggcgtgagcgagctgggcctggtgttcatgaagggcaactgggcccacagcggcttccccgagatcgccttcggcagatacagcgacagcctggtgcagaagggctacaaggtggccagagtggagcagaccgagacccccgagatgatggaggccagatgcagaaagatggcccacatcagcaagtacgacagagtggtgagaagagagatctgcagaatcatcaccaagggcacccagacctacagcgtgctggagggcgaccccagcgagaactacagcaagtacctgctgagcctgaaggagaaggaggaggacagcagcggccacaccagagcctacggcgtgtgcttcgtggacaccagcctgggcaagttcttcatcggccagttcagcgacgacagacactgcagcagattcagaaccctggtggcccactacccccccgtgcaggtgctgttcgagaagggcaacctgagcaaggagaccaagaccatcctgaagagcagcctgagctgcagcctgcaggagggcctgatccccggcagccagttctgggacgccagcaagaccctgagaaccctgctggaggaggagtacttcagagagaagctgagcgacggcatcggcgtgatgctgccccaggtgctgaagggcatgaccagcgagagcgacagcatcggcctgacccccggcgagaagagcgagctggccctgagcgccctgggcggctgcgtgttctacctgaagaagtgcctgatcgaccaggagctgctgagcatggccaacttcgaggagtacatccccctggacagcgacaccgtgagcaccaccagaagcggcgccatcttcaccaaggcctaccagagaatggtgctggacgccgtgaccctgaacaacctggagatcttcctgaacggcaccaacggcagcaccgagggcaccctgctggagagagtggacacctgccacacccccttcggcaagagactgctgaagcagtggctgtgcgcccccctgtgcaaccactacgccatcaacgacagactggacgccatcgaggacctgatggtggtgcccgacaagatcagcgaggtggtggagctgctgaagaagctgcccgacctggagagactgctgagcaagatccacaacgtgggcagccccctgaagagccagaaccaccccgacagcagagccatcatgtacgaggagaccacctacagcaagaagaagatcatcgacttcctgagcgccctggagggcttcaaggtgatgtgcaagatcatcggcatcatggaggaggtggccgacggcttcaagagcaagatcctgaagcaggtgatcagcctgcagaccaagaaccccgagggcagattccccgacctgaccgtggagctgaacagatgggacaccgccttcgaccacgagaaggccagaaagaccggcctgatcacccccaaggccggcttcgacagcgactacgaccaggccctggccgacatcagagagaacgagcagagcctgctggagtacctggagaagcagagaaacagaatcggctgcagaaccatcgtgtactggggcatcggcagaaacagataccagctggagatccccgagaacttcaccaccagaaacctgcccgaggagtacgagctgaagagcaccaagaagggctgcaagagatactggaccaagaccatcgagaagaagctggccaacctgatcaacgccgaggagagaagagacgtgagcctgaaggactgcatgagaagactgttctacaacttcgacaagaactacaaggactggcagagcgccgtggagtgcatcgccgtgctggacgtgctgctgtgcctggccaactacagcagaggcggcgacggccccatgtgcagacccgtgatcctgctgcccgaggacaccccccccttcctggagctgaagggcagcagacacccctgcatcaccaagaccttcttcggcgacgacttcatccccaacgacatcctgatcggctgcgaggaggaggagcaggagaacggcaaggcctactgcgtgctggtgaccggccccaacatgggcggcaagagcaccctgatgagacaggccggcctgctggccgtgatggcccagatgggctgctacgtgcccgccgaggtgtgcagactgacccccatcgacagagtgttcaccagactgggcgccagcgacagaatcatgagcggcgagagcaccttcttcgtggagctgagcgagaccgccagcatcctgatgcacgccaccgcccacagcctggtgctggtggacgagctgggcagaggcaccgccaccttcgacggcaccgccatcgccaacgccgtggtgaaggagctggccgagaccatcaagtgcagaaccctgttcagcacccactaccacagcctggtggaggactacagccagaacgtggccgtgagactgggccacatggcctgcatggtggagaacgagtgcgaggaccccagccaggagaccatcaccttcctgtacaagttcatcaagggcgcctgccccaagagctacggcttcaacgccgccagactggccaacctgcccgaggaggtgatccagaagggccacagaaaggccagagagttcgagaagatgaaccagagcctgagactgttcagagaggtgtgcctggccagcgagagaagcaccgtggacgccgaggccgtgcacaagctgctgaccctgatcaaggagctgtag

SEQ ID NO: 11664 - DNA, 3693 bp, Artificial Sequence
  Description of Artificial Sequence: Synthetic coding sequence
atgagcagacagagcaccctgtacagcttcttccccaagagccccgccctgagcgacgccaacaaggccagcgccagagccagcagagagggcggcagagccgccgccgcccccggcgccagccccagccccggcggcgacgccgcctggagcgaggccggccccggccccagacccctggccagaagcgccagcccccccaaggccaagaacctgaacggcggcctgagaagaagcgtgggcaccacctacgtgaccgacaagagcgaggaggacaacgagatcgagagcgaggaggaggtgcagcccaagacccagggcagcagaagaagcagcagacagatcaagaagagaagagtgatcagcgacagcgagagcgacatcggcggcagcgacgtggagttcaagcccgacaccaaggaggagggcagcagcgacgagatcagcagcggcgtgggcgacagcgagagcgagggcctgaacagccccgtgaaggtggccagaaagagaaagagaatggtgaccggcaacggcagcctgaagagaaagagcagcagaaaggagacccccagcgccaccaagcaggccaccagcatcagcagcgagaccaagaacaccctgagagccttcagcgccccccagaacagcgagagccaggcccacgtgagcggcggcggcgacgacagcagcagacccaccgtgtggtaccacgagaccctggagtggctgaaggaggagaagagaagagacgagcacagaagaagacccgaccaccccgacttcgacgccagcaccctgtacgtgcccgaggacttcctgaacagctgcacccccggcatgagaaagtggtggcagatcaagagccagaacttcgacctggtgatctgctacaaggtgggcaagttctacgagctgtaccacatggacgccctgatcggcgtgagcgagctgggcctggtgttcatgaagggcaactgggcccacagcggcttccccgagatcgccttcggcagatacagcgacagcctggtgcagaagggctacaaggtggccagagtggagcagaccgagacccccgagatgatggaggccagatgcagaaagatggcccacatcagcaagtacgacagagtggtgagaagagagatctgcagaatcatcaccaagggcacccagacctacagcgtgctggagggcgaccccagcgagaactacagcaagtacctgctgagcctgaaggagaaggaggaggacagcagcggccacaccagagcctacggcgtgtgcttcgtggacaccagcctgggcaagttcttcatcggccagttcagcgacgacagacactgcagcagattcagaaccctggtggcccactacccccccgtgcaggtgctgttcgagaagggcaacctgagcaaggagaccaagaccatcctgaagagcagcctgagctgcagcctgcaggagggcctgatccccggcagccagttctgggacgccagcaagaccctgagaaccctgctggaggaggagtacttcagagagaagctgagcgacggcatcggcgtgatgctgccccaggtgctgaagggcatgaccagcgagagcgacagcatcggcctgacccccggcgagaagagcgagctggccctgagcgccctgggcggctgcgtgttctacctgaagaagtgcctgatcgaccaggagctgctgagcatggccaacttcgaggagtacatccccctggacagcgacaccgtgagcaccaccagaagcggcgccatcttcaccaaggcctaccagagaatggtgctggacgccgtgaccctgaacaacctggagatcttcctgaacggcaccaacggcagcaccgagggcaccctgctggagagagtggacacctgccacacccccttcggcaagagactgctgaagcagtggctgtgcgcccccctgtgcaaccactacgccatcaacgacagactggacgccatcgaggacctgatggtggtgcccgacaagatcagcgaggtggtggagctgctgaagaagctgcccgacctggagagactgctgagcaagatccacaacgtgggcagccccctgaagagccagaaccaccccgacagcagagccatcatgtacgaggagaccacctacagcaagaagaagatcatcgacttcctgagcgccctggagggcttcaaggtgatgtgcaagatcatcggcatcatggaggaggtggccgacggcttcaagagcaagatcctgaagcaggtgatcagcctgcagaccaagaaccccgagggcagattccccgacctgaccgtggagctgaacagatgggacaccgccttcgaccacgagaaggccagaaagaccggcctgatcacccccaaggccggcttcgacagcgactacgaccaggccctggccgacatcagagagaacgagcagagcctgctggagtacctggagaagcagagaaacagaatcggctgcagaaccatcgtgtactggggcatcggcagaaacagataccagctggagatccccgagaacttcaccaccagaaacctgcccgaggagtacgagctgaagagcaccaagaagggctgcaagagatactggaccaagaccatcgagaagaagctggccaacctgatcaacgccgaggagagaagagacgtgagcctgaaggactgcatgagaagactgttctacaacttcgacaagaactacaaggactggcagagcgccgtggagtgcatcgccgtgctggacgtgctgctgtgcctggccaactacagcagaggcggcgacggccccatgtgcagacccgtgatcctgctgcccgaggacaccccccccttcctggagctgaagggcagcagacacccctgcatcaccaagaccttcttcggcgacgacttcatccccaacgacatcctgatcggctgcgaggaggaggagcaggagaacggcaaggcctactgcgtgctggtgaccggccccaacatgggcggcaagagcaccctgatgagacaggccggcctgctggccgtgatggcccagatgggctgctacgtgcccgccgaggtgtgcagactgacccccatcgacagagtgttcaccagactgggcgccagcgacagaatcatgagcggcgagagcaccttcttcgtggagctgagcgagaccgccagcatcctgatgcacgccaccgcccacagcctggtgctggtggacgagctgggcagaggcaccgccaccttcgacggcaccgccatcgccaacgccgtggtgaaggagctggccgagaccatcaagtgcagaaccctgttcagcacccactaccacagcctggtggaggactacagccagaacgtggccgtgagactgggccacatggcctgcatggtggagaacgagtgcgaggaccccagccaggagaccatcaccttcctgtacaagttcatcaagggcgcctgccccaagagctacggcttcaacgccgccagactggccaacctgcccgaggaggtgatccagaagggccacagaaaggccagagagttcgagaagatgaaccagagcctgagactgttcagagaggtgtgcctggccagcgagagaagcaccgtggacgccgaggccgtgcacaagctgctgaccctgatcaaggagctgtag

SEQ ID NO: 11665 - DNA, 975 bp, Artificial Sequence
  Description of Artificial Sequence: Synthetic coding sequence
atgagaagactgttctacaacttcgacaagaactacaaggactggcagagcgccgtggagtgcatcgccgtgctggacgtgctgctgtgcctggccaactacagcagaggcggcgacggccccatgtgcagacccgtgatcctgctgcccgaggacaccccccccttcctggagctgaagggcagcagacacccctgcatcaccaagaccttcttcggcgacgacttcatccccaacgacatcctgatcggctgcgaggaggaggagcaggagaacggcaagatcgtgtgcctgctgctggaccagatctggggcgccagcctgagaatgagacaggccggcctgctggccgtgatggcccagatgggctgctacgtgcccgccgaggtgtgcagactgacccccatcgacagagtgttcaccagactgggcgccagcgacagaatcatgagcggcgagagcaccttcttcgtggagctgagcgagaccgccagcatcctgatgcacgccaccgcccacagcctggtgctggtggacgagctgggcagaggcaccgccaccttcgacggcaccgccatcgccaacgccgtggtgaaggagctggccgagaccatcaagtgcagaaccctgttcagcacccactaccacatcagcagaagactgttcagcaagtgctgctgcctgggccacatggcctgcatggtggagaacgagtgcgaggaccccagccaggagaccatcaccttcctgtacaagttcatcaagggcgcctgccccaagagctacggcttcaacgccgccagactggccaacctgcccgaggaggtgatccagaagggccacagaaaggccagagagttcgagaagatgaaccagagcctgagactgttcagagaggtgtgcctggccagcgagagaagcaccgtggacgccgaggccgtgcacaagctgctgaccctgatcaaggagctgtag

SEQ ID NO: 11666 - DNA, 3201 bp, Artificial Sequence
  Description of Artificial Sequence: Synthetic coding sequence
atgagcagacagagcaccctgtacagcttcttccccaagagccccgccctgagcgacgccaacaaggccagcgccagagccagcagagagggcggcagagccgcctgccccagaggcctgagcttccccagaagaggctgcggcctggagagaggctgggcctggagacccctggccagaagcgccagcccccccaaggccaagaacctgaacggcggcctgagaagaagcgtggcccccgccgcccccaccagctgcgacttcagccccggcgacctggtgtgggccaagatggagggctacccctggtggccctgcctggtgtacaaccaccccttcgacggcaccttcatcagagagaagggcaagagcgtgagagtgcacgtgcagttcttcgacgacagccccaccagaggctgggtgagcaagagactgctgaagccctacaccggcagcaagagcaaggaggcccagaagggcggccacttctacagcgccaagcccgagatcctgagagccatgcagagagccgacgaggccctgaacaaggacaagatcaagagactggagctggccgtgtgcgacgagcccagcgagcccgaggaggaggaggagatggaggtgggcaccacctacgtgaccgacaagagcgaggaggacaacgagatcgagagcgaggaggaggtgcagcccaagacccagggcagcagaagaagcagcagacagatcaagaagagaagagtgatcagcgacagcgagagcgacatcggcggcagcgacgtggagttcaagcccgacaccaaggaggagggcagcagcgacgagatcagcagcggcgtgggcgacagcgagagcgagggcctgaacagccccgtgaaggtggccagaaagagaaagagaatggtgaccggcaacggcagcctgaagagaaagagcagcagaaaggagacccccagcgccaccaagcaggccaccagcatcagcagcgagaccaagaacaccctgagagccttcagcgccccccagaacagcgagagccaggcccacgtgagcggcggcggcgacgacagcagcagacccaccgtgtggtaccacgagaccctggagtggctgaaggaggagaagagaagagacgagcacagaagaagacccgaccaccccgacttcgacgccagcaccctgtacgtgcccgaggacttcctgaacagctgcacccccggcatgagaaagtggtggcagatcaagagccagaacttcgacctggtgatctgctacaaggtgggcaagttctacgagctgtaccacatggacgccctgatcggcgtgagcgagctgggcctggtgttcatgaagggcaactgggcccacagcggcttccccgagatcgccttcggcagatacagcgacagcctggtgcagaagggctacaaggtggccagagtggagcagaccgagacccccgagatgatggaggccagatgcagaaagatggcccacatcagcaagtacgacagagtggtgagaagagagatctgcagaatcatcaccaagggcacccagacctacagcgtgctggagggcgaccccagcgagaactacagcaagtacctgctgagcctgaaggagaaggaggaggacagcagcggccacaccagagcctacggcgtgtgcttcgtggacaccagcctgggcaagttcttcatcggccagttcagcgacgacagacactgcagcagattcagaaccctggtggcccactacccccccgtgcaggtgctgttcgagaagggcaacctgagcaaggagaccaagaccatcctgaagagcagcctgagctgcagcctgcaggagggcctgatccccggcagccagttctgggacgccagcaagaccctgagaaccctgctggaggaggagtacttcagagagaagctgagcgacggcatcggcgtgatgctgccccaggtgctgaagggcatgaccagcgagagcgacagcatcggcctgacccccggcgagaagagcgagctggccctgagcgccctgggcggctgcgtgttctacctgaagaagtgcctgatcgaccaggagctgctgagcatggccaacttcgaggagtacatccccctggacagcgacaccgtgagcaccaccagaagcggcgccatcttcaccaaggcctaccagagaatggtgctggacgccgtgaccctgaacaacctggagatcttcctgaacggcaccaacggcagcaccgagggcaccctgctggagagagtggacacctgccacacccccttcggcaagagactgctgaagcagtggctgtgcgcccccctgtgcaaccactacgccatcaacgacagactggacgccatcgaggacctgatggtggtgcccgacaagatcagcgaggtggtggagctgctgaagaagctgcccgacctggagagactgctgagcaagatccacaacgtgggcagccccctgaagagccagaaccaccccgacagcagagccatcatgtacgaggagaccacctacagcaagaagaagatcatcgacttcctgagcgccctggagggcttcaaggtgatgtgcaagatcatcggcatcatggaggaggtggccgacggcttcaagagcaagatcctgaagcaggtgatcagcctgcagaccaagaaccccgagggcagattccccgacctgaccgtggagctgaacagatgggacaccgccttcgaccacgagaaggccagaaagaccggcctgatcacccccaaggccggcttcgacagcgactacgaccaggccctggccgacatcagagagaacgagcagagcctgctggagtacctggagaagcagagaaacagaatcggctgcagaaccatcgtgtactggggcatcggcagaaacagataccagctggagatccccgagaacttcaccaccagaaacctgcccgaggagtacgagctgaagagcaccaagaagggctgcaagagatactggaccaagaccatcgagaagaagctggccaacctgatcaacgccgaggagagaagagacgtgagcctgaaggactgcatgagaagactgttctacaacttcgacaagaactacaaggactggcagagcgccgtggagtgcatcgccgtgctgggcaagaccctgaacaagctggtgctgagactgtag

SEQ ID NO: 11667 - DNA, 1569 bp, Artificial Sequence
  Description of Artificial Sequence: Synthetic coding sequence
atgagaaagcccagagccgccgtgggcagcggccacagaaagcaggccgccagccaggagggcagacagaagcacgccaagaacaacagccaggccaagcccagcgcctgcgacgccggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11668 - DNA, 1566 bp, Artificial Sequence
  Description of Artificial Sequence: Synthetic coding sequence
atgagaaagcccagagccgccgtgggcagcggccacagaaagcaggccgccagccaggagggcagacagaagcacgccaagaacaacagccaggccaagcccagcgcctgcgacggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11669 - DNA, 1641 bp, Artificial Sequence
  Description of Artificial Sequence: Synthetic coding sequence
atgacccccctggtgagcagactgagcagactgtgggccatcatgagaaagcccagagccgccgtgggcagcggccacagaaagcaggccgccagccaggagggcagacagaagcacgccaagaacaacagccaggccaagcccagcgcctgcgacggcatgatcgccgagtgccccggcgcccccgccggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11670 - DNA, 1599 bp, Artificial Sequence
  Description of Artificial Sequence: Synthetic coding sequence
atgagaaagcccagagccgccgtgggcagcggccacagaaagcaggccgccagccaggagggcagacagaagcacgccaagaacaacagccaggccaagcccagcgcctgcgacggcatgatcgccgagtgccccggcgcccccgccggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11671 - DNA, 1566 bp, Artificial Sequence; identical to SEQ ID NO: 11668
  Description of Artificial Sequence: Synthetic coding sequence

SEQ ID NO: 11672 - DNA, 1611 bp, Artificial Sequence
  Description of Artificial Sequence: Synthetic coding sequence
atgacccccctggtgagcagactgagcagactgtgggccatcatgagaaagcccagagccgccgtgggcagcggccacagaaagcaggccgccagccaggagggcagacagaagcacgccaagaacaacagccaggccaagcccagcgcctgcgacgccggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11673 - DNA, 1608 bp, Artificial Sequence
  Description of Artificial Sequence: Synthetic coding sequence
atgacccccctggtgagcagactgagcagactgtgggccatcatgagaaagcccagagccgccgtgggcagcggccacagaaagcaggccgccagccaggagggcagacagaagcacgccaagaacaacagccaggccaagcccagcgcctgcgacggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11674 - DNA, 876 bp, Artificial Sequence
  Description of Artificial Sequence: Synthetic coding sequence
atgagaaagcccagagccgccgtgggcagcggccacagaaagcaggccgccagccaggagggcagacagaagcacgccaagaacaacagccaggccaagcccagcgcctgcgacggcatgatcgccgagtgccccggcgcccccgccggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagcctag

SEQ ID NO: 11675 - DNA, 1599 bp, Artificial Sequence; identical to SEQ ID NO: 11670
  Description of Artificial Sequence: Synthetic coding sequence

SEQ ID NO: 11676 - DNA, 1650 bp, Artificial Sequence
  Description of Artificial Sequence: Synthetic coding sequence
atgacccccctggtgagcagactgagcagactgtgggccatcatgagaaagcccagagccgccgtgggcagcggccacagaaagcaggccgccagccaggagggcagacagaagcacgccaagaacaacagccaggccaagcccagcgcctgcgacgcctgcgccggcatgatcgccgagtgccccggcgcccccgccggcctggccagacagcccgaggaggtggtgctgcaggccagcgtgagcagctaccacctgttcagagacgtggccgaggtgaccgccttcagaggcagcctgctgagctggtacgaccaggagaagagagacctgccctggagaagaagagccgaggacgagatggacctggacagaagagcctacgccgtgtgggtgagcgaggtgatgctgcagcagacccaggtggccaccgtgatcaactactacaccggctggatgcagaagtggcccaccctgcaggacctggccagcgccagcctggaggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagcagcgccacctgcgtgctggagcagcccggcgccctgggcgcccagatcctgctggtgcagagacccaacagcggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11677 - DNA, 1566 bp, Artificial Sequence; identical to SEQ ID NO: 11668
  Description of Artificial Sequence: Synthetic coding sequence

SEQ ID NO: 11678 - DNA, 648 bp, Artificial Sequence
  Description of Artificial Sequence: Synthetic coding sequence
atgacccccctggtgagcagactgagcagactgtgggaggtgaaccagctgtgggccggcctgggctactacagcagaggcagaagactgcaggagggcgccagaaaggtggtggaggagctgggcggccacatgcccagaaccgccgagaccctgcagcagctgctgcccggcgtgggcagatacaccgccggcgccatcgccagcatcgccttcggccaggccaccggcgtggtggacggcaacgtggccagagtgctgtgcagagtgagagccatcggcgccgaccccagcagcaccctggtgagccagcagctgtggggcctggcccagcagctggtggaccccgccagacccggcgacttcaaccaggccgccatggagctgggcgccaccgtgtgcaccccccagagacccctgtgcagccagtgccccgtggagagcctgtgcagagccagacagagagtggagcaggagcagctgctggccagcggcagcctgagcggcagccccgacgtggaggagtgcgcccccaacaccggccagtgccacctgtgcctgccccccagcgagccctgggaccagaccctgggcgtggtgaacttccccagaaaggccagcagaaagccccccagagaggagagctag

SEQ ID NO: 11679 - DNA, 693 bp, Artificial Sequence
  Description of Artificial Sequence: Synthetic coding sequence
atgacccccctggtgagcagactgagcagactgtgggccatcatgagaaagcccagagccgccgtgggcagcggccacagaaagcaggccgccagccaggagggcagacagaagcacgccaagaacaacagccaggccaagcccagcgcctgcgacggcggcgagagcaccctgggctggcccggcctgctgttcagctggcccgccgccgccggcggcagcagcgagggcctgctggccggcctgtgggagttccccagcgtgacctgggagcccagcgagcagctgcagagaaaggccctgctgcaggagctgcagagatgggccggccccctgcccgccacccacctgagacacctgggcgaggtggtgcacaccttcagccacatcaagctgacctaccaggtgtacggcctggccctggagggccagacccccgtgaccaccgtgccccccggcgccagatggctgacccaggaggagttccacaccgccgccgtgagcaccgccatgaagaaggtgttcagagtgtaccagggccagcagcccggcacctgcatgggcagcaagagaagccaggtgagcagcccctgcagcagaaagaagcccagaatgggccagcaggtgctggacaacttcttcagaagccacatcagcaccgacgcccacagcctgaacagcgccgcccagtag

SEQ ID NO: 11680 - DNA, 291 bp, Artificial Sequence
  Description of Artificial Sequence: Synthetic coding sequence
atgagcgacaacgacgacatcgaggtggagagcgacgaggagcagcccagattccagagcgccgccgacaagagagcccaccacaacgccctggagagaaagagaagagaccacatcaaggacagcttccacagcctgagagacagcgtgcccagcctgcagggcgagaagctgtacttcctgttctggaagctgtgcacccccgtgctgcacagacagagcctgatgcagaagtgccacaccttcatcagcagctaccaggtgcacaagaagaaggagtgcaagatctag

SEQ ID NO: 11681 - DNA, 405 bp, Artificial Sequence
  Description of Artificial Sequence: Synthetic coding sequence
atgagcgacaacgacgacatcgaggtggagagcgacgaggagcagcccagattccagagcgccgccgacaagagagcccaccacaacgccctggagagaaagagaagagaccacatcaaggacagcttccacagcctgagagacagcgtgcccagcctgcagggcgagaaggccagcagagcccagatcctggacaaggccaccgagtacatccagtacatgagaagaaagaaccacacccaccagcaggacatcgacgacctgaagagacagaacgccctgctggagcagcagggcgagcaccccagcagctggggcagctggccctgctgcgcccccgccagaagcggcttcggcacctgggcctgcagagtgagagccagccacggcgtgtgcgcccagtag

SEQ ID NO: 11682 - DNA, 252 bp, Artificial Sequence
  Description of Artificial Sequence: Synthetic coding sequence
atgagcgacaacgacgacatcgaggtggagagcgacgaggagcagcccagattccagagcgccgccgacaagagagcccaccacaacgccctggagagaaagagaagagaccacatcaaggacagcttccacagcctgagagacagcgtgcccagcctgcagggcgagaagggcaccaagatgaagctgaccctgccccccgtgttcccctacgagcacctgcccttccccaccgtgttctgccacggctag

SEQ ID NO: 11683 - DNA, 456 bp, Artificial Sequence
  Description of Artificial Sequence: Synthetic coding sequence
atgagcgacaacgacgacatcgaggtggagagcgacgccgacaagagagcccaccacaacgccctggagagaaagagaagagaccacatcaaggacagcttccacagcctgagagacagcgtgcccagcctgcagggcgagaaggccagcagagcccagatcctggacaaggccaccgagtacatccagtacatgagaagaaagaaccacacccaccagcaggacatcgacgacctgaagagacagaacgccctgctggagcagcaggtgagagccctggagaaggccagaagcagcgcccagctgcagaccaactaccccagcagcgacaacagcctgtacaccaacgccaagggcagcaccatcagcgccttcgacggcggcagcgacagcagcagcgagagcgagcccgaggagccccagagcagaaagaagctgagaatggaggccagctag

SEQ ID NO: 11684 - DNA, 483 bp, Artificial Sequence
  Description of Artificial Sequence: Synthetic coding sequence
atgagcgacaacgacgacatcgaggtggagagcgacgaggagcagcccagattccagagcgccgccgacaagagagcccaccacaacgccctggagagaaagagaagagaccacatcaaggacagcttccacagcctgagagacagcgtgcccagcctgcagggcgagaaggccagcagagcccagatcctggacaaggccaccgagtacatccagtacatgagaagaaagaaccacacccaccagcaggacatcgacgacctgaagagacagaacgccctgctggagcagcaggtgagagccctggagaaggccagaagcagcgcccagctgcagaccaactaccccagcagcgacaacagcctgtacaccaacgccaagggcagcaccatcagcgccttcgacggcggcagcgacagcagcagcgagagcgagcccgaggagccccagagcagaaagaagctgagaatggaggccagctag

SEQ ID NO: 11685 - DNA, 426 bp, Artificial Sequence
  Description of Artificial Sequence: Synthetic coding sequence
atgctgagcgtgaagatcaccagcatcttcagcatcttcttcttcctgctgttccaggaggagcagcccagattccagagcgccgccgacaagagagcccaccacaacgccctggagagaaagagaagagaccacatcaaggacagcttccacagcctgagagacagcgtgcccagcctgcagggcgagaaggccagcagagcccagatcctggacaaggccaccgagtacatccagtacatgagaagaaagaaccacacccaccagcaggacatcgacgacctgaagagacagaacgccctgctggagcagcagggcgagcaccccagcagctggggcagctggccctgctgcgcccccgccagaagcggcttcggcacctgggcctgcagagtgagagccagccacggcgtgtgcgcccagtag

SEQ ID NO: 11686 - DNA, 312 bp, Artificial Sequence
  Description of Artificial Sequence: Synthetic coding sequence
atgagcgacaacgacgacatcgaggtggagagcgacgaggagcagcccagattccagagcgccgccgacaagagagcccaccacaacgccctggagagaaagagaagagaccacatcaaggacagcttccacagcctgagagacagcgtgcccagcctgcagggcgagaaggccagcagagcccagatcctggacaaggccaccgagtacatccagtacatgagaagaaagaaccacacccaccagcaggacatcgacgacctgaagagacagaacgccctgctggagcagcagggcgagagcgagagctag

SEQ ID NO: 11687 - DNA, 312 bp, Artificial Sequence; identical to SEQ ID NO: 11686
  Description of Artificial Sequence: Synthetic coding sequence

SEQ ID NO: 11688 - DNA, 13923 bp, Artificial Sequence
  Description of Artificial Sequence: Synthetic coding sequence
atgcccgtgcccgacggcagcgtggccgccgccggcctgggcctgggcctgcccgccgccgacagcagaggccactaccagctgctgctgagcggcagagccctggccgacagatacagaagaatctacaccgccgccctgaacgacagagaccagggcggcggcagcgccggccaccccgccagcagaaacaagaagatcctgaacaagaagaagctgaagagaaagcagaagagcaagagcaaggtgaagaccagaagcaagagcgagaacctggagaacaccgtgatcatccccgacatcaagctgcacagcaaccccagcgccttcaacatctactgcaacgtgagacactgcgtgctggagtggcagaagaaggagatcagcctggccgccgccagcaagaacagcgtgcagagcggcgagagcgacagcgacgaggaggaggagagcaaggagccccccatcaagctgcccaagatcatcgaggtgggcctgtgcgaggtgttcgagctgatcaaggagaccagattcagccaccccagcctgtgcctgagaagcctgcaggccctgctgaacgtgctgcagggccagcagcccgagggcctgcagagcgagccccccgaggtgctggagagcctgttccagctgctgctggagatcaccgtgagaagcaccggcatgaacgacagcaccggccagagcctgaccgccctgagctgcgcctgcctgttcagcctggtggccagctggggcgagaccggcagaaccctgcaggccatcagcgccatcctgaccaacaacggcagccacgcctgccagaccatccaggtgcccaccatcctgaacagcctgcagagaagcgtgcaggccgtgctggtgggcaagatccagatccaggactggttcagcaacggcatcaagaaggccgccctgatgcacaagtggcccctgaaggagatcagcgtggacgaggacgaccagtgcctgctgcagaacgacggcttcttcctgtacctgctgtgcaaggacggcctgtacaagatcggcagcggctacagcggcaccgtgagaggccacatctacaacagcaccagcagaatcagaaacagaaaggagaagaagagctggctgggctacgcccagggctacctgctgtacagagacgtgaacaaccacagcatgaccgccatcagaatcagccccgagaccctggagcaggacggcaccgtgatgctgcccgactgccacaccgagggccagaacatcctgttcaccgacggcgagtacatcaaccagatcgccgccagcagagacgacggcttcgtggtgagaatcttcgccaccagcaccgagcccgtgctgcagcaggagctgcagctgaagctggccagaaagtgcctgcacgcctgcggcatcagcctgttcgacctggagaaggacctgcacatcatcagcaccggcttcgacgaggagagcgccatcctgggcgccggcagagagttcgccctgatgaagaccgccaacggcaagatctactacaccggcaagtaccagagcctgggcatcaagcagggcggccccagcgccggcaagtgggtggagctgcccatcaccaagagccccaagatcgtgcacttcagcgtgggccacgacggcagccacgccctgctggtggccgaggacggcagcatcttcttcaccggcagcgccagcaagggcgaggacggcgagagcaccaagagcagaagacagagcaagccctacaagcccaagaagatcatcaagatggagggcaagatcgtggtgtacaccgcctgcaacaacggcagcagcagcgtgatcagcaaggacggcgagctgtacatgttcggcaaggacgccatctacagcgacagcagcagcctggtgaccgacctgaagggccacttcgtgacccaggtggccatgggcaaggcccacacctgcgtgctgatgaagaacggcgaggtgtggaccttcggcgtgaacaacaagggccagtgcggcagagacaccggcgccatgaaccagggcggcaagggcttcggcgtggagaacatggccaccgccatggacgaggacctggaggaggagctggacgagaaggacgagaagagcatgatgtgcccccccggcatgcacaagtggaagctggagcagtgcatggtgtgcaccgtgtgcggcgactgcaccggctacggcgccagctgcgtgagcagcggcagacccgacagagtgcccggcggcatctgcggctgcggcagcggcgagagcggctgcgccgtgtgcggctgctgcaaggcctgcgccagagagctggacggccaggaggccagacagagaggcatcctggacgccgtgaaggagatgatccccctggacctgctgctggccgtgcccgtgcccggcgtgaacatcgaggagcacctgcagctgagacaggaggagaagagacagagagtgatcagaagacacagactggaggagggcagaggccccctggtgttcgccggccccatcttcatgaaccacagagagcaggccctggccagactgagaagccaccccgcccagctgaagcacaagagagacaagcacaaggacggcagcggcgagagaggcgagaaggacgccagcaagatcaccacctacccccccggcagcgtgagattcgactgcgagctgagagccgtgcaggtgagctgcggcttccaccacagcgtggtgctgatggagaacggcgacgtgtacaccttcggctacggccagcacggccagctgggccacggcgacgtgaacagcagaggctgccccaccctggtgcaggccctgcccggccccagcacccaggtgaccgccggcagcaaccacaccgccgtgctgctgatggacggccaggtgttcaccttcggcagcttcagcaagggccagctgggcagacccatcctggacgtgccctactggaacgccaagcccgcccccatgcccaacatcggcagcaagtacggcagaaaggccacctggatcggcgccagcggcgaccagaccttcctgagaatcgacgaggccctgatcaacagccacgtgctggccaccagcgagatcttcgccagcaagcacatcatcggcctggtgcccgccagcatcagcgagcccccccccttcaagtgcctgctgatcaacaaggtggacggcagctgcaagaccttcaacgacagcgagcaggaggacctgcagggcttcggcgtgtgcctggaccccgtgtacgacgtgatctggagattcagacccaacaccagagagctgtggtgctacaacgccgtggtggccgacgccagactgcccagcgccgccgacatgcagagcagatgcagcatcctgagccccgagctggccctgcccaccggcagcagagccctgaccaccagaagccacgccgccctgcacatcctgggctgcctggacaccctggccgccatgcaggacctgaagatgggcgtggccagcaccgaggaggagacccaggccgtgatgaaggtgtacagcaaggaggactacagcgtggtgaacagattcgagagccacggcggcggctggggctacagcgcccacagcgtggaggccatcagattcagcgccgacaccgacatcctgctgggcggcctgggcctgttcggcggcagaggcgagtacaccgccaagatcaagctgttcgagctgggccccgacggcggcgaccacgagaccgacggcgacctgctggccgagaccgacgtgctggcctacgactgcgccgccagagagaagtacgccatgatgttcgacgagcccgtgctgctgcaggccggctggtggtacgtggcctgggccagagtgagcggccccagcagcgactgcggcagccacggccaggccagcatcaccaccgacgacggcgtggtgttccagttcaagagcagcaagaagagcaacaacggcaccgacgtgaacgccggccagatcccccagctgctgtacagactgcccaccagcgacggcagcgccagcaagggcaagcagcagaccagcgagcccgtgcacatcctgaagagaagcttcgccagaaccgtgagcgtggagtgcttcgagagcctgctgagcatcctgcactggagctggaccaccctggtgctgggcgtggaggagctgagaggcctgaagggcttccagttcaccgccaccctgctggacctggagagactgagattcgtgggcacctgctgcctgagactgctgagagtgtacacctgcgagatctaccccgtgagcgccaccggcaaggccgtggtggaggagaccagcaagctggccgagtgcatcggcaagaccagaaccctgctgagaaagatcctgagcgagggcgtggaccactgcatggtgaagctggacaacgacccccagggctacctgagccagcccctgagcctgctggaggccgtgctgcaggagtgccacaacaccttcaccgcctgcttccacagcttctaccccacccccgccctgcagtgggcctgcctgtgcgacctgctgaactgcctggaccaggacatccaggaggccaacttcaagaccagcagcagcagactgctggccgccgtgatgagcgccctgtgccacaccagcgtgaagctgaccagcatcttccccatcgcctacgacggcgaggtgctgctgagaagcatcgtgaagcaggtgagcaccgagaacgacagcaccctggtgcacagattccccctgctggtggcccacatggagaagctgagccagagcgaggagaacatcagcggcatgaccagcttcagagaggtgctggagaagatgctggtgatcgtggtgctgcccgtgagaaacagcctgagaagagagaacgagctgttcagcagccacctggtgagcaacacctgcggcctgctggccagcatcgtgagcgagctgaccgccagcgccctgggcagcgaggtggacggcctgaacagcctgcacagcgtgaaggccagcgccaacagattcaccaagaccagccagggcagaagctggaacaccggcaacggcagccccgacgccatctgcttcagcgtggacaagcccggcatcgtggtggtgggcttcagcgtgtacggcggcggcggcatccacgagtacgagctggaggtgctggtggacgacagcgagcacgccggcgacagcacccacagccacagatggaccagcctggagctggtgaagggcacctacaccaccgacgacagccccagcgacatcgccgagatcagactggacaaggtggtgcccctgaaggagaacgtgaagtacgccgtgagactgagaaactacggcagcagaaccgccaacggcgacggcggcatgaccaccgtgcagtgccccgacggcgtgaccttcaccttcagcacctgcagcctgagcagcaacggcaccaaccagaccagaggccagatcccccagatcctgtactacagaagcgagttcgacggcgacctgcagagccagctgctgagcaaggccaacgaggaggacaagaactgcagcagagccctgagcgtggtgagcaccgtggtgagagccagcaaggacctgctgcacagagccctggccgtggacgccgacgacatccccgagctgctgagcagcagcagcctgttcagcatgctgctgcccctgatcatcgcctacatcggccccgtggccgccgccatccccaaggtggccgtggaggtgttcggcctggtgcagcagctgctgcccagcgtggccatcctgaaccagaagtacgccccccccgccttcaaccccaaccagagcaccgacagcaccaccggcaaccagcccgagcagggcctgagcgcctgcaccaccagcagccactacgccgtgatcgagagcgagcacccctacaagcccgcctgcgtgatgcactacaaggtgaccttccccgagtgcgtgagatggatgaccatcgagttcgacccccagtgcggcaccgcccagagcgaggacgtgctgagactgctgatccccgtgagaaccgtgcagaacagcggctacggccccaagctgaccagcgtgcacgagaacctgaacagctggatcgagctgaagaagttcagcggcagcagcggctggcccaccatggtgctggtgctgcccggcaacgaggccctgttcagcctggagaccgccagcgactacgtgaaggacgacaaggccagcttctacggcttcaagtgcttcgccatcggctacgagttcagccccggccccgacgagggcgtgatccagctggagaaggagctggccaacctgggcggcgtgtgcgccgccgccctgatgaagaaggacctggccctgcccatcggcaacgagctggaggaggacctggagatcctggaggaggccgccctgcaggtgtgcaagacccacagcggcatcctgggcaagggcctggccctgagccacagccccaccatcctggaggccctggagggcaacctgcccctgcagatccagagcaacgagcagagcttcctggacgacttcatcgcctgcgtgcccggcagcagcggcggcagactggccagatggctgcagcccgacagctacgccgacccccagaagaccagcctgatcctgaacaaggacgacatcagatgcggctggcccaccaccatcaccgtgcagaccaaggaccagtacggcgacgtggtgcacgtgcccaacatgaaggtggaggtgaaggccgtgcccgtgagccagaagaagatgagcctgcagcaggaccaggccaagaagccccagagaatccccggcagccccgccgtgaccgccgccagcagcaacaccgacatgacctacggcggcctggccagccccaagctggacgtgagctacgagcccatgatcgtgaaggaggccagatacatcgccatcaccatgatgaaggtgtacgagaactacagcttcgaggagctgagattcgccagccccacccccaagagacccagcgagaacatgctgatcagagtgaacaacgacggcacctactgcgccaactggacccccggcgccatcggcctgtacaccctgcacgtgaccatcgacggcatcgagatcgacgccggcctggaggtgaaggtgaaggacccccccaagggcatgatcccccccggcacccagctggtgaagcccaagagcgagccccagcccaacaaggtgagaaagttcgtggccaaggacagcgccggcctgagaatcagaagccaccccagcctgcagagcgagcagatcggcatcgtgaaggtgaacggcaccatcaccttcatcgacgagatccacaacgacgacggcgtgtggctgagactgaacgacgagaccatcaagaagtacgtgcccaacatgaacggctacaccgaggcctggtgcctgagcttcaaccagcacctgggcaagagcctgctggtgcccgtggacgagagcaagaccaacaccgacgacttcttcaaggacatcaacagctgctgcccccaggaggccaccatgcaggagcaggacatgcccttcctgagaggcggccccggcatgtacaaggtggtgaagaccggccccagcggccacaacatcagaagctgccccaacctgagaggcatccccatcggcatgctggtgctgggcaacaaggtgaaggccgtgggcgaggtgaccaacagcgagggcacctgggtgcagctggaccagaacagcatggtggagttctgcgagagcgacgagggcgaggcctggagcctggccagagacagaggcggcaaccagtacctgagacacgaggacgagcaggccctgctggaccagaacagccagacccccccccccagccccttcagcgtgcaggccttcaacaagggcgccagctgcagcgcccagggcttcgactacggcctgggcaacagcaagggcgacagaggcaacatcagcaccagcagcaagcccgccagcaccagcggcaagagcgagctgagcagcaagcacagcagaagcctgaagcccgacggcagaatgagcagaaccaccgccgaccagaagaagcccagaggcaccgagagcctgagcgccagcgagagcctgatcctgaagagcgacgccgccaagctgagaagcgacagccacagcagaagcctgagccccaaccacaacaccctgcagaccctgaagagcgacggcagaatgcccagcagcagcagagccgagagccccggccccggcagcagactgagcagccccaagcccaagaccctgcccgccaacagaagcagccccagcggcgccagcagccccagaagcagcagcccccacgacaagaacctgccccagaagagcaccgcccccgtgaagaccaagctggacccccccagagagagaagcaagagcgacagctacaccctggaccccgacaccctgagaaagaagaagatgcccctgaccgagcccctgagaggcagaagcaccagccccaagcccaagagcgtgcccaaggacagcaccgacagccccggcagcgagaacagagcccccagcccccacgtggtgcaggagaacctgcacagcgaggtggtggaggtgtgcaccagcagcaccctgaagaccaacagcctgaccgacagcacctgcgacgacagcagcgagttcaagagcgtggacgagggcagcaacaaggtgcacttcagcatcggcaaggcccccctgaaggacgagcaggagatgagagccagccccaagatcagcagaaagtgcgccaacagacacaccagacccaagaaggagaagagcagcttcctgttcaagggcgacggcagcaagcccctggagcccgccaagcaggccatgagccccagcgtggccgagtgcgccagagccgtgttcgccagcttcctgtggcacgagggcatcgtgcacgacgccatggcctgcagcagcttcctgaagttccaccccgagctgagcaaggagcacgcccccatcagaagcagcctgaacagccagcagcccaccgaggagaaggagaccaagctgaagaacagacacagcctggagatcagcagcgccctgaacatgttcaacatcgccccccacggccccgacatcagcaagatgggcagcatcaacaagaacaaggtgctgagcatgctgaaggagccccccctgcacgagaagtgcgaggacggcaagaccgagaccaccttcgagatgagcatgcacaacaccatgaagagcaagagccccctgcccctgaccctgcagcacctggtggccttctgggaggacatcagcctggccaccatcaaggccgccagccagaacatgatcttccccagccccggcagctgcgccgtgctgaagaagaaggagtgcgagaaggagaacaagaagagcaagaaggagaagaagaagaaggagaaggccgaggtgagacccagaggcaacctgttcggcgagatggcccagctggccgtgggcggccccgagaaggacaccatctgcgagctgtgcggcgagagccacccctaccccgtgacctaccacatgagacaggcccaccccggctgcggcagatacgccggcggccagggctacaacagcatcggccacttctgcggcggctgggccggcaactgcggcgacggcggcatcggcggcagcacctggtacctggtgtgcgacagatgcagagagaagtacctgagagagaagcaggccgccgccagagagaaggtgaagcagagcagaagaaagcccatgcaggtgaagacccccagagccctgcccaccatggaggcccaccaggtgatcaaggccaacgccctgttcctgctgagcctgagcagcgccgccgagcccagcatcctgtgctaccaccccgccaagcccttccagagccagctgcccagcgtgaaggagggcatcagcgaggacctgcccgtgaagatgccctgcctgtacctgcagaccctggccagacaccaccacgagaacttcgtgggctaccaggacgacaacctgttccaggacgagatgagatacctgagaagcaccagcgtgcccgccccctacatcagcgtgacccccgacgccagccccaacgtgttcgaggagcccgagagcaacatgaagagcatgccccccagcctggagaccagccccatcaccgacaccgacctggccaagagaaccgtgttccagagaagctacagcgtggtggccagcgagtacgacaagcagcacagcatcctgcccgccagagtgaaggccatccccagaagaagagtgaacagcggcgacaccgaggtgggcagcagcctgctgagacaccccagccccgagctgagcagactgatcagcgcccacagcagcctgagcaagggcgagagaaacttccagtggcccgtgctggccttcgtgatccagcaccacgacctggagggcctggagatcgccatgaagcaggccctgagaaagagcgcctgcagagtgttcgccatggaggccttcaactggctgctgtgcaacgtgatccagaccaccagcctgcacgacatcctgtggcacttcgtggccagcctgacccccgcccccgtggagcccgaggaggaggaggacgaggagaacaagaccagcaaggagaacagcgagcaggagaaggacaccagagtgtgcgagcaccccctgagcgacatcgtgatcgccggcgaggccgcccaccccctgccccacaccttccacagactgctgcagaccatcagcgacctgatgatgagcctgcccagcggcagcagcctgcagcagatggccctgagatgctggagcctgaagttcaagcagagcgaccaccagttcctgcaccagagcaacgtgttccaccacatcaacaacatcctgagcaagagcgacgacggcgacagcgaggagagcttcagcatcagcatccagagcggcttcgaggccatgagccaggagctgtgcatcgtgatgtgcctgaaggacctgaccagcatcgtggacatcaagaccagcagcagacccgccatgatcggcagcctgaccgacggcagcaccgagaccttctgggagagcggcgacgaggacaagaacaagaccaagaacatcaccatcaactgcgtgaagggcatcaacgccagatacgtgagcgtgcacgtggacaacagcagagacctgggcaacaaggtgaccagcatgaccttcctgaccggcaaggccgtggaggacctgtgcagaatcaagcaggtggacctggacagcagacacatcggctgggtgaccagcgagctgcccggcggcgacaaccacatcatcaagatcgagctgaagggccccgagaacaccctgagagtgagacaggtgaaggtgctgggctggaaggacggcgagagcaccaagatcgccggccagatcagcgccagcgtggcccagcagagaaactgcgaggccgagaccctgagagtgttcagactgatcaccagccaggtgttcggcaagctgatcagcggcgacgccgagcccacccccgagcaggaggagaaggccctgctgagcagccccgagggcgaggagaaggtgtacaacgccaccagcgacgccgacctgaaggagcacatggtgggcatcatcttcagcagaagcaagctgaccaacctgcagaagcaggtgtgcgcccacatcgtgcaggccatcagaatggaggccaccagagtgagagaggagtgggagcacgccatcagcagcaaggagaacgccaacagccagcccaacgacgaggacgccagcagcgacgcctactgcttcgagctgctgagcatggtgctggccctgagcggcagcaacgtgggcagacagtacctggcccagcagctgaccctgctgcaggacctgttcagcctgctgcacaccgccagccccagagtgcagagacaggtgaccagcctgctgagaagagtgctgcccgaggtgacccccagcagactggccagcatcatcggcgtgaagagcctgccccccgccgacatcagcgacatcatccacagcaccgagaagggcgactggaacaagctgggcatcctggacatgttcctgggctgcatcgccaaggccctgaccgtgcagctgaaggccaagggcaccaccatcaccggcaccgccggcaccaccgtgggcaagggcgtgaccaccgtgaccctgcccatgatcttcaacagcagctacctgagaagaggcgagagccactggtggatgaagggcagcacccccacccagatcagcgagatcatcatcaagctgatcaaggacatggccgccggccacctgagcgaggcctggagcagagtgaccaagaacgccatcgccgagaccatcatcgccctgaccaagatggaggaggagttcagaagccccgtgagatgcatcgccaccaccagactgtggctggccctggccagcctgtgcgtgctggaccaggaccacgtggacagactgagcagcggcagatggatgggcaaggacggccagcagaagcagatgcccatgtgcgacaaccacgacgacggcgagaccgccgccatcatcctgtgcaacgtgtgcggcaacctgtgcaccgactgcgacagattcctgcacctgcacagaagaaccaagacccaccagagacaggtgttcaaggaggaggaggaggccatcaaggtggacctgcacgagggctgcggcagaaccaagctgttctggctgatggccctggccgacagcaagaccatgaaggccatggtggagttcagagagcacaccggcaagcccaccaccagcagcagcgaggcctgcagattctgcggcagcagaagcggcaccgagctgagcgccgtgggcagcgtgtgcagcgacgccgactgccaggagtacgccaagatcgcctgcagcaagacccacccctgcggccacccctgcggcggcgtgaagaacgaggagcactgcctgccctgcctgcacggctgcgacaagagcgccaccagcctgaagcaggacgccgacgacatgtgcatgatctgcttcaccgaggccctgagcgccgcccccgccatccagctggactgcagccacatcttccacctgcagtgctgcagaagagtgctggagaacagatggctgggccccagaatcaccttcggcttcatcagctgccccatctgcaagaacaagatcaaccacatcgtgctgaaggacctgctggaccccatcaaggagctgtacgaggacgtgagaagaaaggccctgatgagactggagtacgagggcctgcacaagagcgaggccatcaccacccccggcgtgagattctacaacgaccccgccggctacgccatgaacagatacgcctactacgtgtgctacaagtgcagaaaggcctacttcggcggcgaggccagatgcgacgccgaggccggcagaggcgacgactacgaccccagagagctgatctgcggcgcctgcagcgacgtgagcagagcccagatgtgccccaagcacggcaccgacttcctggagtacaagtgcagatactgctgcagcgtggccgtgttcttctgcttcggcaccacccacttctgcaacgcctgccacgacgacttccagagaatgaccagcatccccaaggaggagctgccccactgccccgccggccccaagggcaagcagctggagggcaccgagtgccccctgcacgtggtgcacccccccaccggcgaggagttcgccctgggctgcggcgtgtgcagaaacgcccacaccttctag

SEQ ID NO: 11689 - DNA, 1542 bp, Artificial Sequence
  Description of Artificial Sequence: Synthetic coding sequence
atgcaggagcaggacatgcccttcctgagaggcggccccggcatgtacaaggtggtgaagaccggccccagcggccacaacatcagaagctgccccaacctgagaggcatccccatcggcatgctggtgctgggcaacaaggtgaaggccgtgggcgaggtgaccaacagcgagggcacctgggtgcagctggaccagaacagcatggtggagttctgcgagagcgacgagggcgaggcctggagcctggccagagacagaggcggcaaccagtacctgagacacgaggacgagcaggccctgctggaccagaacagccagacccccccccccagccccttcagcgtgcaggccttcaacaagggcgccagctgcagcgcccagggcttcgactacggcctgggcaacagcaaggtgctgaccgtgctgcccaccgccggcgaccagctgagcgccatcctgaacagcatccagagcagacccaacctgcccgcccccagcatcttcgaccaggccgccaagccccccagcagcctggtgcacagccccttcgtgttcggccagcccctgagcttccagcagccccagctgcagagcgacagaggcaacatcagcaccagcagcaagcccgccagcaccagcggcaagagcgagctgagcagcaagcacagcagaagcctgaagcccgacggcagaatgagcagaaccaccgccgaccagaagaagcccagaggcaccgagagcctgagcgccagcgagagcctgatcctgaagagcgacgccgccaagctgagaagcgacagccacagcagaagcctgagccccaaccacaacaccctgcagaccctgaagagcgacggcagaatgcccagcagcagcagagccgagagccccggccccggcagcagactgagcagccccaagcccaagaccctgcccgccaacagaagcagccccagcggcgccagcagccccagaagcagcagcccccacgacaagaacctgccccagaagagcaccgcccccgtgaagaccaagctggacccccccagagagagaagcaagagcgacagctacaccctggaccccgacaccctgagaaagaagaagatgcccctgaccgagcccctgagaggcagaagcaccagccccaagcccaagagcgtgcccaaggacagcaccgacagccccggcagcgagaacagagcccccagcccccacgtggtgcaggagaacctgcacagcgaggtggtggaggtgtgcaccagcagcaccctgaagaccaacagcctgaccgacagcacctgcgacgacagcagcgagttcaagagcgtggacgagggcagcaacaaggtgcacttcagcatcggcaaggcccccctgaaggacgagcaggagatgagagccagccccaagatcagcagaaagtgcgccaacagacacaccagacccaagagaaagatcgagttcagcttccagagaagatggatccaggccttcagagccagccaggccagccacgtgagcttctgcggcagatag

SEQ ID NO: 11690 - DNA, 14037 bp, Artificial Sequence
  Description of Artificial Sequence: Synthetic coding sequence
atgatgatgtgcgccgccaccgccagccccgccgccgccagcagcggcctgggcggcgacggcttctaccccgccgccaccttcagcagcagccccgcccccggcgccctgttcatgcccgtgcccgacggcagcgtggccgccgccggcctgggcctgggcctgcccgccgccgacagcagaggccactaccagctgctgctgagcggcagagccctggccgacagatacagaagaatctacaccgccgccctgaacgacagagaccagggcggcggcagcgccggccaccccgccagcagaaacaagaagatcctgaacaagaagaagctgaagagaaagcagaagagcaagagcaaggtgaagaccagaagcaagagcgagaacctggagaacaccgtgatcatccccgacatcaagctgcacagcaaccccagcgccttcaacatctactgcaacgtgagacactgcgtgctggagtggcagaagaaggagatcagcctggccgccgccagcaagaacagcgtgcagagcggcgagagcgacagcgacgaggaggaggagagcaaggagccccccatcaagctgcccaagatcatcgaggtgggcctgtgcgaggtgttcgagctgatcaaggagaccagattcagccaccccagcctgtgcctgagaagcctgcaggccctgctgaacgtgctgcagggccagcagcccgagggcctgcagagcgagccccccgaggtgctggagagcctgttccagctgctgctggagatcaccgtgagaagcaccggcatgaacgacagcaccggccagagcctgaccgccctgagctgcgcctgcctgttcagcctggtggccagctggggcgagaccggcagaaccctgcaggccatcagcgccatcctgaccaacaacggcagccacgcctgccagaccatccaggtgcccaccatcctgaacagcctgcagagaagcgtgcaggccgtgctggtgggcaagatccagatccaggactggttcagcaacggcatcaagaaggccgccctgatgcacaagtggcccctgaaggagatcagcgtggacgaggacgaccagtgcctgctgcagaacgacggcttcttcctgtacctgctgtgcaaggacggcctgtacaagatcggcagcggctacagcggcaccgtgagaggccacatctacaacagcaccagcagaatcagaaacagaaaggagaagaagagctggctgggctacgcccagggctacctgctgtacagagacgtgaacaaccacagcatgaccgccatcagaatcagccccgagaccctggagcaggacggcaccgtgatgctgcccgactgccacaccgagggccagaacatcctgttcaccgacggcgagtacatcaaccagatcgccgccagcagagacgacggcttcgtggtgagaatcttcgccaccagcaccgagcccgtgctgcagcaggagctgcagctgaagctggccagaaagtgcctgcacgcctgcggcatcagcctgttcgacctggagaaggacctgcacatcatcagcaccggcttcgacgaggagagcgccatcctgggcgccggcagagagttcgccctgatgaagaccgccaacggcaagatctactacaccggcaagtaccagagcctgggcatcaagcagggcggccccagcgccggcaagtgggtggagctgcccatcaccaagagccccaagatcgtgcacttcagcgtgggccacgacggcagccacgccctgctggtggccgaggacggcagcatcttcttcaccggcagcgccagcaagggcgaggacggcgagagcaccaagagcagaagacagagcaagccctacaagcccaagaagatcatcaagatggagggcaagatcgtggtgtacaccgcctgcaacaacggcagcagcagcgtgatcagcaaggacggcgagctgtacatgttcggcaaggacgccatctacagcgacagcagcagcctggtgaccgacctgaagggccacttcgtgacccaggtggccatgggcaaggcccacacctgcgtgctgatgaagaacggcgaggtgtggaccttcggcgtgaacaacaagggccagtgcggcagagacaccggcgccatgaaccagggcggcaagggcttcggcgtggagaacatggccaccgccatggacgaggacctggaggaggagctggacgagaaggacgagaagagcatgatgtgcccccccggcatgcacaagtggaagctggagcagtgcatggtgtgcaccgtgtgcggcgactgcaccggctacggcgccagctgcgtgagcagcggcagacccgacagagtgcccggcggcatctgcggctgcggcagcggcgagagcggctgcgccgtgtgcggctgctgcaaggcctgcgccagagagctggacggccaggaggccagacagagaggcatcctggacgccgtgaaggagatgatccccctggacctgctgctggccgtgcccgtgcccggcgtgaacatcgaggagcacctgcagctgagacaggaggagaagagacagagagtgatcagaagacacagactggaggagggcagaggccccctggtgttcgccggccccatcttcatgaaccacagagagcaggccctggccagactgagaagccaccccgcccagctgaagcacaagagagacaagcacaaggacggcagcggcgagagaggcgagaaggacgccagcaagatcaccacctacccccccggcagcgtgagattcgactgcgagctgagagccgtgcaggtgagctgcggcttccaccacagcgtggtgctgatggagaacggcgacgtgtacaccttcggctacggccagcacggccagctgggccacggcgacgtgaacagcagaggctgccccaccctggtgcaggccctgcccggccccagcacccaggtgaccgccggcagcaaccacaccgccgtgctgctgatggacggccaggtgttcaccttcggcagcttcagcaagggccagctgggcagacccatcctggacgtgccctactggaacgccaagcccgcccccatgcccaacatcggcagcaagtacggcagaaaggccacctggatcggcgccagcggcgaccagaccttcctgagaatcgacgaggccctgatcaacagccacgtgctggccaccagcgagatcttcgccagcaagcacatcatcggcctggtgcccgccagcatcagcgagcccccccccttcaagtgcctgctgatcaacaaggtggacggcagctgcaagaccttcaacgacagcgagcaggaggacctgcagggcttcggcgtgtgcctggaccccgtgtacgacgtgatctggagattcagacccaacaccagagagctgtggtgctacaacgccgtggtggccgacgccagactgcccagcgccgccgacatgcagagcagatgcagcatcctgagccccgagctggccctgcccaccggcagcagagccctgaccaccagaagccacgccgccctgcacatcctgggctgcctggacaccctggccgccatgcaggacctgaagatgggcgtggccagcaccgaggaggagacccaggccgtgatgaaggtgtacagcaaggaggactacagcgtggtgaacagattcgagagccacggcggcggctggggctacagcgcccacagcgtggaggccatcagattcagcgccgacaccgacatcctgctgggcggcctgggcctgttcggcggcagaggcgagtacaccgccaagatcaagctgttcgagctgggccccgacggcggcgaccacgagaccgacggcgacctgctggccgagaccgacgtgctggcctacgactgcgccgccagagagaagtacgccatgatgttcgacgagcccgtgctgctgcaggccggctggtggtacgtggcctgggccagagtgagcggccccagcagcgactgcggcagccacggccaggccagcatcaccaccgacgacggcgtggtgttccagttcaagagcagcaagaagagcaacaacggcaccgacgtgaacgccggccagatcccccagctgctgtacagactgcccaccagcgacggcagcgccagcaagggcaagcagcagaccagcgagcccgtgcacatcctgaagagaagcttcgccagaaccgtgagcgtggagtgcttcgagagcctgctgagcatcctgcactggagctggaccaccctggtgctgggcgtggaggagctgagaggcctgaagggcttccagttcaccgccaccctgctggacctggagagactgagattcgtgggcacctgctgcctgagactgctgagagtgtacacctgcgagatctaccccgtgagcgccaccggcaaggccgtggtggaggagaccagcaagctggccgagtgcatcggcaagaccagaaccctgctgagaaagatcctgagcgagggcgtggaccactgcatggtgaagctggacaacgacccccagggctacctgagccagcccctgagcctgctggaggccgtgctgcaggagtgccacaacaccttcaccgcctgcttccacagcttctaccccacccccgccctgcagtgggcctgcctgtgcgacctgctgaactgcctggaccaggacatccaggaggccaacttcaagaccagcagcagcagactgctggccgccgtgatgagcgccctgtgccacaccagcgtgaagctgaccagcatcttccccatcgcctacgacggcgaggtgctgctgagaagcatcgtgaagcaggtgagcaccgagaacgacagcaccctggtgcacagattccccctgctggtggcccacatggagaagctgagccagagcgaggagaacatcagcggcatgaccagcttcagagaggtgctggagaagatgctggtgatcgtggtgctgcccgtgagaaacagcctgagaagagagaacgagctgttcagcagccacctggtgagcaacacctgcggcctgctggccagcatcgtgagcgagctgaccgccagcgccctgggcagcgaggtggacggcctgaacagcctgcacagcgtgaaggccagcgccaacagattcaccaagaccagccagggcagaagctggaacaccggcaacggcagccccgacgccatctgcttcagcgtggacaagcccggcatcgtggtggtgggcttcagcgtgtacggcggcggcggcatccacgagtacgagctggaggtgctggtggacgacagcgagcacgccggcgacagcacccacagccacagatggaccagcctggagctggtgaagggcacctacaccaccgacgacagccccagcgacatcgccgagatcagactggacaaggtggtgcccctgaaggagaacgtgaagtacgccgtgagactgagaaactacggcagcagaaccgccaacggcgacggcggcatgaccaccgtgcagtgccccgacggcgtgaccttcaccttcagcacctgcagcctgagcagcaacggcaccaaccagaccagaggccagatcccccagatcctgtactacagaagcgagttcgacggcgacctgcagagccagctgctgagcaaggccaacgaggaggacaagaactgcagcagagccctgagcgtggtgagcaccgtggtgagagccagcaaggacctgctgcacagagccctggccgtggacgccgacgacatccccgagctgctgagcagcagcagcctgttcagcatgctgctgcccctgatcatcgcctacatcggccccgtggccgccgccatccccaaggtggccgtggaggtgttcggcctggtgcagcagctgctgcccagcgtggccatcctgaaccagaagtacgccccccccgccttcaaccccaaccagagcaccgacagcaccaccggcaaccagcccgagcagggcctgagcgcctgcaccaccagcagccactacgccgtgatcgagagcgagcacccctacaagcccgcctgcgtgatgcactacaaggtgaccttccccgagtgcgtgagatggatgaccatcgagttcgacccccagtgcggcaccgcccagagcgaggacgtgctgagactgctgatccccgtgagaaccgtgcagaacagcggctacggccccaagctgaccagcgtgcacgagaacctgaacagctggatcgagctgaagaagttcagcggcagcagcggctggcccaccatggtgctggtgctgcccggcaacgaggccctgttcagcctggagaccgccagcgactacgtgaaggacgacaaggccagcttctacggcttcaagtgcttcgccatcggctacgagttcagccccggccccgacgagggcgtgatccagctggagaaggagctggccaacctgggcggcgtgtgcgccgccgccctgatgaagaaggacctggccctgcccatcggcaacgagctggaggaggacctggagatcctggaggaggccgccctgcaggtgtgcaagacccacagcggcatcctgggcaagggcctggccctgagccacagccccaccatcctggaggccctggagggcaacctgcccctgcagatccagagcaacgagcagagcttcctggacgacttcatcgcctgcgtgcccggcagcagcggcggcagactggccagatggctgcagcccgacagctacgccgacccccagaagaccagcctgatcctgaacaaggacgacatcagatgcggctggcccaccaccatcaccgtgcagaccaaggaccagtacggcgacgtggtgcacgtgcccaacatgaaggtggaggtgaaggccgtgcccgtgagccagaagaagatgagcctgcagcaggaccaggccaagaagccccagagaatccccggcagccccgccgtgaccgccgccagcagcaacaccgacatgacctacggcggcctggccagccccaagctggacgtgagctacgagcccatgatcgtgaaggaggccagatacatcgccatcaccatgatgaaggtgtacgagaactacagcttcgaggagctgagattcgccagccccacccccaagagacccagcgagaacatgctgatcagagtgaacaacgacggcacctactgcgccaactggacccccggcgccatcggcctgtacaccctgcacgtgaccatcgacggcatcgagatcgacgccggcctggaggtgaaggtgaaggacccccccaagggcatgatcccccccggcacccagctggtgaagcccaagagcgagccccagcccaacaaggtgagaaagttcgtggccaaggacagcgccggcctgagaatcagaagccaccccagcctgcagagcgagcagatcggcatcgtgaaggtgaacggcaccatcaccttcatcgacgagatccacaacgacgacggcgtgtggctgagactgaacgacgagaccatcaagaagtacgtgcccaacatgaacggctacaccgaggcctggtgcctgagcttcaaccagcacctgggcaagagcctgctggtgcccgtggacgagagcaagaccaacaccgacgacttcttcaaggacatcaacagctgctgcccccaggaggccaccatgcaggagcaggacatgcccttcctgagaggcggccccggcatgtacaaggtggtgaagaccggccccagcggccacaacatcagaagctgccccaacctgagaggcatccccatcggcatgctggtgctgggcaacaaggtgaaggccgtgggcgaggtgaccaacagcgagggcacctgggtgcagctggaccagaacagcatggtggagttctgcgagagcgacgagggcgaggcctggagcctggccagagacagaggcggcaaccagtacctgagacacgaggacgagcaggccctgctggaccagaacagccagacccccccccccagccccttcagcgtgcaggccttcaacaagggcgccagctgcagcgcccagggcttcgactacggcctgggcaacagcaagggcgacagaggcaacatcagcaccagcagcaagcccgccagcaccagcggcaagagcgagctgagcagcaagcacagcagaagcctgaagcccgacggcagaatgagcagaaccaccgccgaccagaagaagcccagaggcaccgagagcctgagcgccagcgagagcctgatcctgaagagcgacgccgccaagctgagaagcgacagccacagcagaagcctgagccccaaccacaacaccctgcagaccctgaagagcgacggcagaatgcccagcagcagcagagccgagagccccggccccggcagcagactgagcagccccaagcccaagaccctgcccgccaacagaagcagccccagcggcgccagcagccccagaagcagcagcccccacgacaagaacctgccccagaagagcaccgcccccgtgaagaccaagctggacccccccagagagagaagcaagagcgacagctacaccctggaccccgacaccctgagaaagaagaagatgcccctgaccgagcccctgagaggcagaagcaccagccccaagcccaagagcgtgcccaaggacagcaccgacagccccggcagcgagaacagagcccccagcccccacgtggtgcaggagaacctgcacagcgaggtggtggaggtgtgcaccagcagcaccctgaagaccaacagcctgaccgacagcacctgcgacgacagcagcgagttcaagagcgtggacgagggcagcaacaaggtgcacttcagcatcggcaaggcccccctgaaggacgagcaggagatgagagccagccccaagatcagcagaaagtgcgccaacagacacaccagacccaagaaggagaagagcagcttcctgttcaagggcgacggcagcaagcccctggagcccgccaagcaggccatgagccccagcgtggccgagtgcgccagagccgtgttcgccagcttcctgtggcacgagggcatcgtgcacgacgccatggcctgcagcagcttcctgaagttccaccccgagctgagcaaggagcacgcccccatcagaagcagcctgaacagccagcagcccaccgaggagaaggagaccaagctgaagaacagacacagcctggagatcagcagcgccctgaacatgttcaacatcgccccccacggccccgacatcagcaagatgggcagcatcaacaagaacaaggtgctgagcatgctgaaggagccccccctgcacgagaagtgcgaggacggcaagaccgagaccaccttcgagatgagcatgcacaacaccatgaagagcaagagccccctgcccctgaccctgcagcacctggtggccttctgggaggacatcagcctggccaccatcaaggccgccagccagaacatgatcttccccagccccggcagctgcgccgtgctgaagaagaaggagtgcgagaaggagaacaagaagagcaagaaggagaagaagaagaaggagaaggccgaggtgagacccagaggcaacctgttcggcgagatggcccagctggccgtgggcggccccgagaaggacaccatctgcgagctgtgcggcgagagccacccctaccccgtgacctaccacatgagacaggcccaccccggctgcggcagatacgccggcggccagggctacaacagcatcggccacttctgcggcggctgggccggcaactgcggcgacggcggcatcggcggcagcacctggtacctggtgtgcgacagatgcagagagaagtacctgagagagaagcaggccgccgccagagagaaggtgaagcagagcagaagaaagcccatgcaggtgaagacccccagagccctgcccaccatggaggcccaccaggtgatcaaggccaacgccctgttcctgctgagcctgagcagcgccgccgagcccagcatcctgtgctaccaccccgccaagcccttccagagccagctgcccagcgtgaaggagggcatcagcgaggacctgcccgtgaagatgccctgcctgtacctgcagaccctggccagacaccaccacgagaacttcgtgggctaccaggacgacaacctgttccaggacgagatgagatacctgagaagcaccagcgtgcccgccccctacatcagcgtgacccccgacgccagccccaacgtgttcgaggagcccgagagcaacatgaagagcatgccccccagcctggagaccagccccatcaccgacaccgacctggccaagagaaccgtgttccagagaagctacagcgtggtggccagcgagtacgacaagcagcacagcatcctgcccgccagagtgaaggccatccccagaagaagagtgaacagcggcgacaccgaggtgggcagcagcctgctgagacaccccagccccgagctgagcagactgatcagcgcccacagcagcctgagcaagggcgagagaaacttccagtggcccgtgctggccttcgtgatccagcaccacgacctggagggcctggagatcgccatgaagcaggccctgagaaagagcgcctgcagagtgttcgccatggaggccttcaactggctgctgtgcaacgtgatccagaccaccagcctgcacgacatcctgtggcacttcgtggccagcctgacccccgcccccgtggagcccgaggaggaggaggacgaggagaacaagaccagcaaggagaacagcgagcaggagaaggacaccagagtgtgcgagcaccccctgagcgacatcgtgatcgccggcgaggccgcccaccccctgccccacaccttccacagactgctgcagaccatcagcgacctgatgatgagcctgcccagcggcagcagcctgcagcagatggccctgagatgctggagcctgaagttcaagcagagcgaccaccagttcctgcaccagagcaacgtgttccaccacatcaacaacatcctgagcaagagcgacgacggcgacagcgaggagagcttcagcatcagcatccagagcggcttcgaggccatgagccaggagctgtgcatcgtgatgtgcctgaaggacctgaccagcatcgtggacatcaagaccagcagcagacccgccatgatcggcagcctgaccgacggcagcaccgagaccttctgggagagcggcgacgaggacaagaacaagaccaagaacatcaccatcaactgcgtgaagggcatcaacgccagatacgtgagcgtgcacgtggacaacagcagagacctgggcaacaaggtgaccagcatgaccttcctgaccggcaaggccgtggaggacctgtgcagaatcaagcaggtggacctggacagcagacacatcggctgggtgaccagcgagctgcccggcggcgacaaccacatcatcaagatcgagctgaagggccccgagaacaccctgagagtgagacaggtgaaggtgctgggctggaaggacggcgagagcaccaagatcgccggccagatcagcgccagcgtggcccagcagagaaactgcgaggccgagaccctgagagtgttcagactgatcaccagccaggtgttcggcaagctgatcagcggcgacgccgagcccacccccgagcaggaggagaaggccctgctgagcagccccgagggcgaggagaaggtgtacaacgccaccagcgacgccgacctgaaggagcacatggtgggcatcatcttcagcagaagcaagctgaccaacctgcagaagcaggtgtgcgcccacatcgtgcaggccatcagaatggaggccaccagagtgagagaggagtgggagcacgccatcagcagcaaggagaacgccaacagccagcccaacgacgaggacgccagcagcgacgcctactgcttcgagctgctgagcatggtgctggccctgagcggcagcaacgtgggcagacagtacctggcccagcagctgaccctgctgcaggacctgttcagcctgctgcacaccgccagccccagagtgcagagacaggtgaccagcctgctgagaagagtgctgcccgaggtgacccccagcagactggccagcatcatcggcgtgaagagcctgccccccgccgacatcagcgacatcatccacagcaccgagaagggcgactggaacaagctgggcatcctggacatgttcctgggctgcatcgccaaggccctgaccgtgcagctgaaggccaagggcaccaccatcaccggcaccgccggcaccaccgtgggcaagggcgtgaccaccgtgaccctgcccatgatcttcaacagcagctacctgagaagaggcgagagccactggtggatgaagggcagcacccccacccagatcagcgagatcatcatcaagctgatcaaggacatggccgccggccacctgagcgaggcctggagcagagtgaccaagaacgccatcgccgagaccatcatcgccctgaccaagatggaggaggagttcagaagccccgtgagatgcatcgccaccaccagactgtggctggccctggccagcctgtgcgtgctggaccaggaccacgtggacagactgagcagcggcagatggatgggcaaggacggccagcagaagcagatgcccatgtgcgacaaccacgacgacggcgagaccgccgccatcatcctgtgcaacgtgtgcggcaacctgtgcaccgactgcgacagattcctgcacctgcacagaagaaccaagacccaccagagacaggtgttcaaggaggaggaggaggccatcaaggtggacctgcacgagggctgcggcagaaccaagctgttctggctgatggccctggccgacagcaagaccatgaaggccatggtggagttcagagagcacaccggcaagcccaccaccagcagcagcgaggcctgcagattctgcggcagcagaagcggcaccgagctgagcgccgtgggcagcgtgtgcagcgacgccgactgccaggagtacgccaagatcgcctgcagcaagacccacccctgcggccacccctgcggcggcgtgaagaacgaggagcactgcctgccctgcctgcacggctgcgacaagagcgccaccagcctgaagcaggacgccgacgacatgtgcatgatctgcttcaccgaggccctgagcgccgcccccgccatccagctggactgcagccacatcttccacctgcagtgctgcagaagagtgctggagaacagatggctgggccccagaatcaccttcggcttcatcagctgccccatctgcaagaacaagatcaaccacatcgtgctgaaggacctgctggaccccatcaaggagctgtacgaggacgtgagaagaaaggccctgatgagactggagtacgagggcctgcacaagagcgaggccatcaccacccccggcgtgagattctacaacgaccccgccggctacgccatgaacagatacgcctactacgtgtgctacaagtgcagaaaggcctacttcggcggcgaggccagatgcgacgccgaggccggcagaggcgacgactacgaccccagagagctgatctgcggcgcctgcagcgacgtgagcagagcccagatgtgccccaagcacggcaccgacttcctggagtacaagtgcagatactgctgcagcgtggccgtgttcttctgcttcggcaccacccacttctgcaacgcctgccacgacgacttccagagaatgaccagcatccccaaggaggagctgccccactgccccgccggccccaagggcaagcagctggagggcaccgagtgccccctgcacgtggtgcacccccccaccggcgaggagttcgccctgggctgcggcgtgtgcagaaacgcccacaccttctag

SEQ ID NO: 11691 - DNA, 13923 bp, Artificial Sequence; identical to SEQ ID NO: 11688
  Description of Artificial Sequence: Synthetic coding sequence

SEQ ID NO: 11692 - DNA, 930 bp, Artificial Sequence
  Description of Artificial Sequence: Synthetic coding sequence
atgagacccgacagagccgaggcccccggcccccccgccatggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcagactgctggacgcctggcagggcagacccggcgccagcgtgggcagactgctggagctgctgaccaagctgggcagagacgacgtgctgctggagctgggccccagcatcgaggaggactgccagaagtacatcctgaagcagcagcaggaggaggccgagaagcccctgcaggtggccgccgtggacagcagcgtgcccagaaccgccgagctggccggcatcaccaccctggacgaccccctgggccacatgcccgagagattcgacgccttcatctgctactgccccagcgacatccagttcgtgcaggagatgatcagacagctggagcagaccaactacagactgaagctgtgcgtgagcgacagagacgtgctgcccggcacctgcgtgtggagcatcgccagcgagctgatcgagaagagatgcagaagaatggtggtggtggtgagcgacgactacctgcagagcaaggagtgcgacttccagaccaagttcgccctgagcctgagccccggcgcccaccagaagagactgatccccatcaagtacaaggccatgaagaaggagttccccagcatcctgagattcatcaccgtgtgcgactacaccaacccctgcaccaagagctggttctggaccagactggccaaggccctgagcctgccctag

SEQ ID NO: 11693 - DNA, 858 bp, Artificial Sequence
  Description of Artificial Sequence: Synthetic coding sequence
atggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcgccagcgtgggcagactgctggagctgctgaccaagctgggcagagacgacgtgctgctggagctgggccccagcatcgaggaggactgccagaagtacatcctgaagcagcagcaggaggaggccgagaagcccctgcaggtggccgccgtggacagcagcgtgcccagaaccgccgagctggccggcatcaccaccctggacgaccccctgggccacatgcccgagagattcgacgccttcatctgctactgccccagcgacatccagttcgtgcaggagatgatcagacagctggagcagaccaactacagactgaagctgtgcgtgagcgacagagacgtgctgcccggcacctgcgtgtggagcatcgccagcgagctgatcgagaagagatgcagaagaatggtggtggtggtgagcgacgactacctgcagagcaaggagtgcgacttccagaccaagttcgccctgagcctgagccccggcgcccaccagaagagactgatccccatcaagtacaaggccatgaagaaggagttccccagcatcctgagattcatcaccgtgtgcgactacaccaacccctgcaccaagagctggttctggaccagactggccaaggccctgagcctgccctag

SEQ ID NO: 11694 - DNA, 954 bp, Artificial Sequence
  Description of Artificial Sequence: Synthetic coding sequence
atgagacccgacagagccgaggcccccggcccccccgccatggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcagactgctggacgcctggcagggcagacccggcgccagcgtgggcagactgctggagctgctgaccaagctgggcagagacgacgtgctgctggagctgggccccagcatcgaggaggactgccagaagtacatcctgaagcagcagcaggaggaggccgagaagcccctgcaggtggccgccgtggacagcagcgtgcccagaaccgccgagctggccggcatcaccaccctggacgaccccctgggccacatgcccgagagattcgacgccttcatctgctactgccccagcgacatccagttcgtgcaggagatgatcagacagctggagcagaccaactacagactgaagctgtgcgtgagcgacagagacgtgctgcccggcacctgcgtgtggagcatcgccagcgagctgatcgagaagagactggccagaagacccagaggcggctgcagaagaatggtggtggtggtgagcgacgactacctgcagagcaaggagtgcgacttccagaccaagttcgccctgagcctgagccccggcgcccaccagaagagactgatccccatcaagtacaaggccatgaagaaggagttccccagcatcctgagattcatcaccgtgtgcgactacaccaacccctgcaccaagagctggttctggaccagactggccaaggccctgagcctgccctag

SEQ ID NO: 11695 - DNA, 510 bp, Artificial Sequence
  Description of Artificial Sequence: Synthetic coding sequence
atggccgccggcggccccggcgccggcagcgccgcccccgtgagcagcaccagcagcctgcccctggccgccctgaacatgagagtgagaagaagactgagcctgttcctgaacgtgagaacccaggtggccgccgactggaccgccctggccgaggagatggacttcgagtacctggagatcagacagctggagacccaggccgaccccaccggcagactgctggacgcctggcagggcagacccggcgccagcgtgggcagactgctggagctgctgaccaagctgggcagagacgacgtgctgctggagctgggccccagcatcgaggaggactgccagaagtacatcctgaagcagcagcaggaggaggccgagaagcccctgcaggtggccgccgtggacagcagcgtgcccccccacctgatgaccccctggggcatctgcctgagcgtgagcatgcccagcagcgccatcgcccccgccaccagcagcctgtgcagaagatag

SEQ ID NO: 11696 - DNA, 963 bp, Artificial Sequence
  Description of Artificial Sequence: Synthetic coding sequence
atggagctgctgagcccccccctgagagacgtggacctgaccgcccccgacggcagcctgtgcagcttcgccaccaccgacgacttctacgacgacccctgcttcgacagccccgacctgagattcttcgaggacctggaccccagactgatgcacgtgggcgccctgctgaagcccgaggagcacagccacttccccgccgccgtgcaccccgcccccggcgccagagaggacgagcacgtgagagcccccagcggccaccaccaggccggcagatgcctgctgtgggcctgcaaggcctgcaagagaaagaccaccaacgccgacagaagaaaggccgccaccatgagagagagaagaagactgagcaaggtgaacgaggccttcgagaccctgaagagatgcaccagcagcaaccccaaccagagactgcccaaggtggagatcctgagaaacgccatcagatacatcgagggcctgcaggccctgctgagagaccaggacgccgccccccccggcgccgccgccgccttctacgcccccggccccctgccccccggcagaggcggcgagcactacagcggcgacagcgacgccagcagccccagaagcaactgcagcgacggcatgatggactacagcggcccccccagcggcgccagaagaagaaactgctacgagggcgcctactacaacgaggcccccagcgagcccagacccggcaagagcgccgccgtgagcagcctggactgcctgagcagcatcgtggagagaatcagcaccgagagccccgccgcccccgccctgctgctggccgacgtgcccagcgagagcccccccagaagacaggaggccgccgcccccagcgagggcgagagcagcggcgaccccacccagagccccgacgccgccccccagtgccccgccggcgccaaccccaaccccatctaccaggtgctgtag

SEQ ID NO: 11697 - DNA, 5538 bp, Artificial Sequence
  Description of Artificial Sequence: Synthetic coding sequence
atgggcgacgtgaagctggtggccagcagccacatcagcaagaccagcctgagcgtggaccccagcagagtggacagcatgcccctgaccgaggcccccgccttcatcctgccccccagaaacctgtgcatcaaggagggcgccaccgccaagttcgagggcagagtgagaggctaccccgagccccaggtgacctggcacagaaacggccagcccatcaccagcggcggcagattcctgctggactgcggcatcagaggcaccttcagcctggtgatccacgccgtgcacgaggaggacagaggcaagtacacctgcgaggccaccaacggcagcggcgccagacaggtgaccgtggagctgaccgtggagggcagcttcgccaagcagctgggccagcccgtggtgagcaagaccctgggcgacagattcagcgcccccgccgtggagaccagacccagcatctggggcgagtgcccccccaagttcgccaccaagctgggcagagtggtggtgaaggagggccagatgggcagattcagctgcaagatcaccggcagaccccagccccaggtgacctggctgaagggcaacgtgcccctgcagcccagcgccagagtgagcgtgagcgagaagaacggcatgcaggtgctggagatccacggcgtgaaccaggacgacgtgggcgtgtacacctgcctggtggtgaacggcagcggcaaggccagcatgagcgccgagctgagcatccagggcctggacagcgccaacagaagcttcgtgagagagaccaaggccaccaacagcgacgtgagaaaggaggtgaccaacgtgatcagcaaggagagcaagctggacagcctggaggccgccgccaagagcaagaactgcagcagcccccagagaggcggcagccccccctgggccgccaacagccagccccagccccccagagagagcaagctggagagctgcaaggacagccccagaaccgccccccagacccccgtgctgcagaagaccagcagcagcatcaccctgcaggccgccagagtgcagcccgagcccagagcccccggcctgggcgtgctgagccccagcggcgaggagagaaagagacccgccccccccagacccgccaccttccccaccagacagcccggcctgggcagccaggacgtggtgagcaaggccgccaacagaagaatccccatggagggccagagagacagcgccttccccaagttcgagagcaagccccagagccaggaggtgaaggagaaccagaccgtgaagttcagatgcgagggcctggccgtgatggaggtggcccccagcttcagcagcgtgctgaaggactgcgccgtgatcgagggccaggacttcgtgctgcagtgcagcgtgagaggcacccccgtgcccagaatcacctggctgctgaacggccagcccatccagtacgccagaagcacctgcgaggccggcgtggccgagctgcacatccaggacgccctgcccgaggaccacggcacctacacctgcctggccgagaacgccctgggccaggtgagctgcagcgcctgggtgaccgtgcacgagaagaagagcagcagaaagagcgagtacctgctgcccgtggcccccagcaagcccaccgcccccatcttcctgcagggcctgagcgacctgaaggtgatggacggcagccaggtgaccatgaccgtgcaggtgagcggcaaccccccccccgaggtgatctggctgcacaacggcaacgagatccaggagagcgaggacttccacttcgagcagagaggcacccagcacagcctgtgcatccaggaggtgttccccgaggacaccggcacctacacctgcgaggcctggaacagcgccggcgaggtgagaacccaggccgtgctgaccgtgcaggagccccacgacggcacccagccctggttcatcagcaagcccagaagcgtgaccgccagcctgggccagagcgtgctgatcagctgcgccatcgccggcgaccccttccccaccgtgcactggctgagagacggcaaggccctgtgcaaggacaccggccacttcgaggtgctgcagaacgaggacgtgttcaccctggtgctgaagaaggtgcagccctggcacgccggccagtacgagatcctgctgaagaacagagtgggcgagtgcagctgccaggtgagcctgatgctgcagaacagcagcgccagagccctgcccagaggcagagagcccgccagctgcgaggacctgtgcggcggcggcgtgggcgccgacggcggcggcagcgacagatacggcagcctgagacccggctggcccgccagaggccagggctggctggaggaggaggacggcgaggacgtgagaggcgtgctgaagagaagagtggagaccagacagcacaccgaggaggccatcagacagcaggaggtggagcagctggacttcagagacctgctgggcaagaaggtgagcaccaagaccctgagcgaggacgacctgaaggagatccccgccgagcagatggacttcagagccaacctgcagagacaggtgaagcccaagaccgtgagcgaggaggagagaaaggtgcacagcccccagcaggtggacttcagaagcgtgctggccaagaagggcaccagcaagacccccgtgcccgagaaggtgcccccccccaagcccgccacccccgacttcagaagcgtgctgggcggcaagaagaagctgcccgccgagaacggcagcagcagcgccgagaccctgaacgccaaggccgtggagagcagcaagcccctgagcaacgcccagcccagcggccccctgaagcccgtgggcaacgccaagcccgccgagaccctgaagcccatgggcaacgccaagcccgccgagaccctgaagcccatgggcaacgccaagcccgacgagaacctgaagagcgccagcaaggaggagctgaagaaggacgtgaagaacgacgtgaactgcaagagaggccacgccggcaccaccgacaacgagaagagaagcgagagccagggcaccgcccccgccttcaagcagaagctgcaggacgtgcacgtggccgagggcaagaagctgctgctgcagtgccaggtgagcagcgacccccccgccaccatcatctggaccctgaacggcaagaccctgaagaccaccaagttcatcatcctgagccaggagggcagcctgtgcagcgtgagcatcgagaaggccctgcccgaggacagaggcctgtacaagtgcgtggccaagaacgacgccggccaggccgagtgcagctgccaggtgaccgtggacgacgcccccgccagcgagaacaccaaggcccccgagatgaagagcagaagacccaagagcagcctgccccccgtgctgggcaccgagagcgacgccaccgtgaagaagaagcccgcccccaagaccccccccaaggccgccatgcccccccagatcatccagttccccgaggaccagaaggtgagagccggcgagagcgtggagctgttcggcaaggtgaccggcacccagcccatcacctgcacctggatgaagttcagaaagcagatccaggagagcgagcacatgaaggtggagaacagcgagaacggcagcaagctgaccatcctggccgccagacaggagcactgcggctgctacaccctgctggtggagaacaagctgggcagcagacaggcccaggtgaacctgaccgtggtggacaagcccgacccccccgccggcaccccctgcgccagcgacatcagaagcagcagcctgaccctgagctggtacggcagcagctacgacggcggcagcgccgtgcagagctacagcatcgagatctgggacagcgccaacaagacctggaaggagctggccacctgcagaagcaccagcttcaacgtgcaggacctgctgcccgaccacgagtacaagttcagagtgagagccatcaacgtgtacggcaccagcgagcccagccaggagagcgagctgaccaccgtgggcgagaagcccgaggagcccaaggacgaggtggaggtgagcgacgacgacgagaaggagcccgaggtggactacagaaccgtgaccatcaacaccgagcagaaggtgagcgacttctacgacatcgaggagagactgggcagcggcaagttcggccaggtgttcagactggtggagaagaagaccagaaaggtgtgggccggcaagttcttcaaggcctacagcgccaaggagaaggagaacatcagacaggagatcagcatcatgaactgcctgcaccaccccaagctggtgcagtgcgtggacgccttcgaggagaaggccaacatcgtgatggtgctggagatcgtgagcggcggcgagctgttcgagagaatcatcgacgaggacttcgagctgaccgagagagagtgcatcaagtacatgagacagatcagcgagggcgtggagtacatccacaagcagggcatcgtgcacctggacctgaagcccgagaacatcatgtgcgtgaacaagaccggcaccagaatcaagctgatcgacttcggcctggccagaagactggagaacgccggcagcctgaaggtgctgttcggcacccccgagttcgtggcccccgaggtgatcaactacgagcccatcggctacgccaccgacatgtggagcatcggcgtgatctgctacatcctggtgagcggcctgagccccttcatgggcgacaacgacaacgagaccctggccaacgtgaccagcgccacctgggacttcgacgacgaggccttcgacgagatcagcgacgacgccaaggacttcatcagcaacctgctgaagaaggacatgaagaacagactggactgcacccagtgcctgcagcacccctggctgatgaaggacaccaagaacatggaggccaagaagctgagcaaggacagaatgaagaagtacatggccagaagaaagtggcagaagaccggcaacgccgtgagagccatcggcagactgagcagcatggccatgatcagcggcctgagcggcagaaagagcagcaccggcagccccaccagccccctgaacgccgagaagctggagagcgaggaggacgtgagccaggccttcctggaggccgtggccgaggagaagccccacgtgaagccctacttcagcaagaccatcagagacctggaggtggtggagggcagcgccgccagattcgactgcaagatcgagggctaccccgaccccgaggtggtgtggttcaaggacgaccagagcatcagagagagcagacacttccagatcgactacgacgaggacggcaactgcagcctgatcatcagcgacgtgtgcggcgacgacgacgccaagtacacctgcaaggccgtgaacagcctgggcgaggccacctgcaccgccgagctgatcgtggagaccatggaggagggcgagggcgagggcgaggaggaggaggagtag

SEQ ID NO: 11698 - DNA, 2145 bp, Artificial Sequence
  Description of Artificial Sequence: Synthetic coding sequence
atgaagagcagaagacccaagagcagcctgccccccgtgctgggcaccgagagcgacgccaccgtgaagaagaagcccgcccccaagaccccccccaaggccgccatgcccccccagatcatccagttccccgaggaccagaaggtgagagccggcgagagcgtggagctgttcggcaaggtgaccggcacccagcccatcacctgcacctggatgaagttcagaaagcagatccaggagagcgagcacatgaaggtggagaacagcgagaacggcagcaagctgaccatcctggccgccagacaggagcactgcggctgctacaccctgctggtggagaacaagctgggcagcagacaggcccaggtgaacctgaccgtggtggacaagcccgacccccccgccggcaccccctgcgccagcgacatcagaagcagcagcctgaccctgagctggtacggcagcagctacgacggcggcagcgccgtgcagagctacagcatcgagatctgggacagcgccaacaagacctggaaggagctggccacctgcagaagcaccagcttcaacgtgcaggacctgctgcccgaccacgagtacaagttcagagtgagagccatcaacgtgtacggcaccagcgagcccagccaggagagcgagctgaccaccgtgggcgagaagcccgaggagcccaaggacgaggtggaggtgagcgacgacgacgagaaggagcccgaggtggactacagaaccgtgaccatcaacaccgagcagaaggtgagcgacttctacgacatcgaggagagactgggcagcggcaagttcggccaggtgttcagactggtggagaagaagaccagaaaggtgtgggccggcaagttcttcaaggcctacagcgccaaggagaaggagaacatcagacaggagatcagcatcatgaactgcctgcaccaccccaagctggtgcagtgcgtggacgccttcgaggagaaggccaacatcgtgatggtgctggagatcgtgagcggcggcgagctgttcgagagaatcatcgacgaggacttcgagctgaccgagagagagtgcatcaagtacatgagacagatcagcgagggcgtggagtacatccacaagcagggcatcgtgcacctggacctgaagcccgagaacatcatgtgcgtgaacaagaccggcaccagaatcaagctgatcgacttcggcctggccagaagactggagaacgccggcagcctgaaggtgctgttcggcacccccgagttcgtggcccccgaggtgatcaactacgagcccatcggctacgccaccgacatgtggagcatcggcgtgatctgctacatcctggtgagcggcctgagccccttcatgggcgacaacgacaacgagaccctggccaacgtgaccagcgccacctgggacttcgacgacgaggccttcgacgagatcagcgacgacgccaaggacttcatcagcaacctgctgaagaaggacatgaagaacagactggactgcacccagtgcctgcagcacccctggctgatgaaggacaccaagaacatggaggccaagaagctgagcaaggacagaatgaagaagtacatggccagaagaaagtggcagaagaccggcaacgccgtgagagccatcggcagactgagcagcatggccatgatcagcggcctgagcggcagaaagagcagcaccggcagccccaccagccccctgaacgccgagaagctggagagcgaggaggacgtgagccaggccttcctggaggccgtggccgaggagaagccccacgtgaagccctacttcagcaagaccatcagagacctggaggtggtggagggcagcgccgccagattcgactgcaagatcgagggctaccccgaccccgaggtggtgtggttcaaggacgaccagagcatcagagagagcagacacttccagatcgactacgacgaggacggcaactgcagcctgatcatcagcgacgtgtgcggcgacgacgacgccaagtacacctgcaaggccgtgaacagcctgggcgaggccacctgcaccgccgagctgatcgtggagaccatggaggagggcgagggcgagggcgaggaggaggaggagtag

SEQ ID NO: 11699 - DNA, 5592 bp, Artificial Sequence
  Description of Artificial Sequence: Synthetic coding sequence
atgggcgacgtgaagctggtggccagcagccacatcagcaagaccagcctgagcgtggaccccagcagagtggacagcatgcccctgaccgaggcccccgccttcatcctgccccccagaaacctgtgcatcaaggagggcgccaccgccaagttcgagggcagagtgagaggctaccccgagccccaggtgacctggcacagaaacggccagcccatcaccagcggcggcagattcctgctggactgcggcatcagaggcaccttcagcctggtgatccacgccgtgcacgaggaggacagaggcaagtacacctgcgaggccaccaacggcagcggcgccagacaggtgaccgtggagctgaccgtggagggcagcttcgccaagcagctgggccagcccgtggtgagcaagaccctgggcgacagattcagcgcccccgccgtggagaccagacccagcatctggggcgagtgcccccccaagttcgccaccaagctgggcagagtggtggtgaaggagggccagatgggcagattcagctgcaagatcaccggcagaccccagccccaggtgacctggctgaagggcaacgtgcccctgcagcccagcgccagagtgagcgtgagcgagaagaacggcatgcaggtgctggagatccacggcgtgaaccaggacgacgtgggcgtgtacacctgcctggtggtgaacggcagcggcaaggccagcatgagcgccgagctgagcatccagggcctggacagcgccaacagaagcttcgtgagagagaccaaggccaccaacagcgacgtgagaaaggaggtgaccaacgtgatcagcaaggagagcaagctggacagcctggaggccgccgccaagagcaagaactgcagcagcccccagagaggcggcagccccccctgggccgccaacagccagccccagccccccagagagagcaagctggagagctgcaaggacagccccagaaccgccccccagacccccgtgctgcagaagaccagcagcagcatcaccctgcaggccgccagagtgcagcccgagcccagagcccccggcctgggcgtgctgagccccagcggcgaggagagaaagagacccgccccccccagacccgccaccttccccaccagacagcccggcctgggcagccaggacgtggtgagcaaggccgccaacagaagaatccccatggagggccagagagacagcgccttccccaagttcgagagcaagccccagagccaggaggtgaaggagaaccagaccgtgaagttcagatgcgaggtgagcggcatccccaagcccgaggtggcctggttcctggagggcacccccgtgagaagacaggagggcagcatcgaggtgtacgaggacgccggcagccactacctgtgcctgctgaaggccagaaccagagacagcggcacctacagctgcaccgccagcaacgcccagggccagctgagctgcagctggaccctgcaggtggagagactggccgtgatggaggtggcccccagcttcagcagcgtgctgaaggactgcgccgtgatcgagggccaggacttcgtgctgcagtgcagcgtgagaggcacccccgtgcccagaatcacctggctgctgaacggccagcccatccagtacgccagaagcacctgcgaggccggcgtggccgagctgcacatccaggacgccctgcccgaggaccacggcacctacacctgcctggccgagaacgccctgggccaggtgagctgcagcgcctgggtgaccgtgcacgagaagaagagcagcagaaagagcgagtacctgctgcccgtggcccccagcaagcccaccgcccccatcttcctgcagggcctgagcgacctgaaggtgatggacggcagccaggtgaccatgaccgtgcaggtgagcggcaaccccccccccgaggtgatctggctgcacaacggcaacgagatccaggagagcgaggacttccacttcgagcagagaggcacccagcacagcctgtgcatccaggaggtgttccccgaggacaccggcacctacacctgcgaggcctggaacagcgccggcgaggtgagaacccaggccgtgctgaccgtgcaggagccccacgacggcacccagccctggttcatcagcaagcccagaagcgtgaccgccagcctgggccagagcgtgctgatcagctgcgccatcgccggcgaccccttccccaccgtgcactggctgagagacggcaaggccctgtgcaaggacaccggccacttcgaggtgctgcagaacgaggacgtgttcaccctggtgctgaagaaggtgcagccctggcacgccggccagtacgagatcctgctgaagaacagagtgggcgagtgcagctgccaggtgagcctgatgctgcagaacagcagcgccagagccctgcccagaggcagagagcccgccagctgcgaggacctgtgcggcggcggcgtgggcgccgacggcggcggcagcgacagatacggcagcctgagacccggctggcccgccagaggccagggctggctggaggaggaggacggcgaggacgtgagaggcgtgctgaagagaagagtggagaccagacagcacaccgaggaggccatcagacagcaggaggtggagcagctggacttcagagacctgctgggcaagaaggtgagcaccaagaccctgagcgaggacgacctgaaggagatccccgccgagcagatggacttcagagccaacctgcagagacaggtgaagcccaagaccgtgagcgaggaggagagaaaggtgcacagcccccagcaggtggacttcagaagcgtgctggccaagaagggcaccagcaagacccccgtgcccgagaaggtgcccccccccaagcccgccacccccgacttcagaagcgtgctgggcggcaagaagaagctgcccgccgagaacggcagcagcagcgccgagaccctgaacgccaaggccgtggagagcagcaagcccctgagcaacgcccagcccagcggccccctgaagcccgtgggcaacgccaagcccgccgagaccctgaagcccatgggcaacgccaagcccgccgagaccctgaagcccatgggcaacgccaagcccgacgagaacctgaagagcgccagcaaggaggagctgaagaaggacgtgaagaacgacgtgaactgcaagagaggccacgccggcaccaccgacaacgagaagagaagcgagagccagggcaccgcccccgccttcaagcagaagctgcaggacgtgcacgtggccgagggcaagaagctgctgctgcagtgccaggtgagcagcgacccccccgccaccatcatctggaccctgaacggcaagaccctgaagaccaccaagttcatcatcctgagccaggagggcagcctgtgcagcgtgagcatcgagaaggccctgcccgaggacagaggcctgtacaagtgcgtggccaagaacgacgccggccaggccgagtgcagctgccaggtgaccgtggacgacgcccccgccagcgagaacaccaaggcccccgagatgaagagcagaagacccaagagcagcctgccccccgtgctgggcaccgagagcgacgccaccgtgaagaagaagcccgcccccaagaccccccccaaggccgccatgcccccccagatcatccagttccccgaggaccagaaggtgagagccggcgagagcgtggagctgttcggcaaggtgaccggcacccagcccatcacctgcacctggatgaagttcagaaagcagatccaggagagcgagcacatgaaggtggagaacagcgagaacggcagcaagctgaccatcctggccgccagacaggagcactgcggctgctacaccctgctggtggagaacaagctgggcagcagacaggcccaggtgaacctgaccgtggtggacaagcccgacccccccgccggcaccccctgcgccagcgacatcagaagcagcagcctgaccctgagctggtacggcagcagctacgacggcggcagcgccgtgcagagctacagcatcgagatctgggacagcgccaacaagacctggaaggagctggccacctgcagaagcaccagcttcaacgtgcaggacctgctgcccgaccacgagtacaagttcagagtgagagccatcaacgtgtacggcaccagcgagcccagccaggagagcgagctgaccaccgtgggcgagaagcccgaggagcccaaggacgaggtggaggtgagcgacgacgacgagaaggagcccgaggtggactacagaaccgtgaccatcaacaccgagcagaaggtgagcgacttctacgacatcgaggagagactgggcagcggcaagttcggccaggtgttcagactggtggagaagaagaccagaaaggtgtgggccggcaagttcttcaaggcctacagcgccaaggagaaggagaacatcagacaggagatcagcatcatgaactgcctgcaccaccccaagctggtgcagtgcgtggacgccttcgaggagaaggccaacatcgtgatggtgctggagatcgtgagcggcggcgagctgttcgagagaatcatcgacgaggacttcgagctgaccgagagagagtgcatcaagtacatgagacagatcagcgagggcgtggagtacatccacaagcagggcatcgtgcacctggacctgaagcccgagaacatcatgtgcgtgaacaagaccggcaccagaatcaagctgatcgacttcggcctggccagaagactggagaacgccggcagcctgaaggtgctgttcggcacccccgagttcgtggcccccgaggtgatcaactacgagcccatcggctacgccaccgacatgtggagcatcggcgtgatctgctacatcctgaacagactggactgcacccagtgcctgcagcacccctggctgatgaaggacaccaagaacatggaggccaagaagctgagcaaggacagaatgaagaagtacatggccagaagaaagtggcagaagaccggcaacgccgtgagagccatcggcagactgagcagcatggccatgatcagcggcctgagcggcagaaagagcagcaccggcagccccaccagccccctgaacgccgagaagctggagagcgaggaggacgtgagccaggccttcctggaggccgtggccgaggagaagccccacgtgaagccctacttcagcaagaccatcagagacctggaggtggtggagggcagcgccgccagattcgactgcaagatcgagggctaccccgaccccgaggtggtgtggttcaaggacgaccagagcatcagagagagcagacacttccagatcgactacgacgaggacggcaactgcagcctgatcatcagcgacgtgtgcggcgacgacgacgccaagtacacctgcaaggccgtgaacagcctgggcgaggccacctgcaccgccgagctgatcgtggagaccatggaggagggcgagggcgagggcgaggaggaggaggagtag

SEQ ID NO: 11700 - DNA, 5745 bp, Artificial Sequence
  Description of Artificial Sequence: Synthetic coding sequence
atgggcgacgtgaagctggtggccagcagccacatcagcaagaccagcctgagcgtggaccccagcagagtggacagcatgcccctgaccgaggcccccgccttcatcctgccccccagaaacctgtgcatcaaggagggcgccaccgccaagttcgagggcagagtgagaggctaccccgagccccaggtgacctggcacagaaacggccagcccatcaccagcggcggcagattcctgctggactgcggcatcagaggcaccttcagcctggtgatccacgccgtgcacgaggaggacagaggcaagtacacctgcgaggccaccaacggcagcggcgccagacaggtgaccgtggagctgaccgtggagggcagcttcgccaagcagctgggccagcccgtggtgagcaagaccctgggcgacagattcagcgcccccgccgtggagaccagacccagcatctggggcgagtgcccccccaagttcgccaccaagctgggcagagtggtggtgaaggagggccagatgggcagattcagctgcaagatcaccggcagaccccagccccaggtgacctggctgaagggcaacgtgcccctgcagcccagcgccagagtgagcgtgagcgagaagaacggcatgcaggtgctggagatccacggcgtgaaccaggacgacgtgggcgtgtacacctgcctggtggtgaacggcagcggcaaggccagcatgagcgccgagctgagcatccagggcctggacagcgccaacagaagcttcgtgagagagaccaaggccaccaacagcgacgtgagaaaggaggtgaccaacgtgatcagcaaggagagcaagctggacagcctggaggccgccgccaagagcaagaactgcagcagcccccagagaggcggcagccccccctgggccgccaacagccagccccagccccccagagagagcaagctggagagctgcaaggacagccccagaaccgccccccagacccccgtgctgcagaagaccagcagcagcatcaccctgcaggccgccagagtgcagcccgagcccagagcccccggcctgggcgtgctgagccccagcggcgaggagagaaagagacccgccccccccagacccgccaccttccccaccagacagcccggcctgggcagccaggacgtggtgagcaaggccgccaacagaagaatccccatggagggccagagagacagcgccttccccaagttcgagagcaagccccagagccaggaggtgaaggagaaccagaccgtgaagttcagatgcgaggtgagcggcatccccaagcccgaggtggcctggttcctggagggcacccccgtgagaagacaggagggcagcatcgaggtgtacgaggacgccggcagccactacctgtgcctgctgaaggccagaaccagagacagcggcacctacagctgcaccgccagcaacgcccagggccagctgagctgcagctggaccctgcaggtggagagactggccgtgatggaggtggcccccagcttcagcagcgtgctgaaggactgcgccgtgatcgagggccaggacttcgtgctgcagtgcagcgtgagaggcacccccgtgcccagaatcacctggctgctgaacggccagcccatccagtacgccagaagcacctgcgaggccggcgtggccgagctgcacatccaggacgccctgcccgaggaccacggcacctacacctgcctggccgagaacgccctgggccaggtgagctgcagcgcctgggtgaccgtgcacgagaagaagagcagcagaaagagcgagtacctgctgcccgtggcccccagcaagcccaccgcccccatcttcctgcagggcctgagcgacctgaaggtgatggacggcagccaggtgaccatgaccgtgcaggtgagcggcaaccccccccccgaggtgatctggctgcacaacggcaacgagatccaggagagcgaggacttccacttcgagcagagaggcacccagcacagcctgtgcatccaggaggtgttccccgaggacaccggcacctacacctgcgaggcctggaacagcgccggcgaggtgagaacccaggccgtgctgaccgtgcaggagccccacgacggcacccagccctggttcatcagcaagcccagaagcgtgaccgccagcctgggccagagcgtgctgatcagctgcgccatcgccggcgaccccttccccaccgtgcactggctgagagacggcaaggccctgtgcaaggacaccggccacttcgaggtgctgcagaacgaggacgtgttcaccctggtgctgaagaaggtgcagccctggcacgccggccagtacgagatcctgctgaagaacagagtgggcgagtgcagctgccaggtgagcctgatgctgcagaacagcagcgccagagccctgcccagaggcagagagcccgccagctgcgaggacctgtgcggcggcggcgtgggcgccgacggcggcggcagcgacagatacggcagcctgagacccggctggcccgccagaggccagggctggctggaggaggaggacggcgaggacgtgagaggcgtgctgaagagaagagtggagaccagacagcacaccgaggaggccatcagacagcaggaggtggagcagctggacttcagagacctgctgggcaagaaggtgagcaccaagaccctgagcgaggacgacctgaaggagatccccgccgagcagatggacttcagagccaacctgcagagacaggtgaagcccaagaccgtgagcgaggaggagagaaaggtgcacagcccccagcaggtggacttcagaagcgtgctggccaagaagggcaccagcaagacccccgtgcccgagaaggtgcccccccccaagcccgccacccccgacttcagaagcgtgctgggcggcaagaagaagctgcccgccgagaacggcagcagcagcgccgagaccctgaacgccaaggccgtggagagcagcaagcccctgagcaacgcccagcccagcggccccctgaagcccgtgggcaacgccaagcccgccgagaccctgaagcccatgggcaacgccaagcccgccgagaccctgaagcccatgggcaacgccaagcccgacgagaacctgaagagcgccagcaaggaggagctgaagaaggacgtgaagaacgacgtgaactgcaagagaggccacgccggcaccaccgacaacgagaagagaagcgagagccagggcaccgcccccgccttcaagcagaagctgcaggacgtgcacgtggccgagggcaagaagctgctgctgcagtgccaggtgagcagcgacccccccgccaccatcatctggaccctgaacggcaagaccctgaagaccaccaagttcatcatcctgagccaggagggcagcctgtgcagcgtgagcatcgagaaggccctgcccgaggacagaggcctgtacaagtgcgtggccaagaacgacgccggccaggccgagtgcagctgccaggtgaccgtggacgacgcccccgccagcgagaacaccaaggcccccgagatgaagagcagaagacccaagagcagcctgccccccgtgctgggcaccgagagcgacgccaccgtgaagaagaagcccgcccccaagaccccccccaaggccgccatgcccccccagatcatccagttccccgaggaccagaaggtgagagccggcgagagcgtggagctgttcggcaaggtgaccggcacccagcccatcacctgcacctggatgaagttcagaaagcagatccaggagagcgagcacatgaaggtggagaacagcgagaacggcagcaagctgaccatcctggccgccagacaggagcactgcggctgctacaccctgctggtggagaacaagctgggcagcagacaggcccaggtgaacctgaccgtggtggacaagcccgacccccccgccggcaccccctgcgccagcgacatcagaagcagcagcctgaccctgagctggtacggcagcagctacgacggcggcagcgccgtgcagagctacagcatcgagatctgggacagcgccaacaagacctggaaggagctggccacctgcagaagcaccagcttcaacgtgcaggacctgctgcccgaccacgagtacaagttcagagtgagagccatcaacgtgtacggcaccagcgagcccagccaggagagcgagctgaccaccgtgggcgagaagcccgaggagcccaaggacgaggtggaggtgagcgacgacgacgagaaggagcccgaggtggactacagaaccgtgaccatcaacaccgagcagaaggtgagcgacttctacgacatcgaggagagactgggcagcggcaagttcggccaggtgttcagactggtggagaagaagaccagaaaggtgtgggccggcaagttcttcaaggcctacagcgccaaggagaaggagaacatcagacaggagatcagcatcatgaactgcctgcaccaccccaagctggtgcagtgcgtggacgccttcgaggagaaggccaacatcgtgatggtgctggagatcgtgagcggcggcgagctgttcgagagaatcatcgacgaggacttcgagctgaccgagagagagtgcatcaagtacatgagacagatcagcgagggcgtggagtacatccacaagcagggcatcgtgcacctggacctgaagcccgagaacatcatgtgcgtgaacaagaccggcaccagaatcaagctgatcgacttcggcctggccagaagactggagaacgccggcagcctgaaggtgctgttcggcacccccgagttcgtggcccccgaggtgatcaactacgagcccatcggctacgccaccgacatgtggagcatcggcgtgatctgctacatcctggtgagcggcctgagccccttcatgggcgacaacgacaacgagaccctggccaacgtgaccagcgccacctgggacttcgacgacgaggccttcgacgagatcagcgacgacgccaaggacttcatcagcaacctgctgaagaaggacatgaagaacagactggactgcacccagtgcctgcagcacccctggctgatgaaggacaccaagaacatggaggccaagaagctgagcaaggacagaatgaagaagtacatggccagaagaaagtggcagaagaccggcaacgccgtgagagccatcggcagactgagcagcatggccatgatcagcggcctgagcggcagaaagagcagcaccggcagccccaccagccccctgaacgccgagaagctggagagcgaggaggacgtgagccaggccttcctggaggccgtggccgaggagaagccccacgtgaagccctacttcagcaagaccatcagagacctggaggtggtggagggcagcgccgccagattcgactgcaagatcgagggctaccccgaccccgaggtggtgtggttcaaggacgaccagagcatcagagagagcagacacttccagatcgactacgacgaggacggcaactgcagcctgatcatcagcgacgtgtgcggcgacgacgacgccaagtacacctgcaaggccgtgaacagcctgggcgaggccacctgcaccgccgagctgatcgtggagaccatggaggagggcgagggcgagggcgaggaggaggaggagtag

SEQ ID NO: 11701 - DNA, 231 bp, Artificial Sequence
  Description of Artificial Sequence: Synthetic coding sequence
atgggcgacgtgaagctggtggccagcagccacatcagcaagaccagcctgagcgtggaccccagcagagtggacagcatgcccctgaccgaggcccccgccttcatcctgccccccagaaacctgtgcatcaaggagggcgccaccgccaagttcgagggcagagtgagaggctaccccgagccccaggtgacctggcacagaaacggccagcccatcaccagcggctag

SEQ ID NO: 11702 - DNA, 5592 bp, Artificial Sequence; identical to SEQ ID NO: 11699
  Description of Artificial Sequence: Synthetic coding sequence

SEQ ID NO: 11703 - DNA, 465 bp, Artificial Sequence
  Description of Artificial Sequence: Synthetic coding sequence
atggccatgatcagcggcctgagcggcagaaagagcagcaccggcagccccaccagccccctgaacgccgagaagctggagagcgaggaggacgtgagccaggccttcctggaggccgtggccgaggagaagccccacgtgaagccctacttcagcaagaccatcagagacctggaggtggtggagggcagcgccgccagattcgactgcaagatcgagggctaccccgaccccgaggtggtgtggttcaaggacgaccagagcatcagagagagcagacacttccagatcgactacgacgaggacggcaactgcagcctgatcatcagcgacgtgtgcggcgacgacgacgccaagtacacctgcaaggccgtgaacagcctgggcgaggccacctgcaccgccgagctgatcgtggagaccatggaggagggcgagggcgagggcgaggaggaggaggagtag

SEQ ID NO: 11704 - DNA, 5745 bp, Artificial Sequence; identical to SEQ ID NO: 11700
  Description of Artificial Sequence: Synthetic coding sequence

SEQ ID NO: 11705 - DNA, 5931 bp, Artificial Sequence
  Description of Artificial Sequence: Synthetic coding sequence
atggcccagagaaccggcctggaggaccccgagagatacctgttcgtggacagagccgtgatctacaaccccgccacccaggccgactggaccgccaagaagctggtgtggatccccagcgagagacacggcttcgaggccgccagcatcaaggaggagagaggcgacgaggtgatggtggagctggccgagaacggcaagaaggccatggtgaacaaggacgacatccagaagatgaacccccccaagttcagcaaggtggaggacatggccgagctgacctgcctgaacgaggccagcgtgctgcacaacctgaaggacagatactacagcggcctgatctacacctacagcggcctgttctgcgtggtgatcaacccctacaagaacctgcccatctacagcgagaacatcatcgagatgtacagaggcaagaagagacacgagatgcccccccacatctacgccatcagcgagagcgcctacagatgcatgctgcaggacagagaggaccagagcatcctgtgcaccggcgagagcggcgccggcaagaccgagaacaccaagaaggtgatccagtacctggcccacgtggccagcagccacaagggcagaaaggaccacaacatccccggcgagctggagagacagctgctgcaggccaaccccatcctggagagcttcggcaacgccaagaccgtgaagaacgacaacagcagcagattcggcaagttcatcagaatcaacttcgacgtgaccggctacatcgtgggcgccaacatcgagacctacctgctggagaagagcagagccgtgagacaggccaaggacgagagaaccttccacatcttctaccagctgctgagcggcgccggcgagcacctgaagagcgacctgctgctggagggcttcaacaactacagattcctgagcaacggctacatccccatccccggccagcaggacaaggacaacttccaggagaccatggaggccatgcacatcatgggcttcagccacgaggagatcctgagcatgctgaaggtggtgagcagcgtgctgcagttcggcaacatcagcttcaagaaggagagaaacaccgaccaggccagcatgcccgagaacaccgtggcccagaagctgtgccacctgctgggcatgaacgtgatggagttcaccagagccatcctgacccccagaatcaaggtgggcagagactacgtgcagaaggcccagaccaaggagcaggccgacttcgccgtggaggccctggccaaggccacctacgagagactgttcagatggctggtgcacagaatcaacaaggccctggacagaaccaagagacagggcgccagcttcatcggcatcctggacatcgccggcttcgagatcttcgagctgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgacctgatcgagagacccgccaacccccccggcgtgctggccctgctggacgaggagtgctggttccccaaggccaccgacaagaccttcgtggagaagctggtgcaggagcagggcagccacagcaagttccagaagcccagacagctgaaggacaaggccgacttctgcatcatccactacgccggcaaggtggactacaaggccgacgagtggctgatgaagaacatggaccccctgaacgacaacgtggccaccctgctgcaccagagcagcgacagattcgtggccgagctgtggaaggacgtggacagaatcgtgggcctggaccaggtgaccggcatgaccgagaccgccttcggcagcgcctacaagaccaagaagggcatgttcagaaccgtgggccagctgtacaaggagagcctgaccaagctgatggccaccctgagaaacaccaaccccaacttcgtgagatgcatcatccccaaccacgagaagagagccggcaagctggacccccacctggtgctggaccagctgagatgcaacggcgtgctggagggcatcagaatctgcagacagggcttccccaacagaatcgtgttccaggagttcagacagagatacgagatcctgacccccaacgccatccccaagggcttcatggacggcaagcaggcctgcgagagaatgatcagagccctggagctggaccccaacctgtacagaatcggccagagcaagatcttcttcagagccggcgtgctggcccacctggaggaggagagagacctgaagatcaccgacatcatcatcttcttccaggccgtgtgcagaggctacctggccagaaaggccttcgccaagaagcagcagcagctgagcgccctgaaggtgctgcagagaaactgcgccgcctacctgaagctgagacactggcagtggtggagagtgttcaccaaggtgaagcccctgctgcaggtgaccagacaggaggaggagctgcaggccaaggacgaggagctgctgaaggtgaaggagaagcagaccaaggtggagggcgagctggaggagatggagagaaagcaccagcagctgctggaggagaagaacatcctggccgagcagctgcaggccgagaccgagctgttcgccgaggccgaggagatgagagccagactggccgccaagaagcaggagctggaggagatcctgcacgacctggagagcagagtggaggaggaggaggagagaaaccagatcctgcagaacgagaagaagaagatgcaggcccacatccaggacctggaggagcagctggacgaggaggagggcgccagacagaagctgcagctggagaaggtgaccgccgaggccaagatcaagaagatggaggaggagatcctgctgctggaggaccagaacagcaagttcatcaaggagaagaagctgatggaggacagaatcgccgagtgcagcagccagctggccgaggaggaggagaaggccaagaacctggccaagatcagaaacaagcaggaggtgatgatcagcgacctggaggagagactgaagaaggaggagaagaccagacaggagctggagaaggccaagagaaagctggacggcgagaccaccgacctgcaggaccagatcgccgagctgcaggcccagatcgacgagctgaagctgcagctggccaagaaggaggaggagctgcagggcgccctggccagaggcgacgacgagaccctgcacaagaacaacgccctgaaggtggtgagagagctgcaggcccagatcgccgagctgcaggaggacttcgagagcgagaaggccagcagaaacaaggccgagaagcagaagagagacctgagcgaggagctggaggccctgaagaccgagctggaggacaccctggacaccaccgccgcccagcaggagctgagaaccaagagagagcaggaggtggccgagctgaagaaggccctggaggaggagaccaagaaccacgaggcccagatccaggacatgagacagagacacgccaccgccctggaggagctgagcgagcagctggagcaggccaagagattcaaggccaacctggagaagaacaagcagggcctggagaccgacaacaaggagctggcctgcgaggtgaaggtgctgcagcaggtgaaggccgagagcgagcacaagagaaagaagctggacgcccaggtgcaggagctgcacgccaaggtgagcgagggcgacagactgagagtggagctggccgagaaggccagcaagctgcagaacgagctggacaacgtgagcaccctgctggaggaggccgagaagaagggcatcaagttcgccaaggacgccgccagcctggagagccagctgcaggacacccaggagctgctgcaggaggagaccagacagaagctgaacctgagcagcagaatcagacagctggaggaggagaagaacagcctgcaggagcagcaggaggaggaggaggaggccagaaagaacctggagaagcaggtgctggccctgcagagccagctggccgacaccaagaagaaggtggacgacgacctgggcaccatcgagagcctggaggaggccaagaagaagctgctgaaggacgccgaggccctgagccagagactggaggagaaggccctggcctacgacaagctggagaagaccaagaacagactgcagcaggagctggacgacctgaccgtggacctggaccaccagagacaggtggccagcaacctggagaagaagcagaagaagttcgaccagctgctggccgaggagaagagcatcagcgccagatacgccgaggagagagacagagccgaggccgaggccagagagaaggagaccaaggccctgagcctggccagagccctggaggaggccctggaggccaaggaggagttcgagagacagaacaagcagctgagagccgacatggaggacctgatgagcagcaaggacgacgtgggcaagaacgtgcacgagctggagaagagcaagagagccctggagcagcaggtggaggagatgagaacccagctggaggagctggaggacgagctgcaggccaccgaggacgccaagctgagactggaggtgaacatgcaggccatgaaggcccagttcgagagagacctgcagaccagagacgagcagaacgaggagaagaagagactgctgatcaagcaggtgagagagctggaggccgagctggaggacgagagaaagcagagagccctggccgtggccagcaagaagaagatggagatcgacctgaaggacctggaggcccagatcgaggccgccaacaaggccagagacgaggtgatcaagcagctgagaaagctgcaggcccagatgaaggactaccagagagagctggaggaggccagagccagcagagacgagatcttcgcccagagcaaggagagcgagaagaagctgaagagcctggaggccgagatcctgcagctgcaggaggagctggccagcagcgagagagccagaagacacgccgagcaggagagagacgagctggccgacgagatcaccaacagcgccagcggcaagagcgccctgctggacgagaagagaagactggaggccagaatcgcccagctggaggaggagctggaggaggagcagagcaacatggagctgctgaacgacagattcagaaagaccaccctgcaggtggacaccctgaacgccgagctggccgccgagagaagcgccgcccagaagagcgacaacgccagacagcagctggagagacagaacaaggagctgaaggccaagctgcaggagctggagggcgccgtgaagagcaagttcaaggccaccatcagcgccctggaggccaagatcggccagctggaggagcagctggagcaggaggccaaggagagagccgccgccaacaagctggtgagaagaaccgagaagaagctgaaggagatcttcatgcaggtggaggacgagagaagacacgccgaccagtacaaggagcagatggagaaggccaacgccagaatgaagcagctgaagagacagctggaggaggccgaggaggaggccaccagagccaacgccagcagaagaaagctgcagagagagctggacgacgccaccgaggccaacgagggcctgagcagagaggtgagcaccctgaagaacagactgagaagaggcggccccatcagcttcagcagcagcagaagcggcagaagacagctgcacctggagggcgccagcctggagctgagcgacgacgacaccgagagcaagaccagcgacgtgaacgagacccagcccccccagagcgagtag

SEQ ID NO: 11706 - DNA, 6024 bp, Artificial Sequence
  Description of Artificial Sequence: Synthetic coding sequence
atggcccagagaaccggcctggaggaccccgagagatacctgttcgtggacagagccgtgatctacaaccccgccacccaggccgactggaccgccaagaagctggtgtggatccccagcgagagacacggcttcgaggccgccagcatcaaggaggagagaggcgacgaggtgatggtggagctggccgagaacggcaagaaggccatggtgaacaaggacgacatccagaagatgaacccccccaagttcagcaaggtggaggacatggccgagctgacctgcctgaacgaggccagcgtgctgcacaacctgaaggacagatactacagcggcctgatctacacctacagcggcctgttctgcgtggtgatcaacccctacaagaacctgcccatctacagcgagaacatcatcgagatgtacagaggcaagaagagacacgagatgcccccccacatctacgccatcagcgagagcgcctacagatgcatgctgcaggacagagaggaccagagcatcctgtgcaccggcgagagcggcgccggcaagaccgagaacaccaagaaggtgatccagtacctggcccacgtggccagcagccacaagggcagaaaggaccacaacatcccccaggagagccccaagcccgtgaagcaccagggcgagctggagagacagctgctgcaggccaaccccatcctggagagcttcggcaacgccaagaccgtgaagaacgacaacagcagcagattcggcaagttcatcagaatcaacttcgacgtgaccggctacatcgtgggcgccaacatcgagacctacctgctggagaagagcagagccgtgagacaggccaaggacgagagaaccttccacatcttctaccagctgctgagcggcgccggcgagcacctgaagagcgacctgctgctggagggcttcaacaactacagattcctgagcaacggctacatccccatccccggccagcaggacaaggacaacttccaggagaccatggaggccatgcacatcatgggcttcagccacgaggagatcctgagcatgctgaaggtggtgagcagcgtgctgcagttcggcaacatcagcttcaagaaggagagaaacaccgaccaggccagcatgcccgagaacaccgtggcccagaagctgtgccacctgctgggcatgaacgtgatggagttcaccagagccatcctgacccccagaatcaaggtgggcagagactacgtgcagaaggcccagaccaaggagcaggccgacttcgccgtggaggccctggccaaggccacctacgagagactgttcagatggctggtgcacagaatcaacaaggccctggacagaaccaagagacagggcgccagcttcatcggcatcctggacatcgccggcttcgagatcttcgagctgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgacctgatcgagagacccgccaacccccccggcgtgctggccctgctggacgaggagtgctggttccccaaggccaccgacaagaccttcgtggagaagctggtgcaggagcagggcagccacagcaagttccagaagcccagacagctgaaggacaaggccgacttctgcatcatccactacgccggcaaggtggactacaaggccgacgagtggctgatgaagaacatggaccccctgaacgacaacgtggccaccctgctgcaccagagcagcgacagattcgtggccgagctgtggaaggacgagatccagaacatccagagagccagcttctacgacagcgtgagcggcctgcacgagccccccgtggacagaatcgtgggcctggaccaggtgaccggcatgaccgagaccgccttcggcagcgcctacaagaccaagaagggcatgttcagaaccgtgggccagctgtacaaggagagcctgaccaagctgatggccaccctgagaaacaccaaccccaacttcgtgagatgcatcatccccaaccacgagaagagagccggcaagctggacccccacctggtgctggaccagctgagatgcaacggcgtgctggagggcatcagaatctgcagacagggcttccccaacagaatcgtgttccaggagttcagacagagatacgagatcctgacccccaacgccatccccaagggcttcatggacggcaagcaggcctgcgagagaatgatcagagccctggagctggaccccaacctgtacagaatcggccagagcaagatcttcttcagagccggcgtgctggcccacctggaggaggagagagacctgaagatcaccgacatcatcatcttcttccaggccgtgtgcagaggctacctggccagaaaggccttcgccaagaagcagcagcagctgagcgccctgaaggtgctgcagagaaactgcgccgcctacctgaagctgagacactggcagtggtggagagtgttcaccaaggtgaagcccctgctgcaggtgaccagacaggaggaggagctgcaggccaaggacgaggagctgctgaaggtgaaggagaagcagaccaaggtggagggcgagctggaggagatggagagaaagcaccagcagctgctggaggagaagaacatcctggccgagcagctgcaggccgagaccgagctgttcgccgaggccgaggagatgagagccagactggccgccaagaagcaggagctggaggagatcctgcacgacctggagagcagagtggaggaggaggaggagagaaaccagatcctgcagaacgagaagaagaagatgcaggcccacatccaggacctggaggagcagctggacgaggaggagggcgccagacagaagctgcagctggagaaggtgaccgccgaggccaagatcaagaagatggaggaggagatcctgctgctggaggaccagaacagcaagttcatcaaggagaagaagctgatggaggacagaatcgccgagtgcagcagccagctggccgaggaggaggagaaggccaagaacctggccaagatcagaaacaagcaggaggtgatgatcagcgacctggaggagagactgaagaaggaggagaagaccagacaggagctggagaaggccaagagaaagctggacggcgagaccaccgacctgcaggaccagatcgccgagctgcaggcccagatcgacgagctgaagctgcagctggccaagaaggaggaggagctgcagggcgccctggccagaggcgacgacgagaccctgcacaagaacaacgccctgaaggtggtgagagagctgcaggcccagatcgccgagctgcaggaggacttcgagagcgagaaggccagcagaaacaaggccgagaagcagaagagagacctgagcgaggagctggaggccctgaagaccgagctggaggacaccctggacaccaccgccgcccagcaggagctgagaaccaagagagagcaggaggtggccgagctgaagaaggccctggaggaggagaccaagaaccacgaggcccagatccaggacatgagacagagacacgccaccgccctggaggagctgagcgagcagctggagcaggccaagagattcaaggccaacctggagaagaacaagcagggcctggagaccgacaacaaggagctggcctgcgaggtgaaggtgctgcagcaggtgaaggccgagagcgagcacaagagaaagaagctggacgcccaggtgcaggagctgcacgccaaggtgagcgagggcgacagactgagagtggagctggccgagaaggccagcaagctgcagaacgagctggacaacgtgagcaccctgctggaggaggccgagaagaagggcatcaagttcgccaaggacgccgccagcctggagagccagctgcaggacacccaggagctgctgcaggaggagaccagacagaagctgaacctgagcagcagaatcagacagctggaggaggagaagaacagcctgcaggagcagcaggaggaggaggaggaggccagaaagaacctggagaagcaggtgctggccctgcagagccagctggccgacaccaagaagaaggtggacgacgacctgggcaccatcgagagcctggaggaggccaagaagaagctgctgaaggacgccgaggccctgagccagagactggaggagaaggccctggcctacgacaagctggagaagaccaagaacagactgcagcaggagctggacgacctgaccgtggacctggaccaccagagacaggtggccagcaacctggagaagaagcagaagaagttcgaccagctgctggccgaggagaagagcatcagcgccagatacgccgaggagagagacagagccgaggccgaggccagagagaaggagaccaaggccctgagcctggccagagccctggaggaggccctggaggccaaggaggagttcgagagacagaacaagcagctgagagccgacatggaggacctgatgagcagcaaggacgacgtgggcaagaacgtgcacgagctggagaagagcaagagagccctggagcagcaggtggaggagatgagaacccagctggaggagctggaggacgagctgcaggccaccgaggacgccaagctgagactggaggtgaacatgcaggccatgaaggcccagttcgagagagacctgcagaccagagacgagcagaacgaggagaagaagagactgctgatcaagcaggtgagagagctggaggccgagctggaggacgagagaaagcagagagccctggccgtggccagcaagaagaagatggagatcgacctgaaggacctggaggcccagatcgaggccgccaacaaggccagagacgaggtgatcaagcagctgagaaagctgcaggcccagatgaaggactaccagagagagctggaggaggccagagccagcagagacgagatcttcgcccagagcaaggagagcgagaagaagctgaagagcctggaggccgagatcctgcagctgcaggaggagctggccagcagcgagagagccagaagacacgccgagcaggagagagacgagctggccgacgagatcaccaacagcgccagcggcaagagcgccctgctggacgagaagagaagactggaggccagaatcgcccagctggaggaggagctggaggaggagcagagcaacatggagctgctgaacgacagattcagaaagaccaccctgcaggtggacaccctgaacgccgagctggccgccgagagaagcgccgcccagaagagcgacaacgccagacagcagctggagagacagaacaaggagctgaaggccaagctgcaggagctggagggcgccgtgaagagcaagttcaaggccaccatcagcgccctggaggccaagatcggccagctggaggagcagctggagcaggaggccaaggagagagccgccgccaacaagctggtgagaagaaccgagaagaagctgaaggagatcttcatgcaggtggaggacgagagaagacacgccgaccagtacaaggagcagatggagaaggccaacgccagaatgaagcagctgaagagacagctggaggaggccgaggaggaggccaccagagccaacgccagcagaagaaagctgcagagagagctggacgacgccaccgaggccaacgagggcctgagcagagaggtgagcaccctgaagaacagactgagaagaggcggccccatcagcttcagcagcagcagaagcggcagaagacagctgcacctggagggcgccagcctggagctgagcgacgacgacaccgagagcaagaccagcgacgtgaacgagacccagcccccccagagcgagtag

SEQ ID NO: 11707 - DNA, 5979 bp, Artificial Sequence
  Description of Artificial Sequence: Synthetic coding sequence
atggcccagagaaccggcctggaggaccccgagagatacctgttcgtggacagagccgtgatctacaaccccgccacccaggccgactggaccgccaagaagctggtgtggatccccagcgagagacacggcttcgaggccgccagcatcaaggaggagagaggcgacgaggtgatggtggagctggccgagaacggcaagaaggccatggtgaacaaggacgacatccagaagatgaacccccccaagttcagcaaggtggaggacatggccgagctgacctgcctgaacgaggccagcgtgctgcacaacctgaaggacagatactacagcggcctgatctacacctacagcggcctgttctgcgtggtgatcaacccctacaagaacctgcccatctacagcgagaacatcatcgagatgtacagaggcaagaagagacacgagatgcccccccacatctacgccatcagcgagagcgcctacagatgcatgctgcaggacagagaggaccagagcatcctgtgcaccggcgagagcggcgccggcaagaccgagaacaccaagaaggtgatccagtacctggcccacgtggccagcagccacaagggcagaaaggaccacaacatcccccaggagagccccaagcccgtgaagcaccaggccagcgccctgctgtacggcgagctggagagacagctgctgcaggccaaccccatcctggagagcttcggcaacgccaagaccgtgaagaacgacaacagcagcagattcggcaagttcatcagaatcaacttcgacgtgaccggctacatcgtgggcgccaacatcgagacctacctgctggagaagagcagagccgtgagacaggccaaggacgagagaaccttccacatcttctaccagctgctgagcggcgccggcgagcacctgaagagcgacctgctgctggagggcttcaacaactacagattcctgagcaacggctacatccccatccccggccagcaggacaaggacaacttccaggagaccatggaggccatgcacatcatgggcttcagccacgaggagatcctgagcatgctgaaggtggtgagcagcgtgctgcagttcggcaacatcagcttcaagaaggagagaaacaccgaccaggccagcatgcccgagaacaccgtggcccagaagctgtgccacctgctgggcatgaacgtgatggagttcaccagagccatcctgacccccagaatcaaggtgggcagagactacgtgcagaaggcccagaccaaggagcaggccgacttcgccgtggaggccctggccaaggccacctacgagagactgttcagatggctggtgcacagaatcaacaaggccctggacagaaccaagagacagggcgccagcttcatcggcatcctggacatcgccggcttcgagatcttcgagctgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgacctgatcgagagacccgccaacccccccggcgtgctggccctgctggacgaggagtgctggttccccaaggccaccgacaagaccttcgtggagaagctggtgcaggagcagggcagccacagcaagttccagaagcccagacagctgaaggacaaggccgacttctgcatcatccactacgccggcaaggtggactacaaggccgacgagtggctgatgaagaacatggaccccctgaacgacaacgtggccaccctgctgcaccagagcagcgacagattcgtggccgagctgtggaaggacgtggacagaatcgtgggcctggaccaggtgaccggcatgaccgagaccgccttcggcagcgcctacaagaccaagaagggcatgttcagaaccgtgggccagctgtacaaggagagcctgaccaagctgatggccaccctgagaaacaccaaccccaacttcgtgagatgcatcatccccaaccacgagaagagagccggcaagctggacccccacctggtgctggaccagctgagatgcaacggcgtgctggagggcatcagaatctgcagacagggcttccccaacagaatcgtgttccaggagttcagacagagatacgagatcctgacccccaacgccatccccaagggcttcatggacggcaagcaggcctgcgagagaatgatcagagccctggagctggaccccaacctgtacagaatcggccagagcaagatcttcttcagagccggcgtgctggcccacctggaggaggagagagacctgaagatcaccgacatcatcatcttcttccaggccgtgtgcagaggctacctggccagaaaggccttcgccaagaagcagcagcagctgagcgccctgaaggtgctgcagagaaactgcgccgcctacctgaagctgagacactggcagtggtggagagtgttcaccaaggtgaagcccctgctgcaggtgaccagacaggaggaggagctgcaggccaaggacgaggagctgctgaaggtgaaggagaagcagaccaaggtggagggcgagctggaggagatggagagaaagcaccagcagctgctggaggagaagaacatcctggccgagcagctgcaggccgagaccgagctgttcgccgaggccgaggagatgagagccagactggccgccaagaagcaggagctggaggagatcctgcacgacctggagagcagagtggaggaggaggaggagagaaaccagatcctgcagaacgagaagaagaagatgcaggcccacatccaggacctggaggagcagctggacgaggaggagggcgccagacagaagctgcagctggagaaggtgaccgccgaggccaagatcaagaagatggaggaggagatcctgctgctggaggaccagaacagcaagttcatcaaggagaagaagctgatggaggacagaatcgccgagtgcagcagccagctggccgaggaggaggagaaggccaagaacctggccaagatcagaaacaagcaggaggtgatgatcagcgacctggaggagagactgaagaaggaggagaagaccagacaggagctggagaaggccaagagaaagctggacggcgagaccaccgacctgcaggaccagatcgccgagctgcaggcccagatcgacgagctgaagctgcagctggccaagaaggaggaggagctgcagggcgccctggccagaggcgacgacgagaccctgcacaagaacaacgccctgaaggtggtgagagagctgcaggcccagatcgccgagctgcaggaggacttcgagagcgagaaggccagcagaaacaaggccgagaagcagaagagagacctgagcgaggagctggaggccctgaagaccgagctggaggacaccctggacaccaccgccgcccagcaggagctgagaaccaagagagagcaggaggtggccgagctgaagaaggccctggaggaggagaccaagaaccacgaggcccagatccaggacatgagacagagacacgccaccgccctggaggagctgagcgagcagctggagcaggccaagagattcaaggccaacctggagaagaacaagcagggcctggagaccgacaacaaggagctggcctgcgaggtgaaggtgctgcagcaggtgaaggccgagagcgagcacaagagaaagaagctggacgcccaggtgcaggagctgcacgccaaggtgagcgagggcgacagactgagagtggagctggccgagaaggccagcaagctgcagaacgagctggacaacgtgagcaccctgctggaggaggccgagaagaagggcatcaagttcgccaaggacgccgccagcctggagagccagctgcaggacacccaggagctgctgcaggaggagaccagacagaagctgaacctgagcagcagaatcagacagctggaggaggagaagaacagcctgcaggagcagcaggaggaggaggaggaggccagaaagaacctggagaagcaggtgctggccctgcagagccagctggccgacaccaagaagaaggtggacgacgacctgggcaccatcgagagcctggaggaggccaagaagaagctgctgaaggacgccgaggccctgagccagagactggaggagaaggccctggcctacgacaagctggagaagaccaagaacagactgcagcaggagctggacgacctgaccgtggacctggaccaccagagacaggtggccagcaacctggagaagaagcagaagaagttcgaccagctgctggccgaggagaagagcatcagcgccagatacgccgaggagagagacagagccgaggccgaggccagagagaaggagaccaaggccctgagcctggccagagccctggaggaggccctggaggccaaggaggagttcgagagacagaacaagcagctgagagccgacatggaggacctgatgagcagcaaggacgacgtgggcaagaacgtgcacgagctggagaagagcaagagagccctggagcagcaggtggaggagatgagaacccagctggaggagctggaggacgagctgcaggccaccgaggacgccaagctgagactggaggtgaacatgcaggccatgaaggcccagttcgagagagacctgcagaccagagacgagcagaacgaggagaagaagagactgctgatcaagcaggtgagagagctggaggccgagctggaggacgagagaaagcagagagccctggccgtggccagcaagaagaagatggagatcgacctgaaggacctggaggcccagatcgaggccgccaacaaggccagagacgaggtgatcaagcagctgagaaagctgcaggcccagatgaaggactaccagagagagctggaggaggccagagccagcagagacgagatcttcgcccagagcaaggagagcgagaagaagctgaagagcctggaggccgagatcctgcagctgcaggaggagctggccagcagcgagagagccagaagacacgccgagcaggagagagacgagctggccgacgagatcaccaacagcgccagcggcaagagcgccctgctggacgagaagagaagactggaggccagaatcgcccagctggaggaggagctggaggaggagcagagcaacatggagctgctgaacgacagattcagaaagaccaccctgcaggtggacaccctgaacgccgagctggccgccgagagaagcgccgcccagaagagcgacaacgccagacagcagctggagagacagaacaaggagctgaaggccaagctgcaggagctggagggcgccgtgaagagcaagttcaaggccaccatcagcgccctggaggccaagatcggccagctggaggagcagctggagcaggaggccaaggagagagccgccgccaacaagctggtgagaagaaccgagaagaagctgaaggagatcttcatgcaggtggaggacgagagaagacacgccgaccagtacaaggagcagatggagaaggccaacgccagaatgaagcagctgaagagacagctggaggaggccgaggaggaggccaccagagccaacgccagcagaagaaagctgcagagagagctggacgacgccaccgaggccaacgagggcctgagcagagaggtgagcaccctgaagaacagactgagaagaggcggccccatcagcttcagcagcagcagaagcggcagaagacagctgcacctggagggcgccagcctggagctgagcgacgacgacaccgagagcaagaccagcgacgtgaacgagacccagcccccccagagcgagtag

SEQ ID NO: 11708 - DNA, 5994 bp, Artificial Sequence
  Description of Artificial Sequence: Synthetic coding sequence
atggcccagagaaccggcctggaggaccccgagagatacctgttcgtggacagagccgtgatctacaaccccgccacccaggccgactggaccgccaagaagctggtgtggatccccagcgagagacacggcttcgaggccgccagcatcaaggaggagagaggcgacgaggtgatggtggagctggccgagaacggcaagaaggccatggtgaacaaggacgacatccagaagatgaacccccccaagttcagcaaggtggaggacatggccgagctgacctgcctgaacgaggccagcgtgctgcacaacctgaaggacagatactacagcggcctgatctacacctacagcggcctgttctgcgtggtgatcaacccctacaagaacctgcccatctacagcgagaacatcatcgagatgtacagaggcaagaagagacacgagatgcccccccacatctacgccatcagcgagagcgcctacagatgcatgctgcaggacagagaggaccagagcatcctgtgcaccggcgagagcggcgccggcaagaccgagaacaccaagaaggtgatccagtacctggcccacgtggccagcagccacaagggcagaaaggaccacaacatccccggcgagctggagagacagctgctgcaggccaaccccatcctggagagcttcggcaacgccaagaccgtgaagaacgacaacagcagcagattcggcaagttcatcagaatcaacttcgacgtgaccggctacatcgtgggcgccaacatcgagacctacctgctggagaagagcagagccgtgagacaggccaaggacgagagaaccttccacatcttctaccagctgctgagcggcgccggcgagcacctgaagagcgacctgctgctggagggcttcaacaactacagattcctgagcaacggctacatccccatccccggccagcaggacaaggacaacttccaggagaccatggaggccatgcacatcatgggcttcagccacgaggagatcctgagcatgctgaaggtggtgagcagcgtgctgcagttcggcaacatcagcttcaagaaggagagaaacaccgaccaggccagcatgcccgagaacaccgtggcccagaagctgtgccacctgctgggcatgaacgtgatggagttcaccagagccatcctgacccccagaatcaaggtgggcagagactacgtgcagaaggcccagaccaaggagcaggccgacttcgccgtggaggccctggccaaggccacctacgagagactgttcagatggctggtgcacagaatcaacaaggccctggacagaaccaagagacagggcgccagcttcatcggcatcctggacatcgccggcttcgagatcttcgagctgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgacctgatcgagagacccgccaacccccccggcgtgctggccctgctggacgaggagtgctggttccccaaggccaccgacaagaccttcgtggagaagctggtgcaggagcagggcagccacagcaagttccagaagcccagacagctgaaggacaaggccgacttctgcatcatccactacgccggcaaggtggactacaaggccgacgagtggctgatgaagaacatggaccccctgaacgacaacgtggccaccctgctgcaccagagcagcgacagattcgtggccgagctgtggaaggacgagatccagaacatccagagagccagcttctacgacagcgtgagcggcctgcacgagccccccgtggacagaatcgtgggcctggaccaggtgaccggcatgaccgagaccgccttcggcagcgcctacaagaccaagaagggcatgttcagaaccgtgggccagctgtacaaggagagcctgaccaagctgatggccaccctgagaaacaccaaccccaacttcgtgagatgcatcatccccaaccacgagaagagagccggcaagctggacccccacctggtgctggaccagctgagatgcaacggcgtgctggagggcatcagaatctgcagacagggcttccccaacagaatcgtgttccaggagttcagacagagatacgagatcctgacccccaacgccatccccaagggcttcatggacggcaagcaggcctgcgagagaatgatcagagccctggagctggaccccaacctgtacagaatcggccagagcaagatcttcttcagagccggcgtgctggcccacctggaggaggagagagacctgaagatcaccgacatcatcatcttcttccaggccgtgtgcagaggctacctggccagaaaggccttcgccaagaagcagcagcagctgagcgccctgaaggtgctgcagagaaactgcgccgcctacctgaagctgagacactggcagtggtggagagtgttcaccaaggtgaagcccctgctgcaggtgaccagacaggaggaggagctgcaggccaaggacgaggagctgctgaaggtgaaggagaagcagaccaaggtggagggcgagctggaggagatggagagaaagcaccagcagctgctggaggagaagaacatcctggccgagcagctgcaggccgagaccgagctgttcgccgaggccgaggagatgagagccagactggccgccaagaagcaggagctggaggagatcctgcacgacctggagagcagagtggaggaggaggaggagagaaaccagatcctgcagaacgagaagaagaagatgcaggcccacatccaggacctggaggagcagctggacgaggaggagggcgccagacagaagctgcagctggagaaggtgaccgccgaggccaagatcaagaagatggaggaggagatcctgctgctggaggaccagaacagcaagttcatcaaggagaagaagctgatggaggacagaatcgccgagtgcagcagccagctggccgaggaggaggagaaggccaagaacctggccaagatcagaaacaagcaggaggtgatgatcagcgacctggaggagagactgaagaaggaggagaagaccagacaggagctggagaaggccaagagaaagctggacggcgagaccaccgacctgcaggaccagatcgccgagctgcaggcccagatcgacgagctgaagctgcagctggccaagaaggaggaggagctgcagggcgccctggccagaggcgacgacgagaccctgcacaagaacaacgccctgaaggtggtgagagagctgcaggcccagatcgccgagctgcaggaggacttcgagagcgagaaggccagcagaaacaaggccgagaagcagaagagagacctgagcgaggagctggaggccctgaagaccgagctggaggacaccctggacaccaccgccgcccagcaggagctgagaaccaagagagagcaggaggtggccgagctgaagaaggccctggaggaggagaccaagaaccacgaggcccagatccaggacatgagacagagacacgccaccgccctggaggagctgagcgagcagctggagcaggccaagagattcaaggccaacctggagaagaacaagcagggcctggagaccgacaacaaggagctggcctgcgaggtgaaggtgctgcagcaggtgaaggccgagagcgagcacaagagaaagaagctggacgcccaggtgcaggagctgcacgccaaggtgagcgagggcgacagactgagagtggagctggccgagaaggccagcaagctgcagaacgagctggacaacgtgagcaccctgctggaggaggccgagaagaagggcatcaagttcgccaaggacgccgccagcctggagagccagctgcaggacacccaggagctgctgcaggaggagaccagacagaagctgaacctgagcagcagaatcagacagctggaggaggagaagaacagcctgcaggagcagcaggaggaggaggaggaggccagaaagaacctggagaagcaggtgctggccctgcagagccagctggccgacaccaagaagaaggtggacgacgacctgggcaccatcgagagcctggaggaggccaagaagaagctgctgaaggacgccgaggccctgagccagagactggaggagaaggccctggcctacgacaagctggagaagaccaagaacagactgcagcaggagctggacgacctgaccgtggacctggaccaccagagacaggtggccagcaacctggagaagaagcagaagaagttcgaccagctgctggccgaggagaagagcatcagcgccagatacgccgaggagagagacagagccgaggccgaggccagagagaaggagaccaaggccctgagcctggccagagccctggaggaggccctggaggccaaggaggagttcgagagacagaacaagcagctgagagccgacatggaggacctgatgagcagcaaggacgacgtgggcaagaacgtgcacgagctggagaagagcaagagagccctggagcagcaggtggaggagatgagaacccagctggaggagctggaggacgagctgcaggccaccgaggacgccaagctgagactggaggtgaacatgcaggccatgaaggcccagttcgagagagacctgcagaccagagacgagcagaacgaggagaagaagagactgctgatcaagcaggtgagagagctggaggccgagctggaggacgagagaaagcagagagccctggccgtggccagcaagaagaagatggagatcgacctgaaggacctggaggcccagatcgaggccgccaacaaggccagagacgaggtgatcaagcagctgagaaagctgcaggcccagatgaaggactaccagagagagctggaggaggccagagccagcagagacgagatcttcgcccagagcaaggagagcgagaagaagctgaagagcctggaggccgagatcctgcagctgcaggaggagctggccagcagcgagagagccagaagacacgccgagcaggagagagacgagctggccgacgagatcaccaacagcgccagcggcaagagcgccctgctggacgagaagagaagactggaggccagaatcgcccagctggaggaggagctggaggaggagcagagcaacatggagctgctgaacgacagattcagaaagaccaccctgcaggtggacaccctgaacgccgagctggccgccgagagaagcgccgcccagaagagcgacaacgccagacagcagctggagagacagaacaaggagctgaaggccaagctgcaggagctggagggcgccgtgaagagcaagttcaaggccaccatcagcgccctggaggccaagatcggccagctggaggagcagctggagcaggaggccaaggagagagccgccgccaacaagctggtgagaagaaccgagaagaagctgaaggagatcttcatgcaggtggaggacgagagaagacacgccgaccagtacaaggagcagatggagaaggccaacgccagaatgaagcagctgaagagacagctggaggaggccgaggaggaggccaccagagccaacgccagcagaagaaagctgcagagagagctggacgacgccaccgaggccaacgagggcctgagcagagaggtgagcaccctgaagaacagactgagaagaggcggccccatcagcttcagcagcagcagaagcggcagaagacagctgcacctggagggcgccagcctggagctgagcgacgacgacaccgagagcaagaccagcgacgtgaacgagacccagcccccccagagcgagtag

SEQ ID NO: 11709 - DNA, 567 bp, Artificial Sequence
  Description of Artificial Sequence: Synthetic coding sequence
atggcccagagaaccggcctggaggaccccgagagatacctgttcgtggacagagccgtgatctacaaccccgccacccaggccgactggaccgccaagaagctggtgtggatccccagcgagagacacggcttcgaggccgccagcatcaaggaggagagaggcgacgaggtgatggtggagctggccgagaacggcaagaaggccatggtgaacaaggacgacatccagaagatgaacccccccaagttcagcaaggtggaggacatggccgagctgacctgcctgaacgaggccagcgtgctgcacaacctgaaggacagatactacagcggcctgatctacacctacagcggcctgttctgcgtggtgatcaacccctacaagaacctgcccatctacagcgagaacatcatcgagatgtacagaggcaagaagagacacgagatgcccccccacatctacgccatcagcgagagcgcctacagatgcatgctgcaggacagagaggaccagagcatcctgtgcaccggcgagagcggcgccggcaagaccgagaacacctag

SEQ ID NO: 11710 - DNA, 1446 bp, Artificial Sequence
  Description of Artificial Sequence: Synthetic coding sequence
atgtacgacgccgagagaggctggagcctgagcttcgccggctgcggcttcctgggcttctaccacgtgggcgccaccagatgcctgagcgagcacgccccccacctgctgagagacgccagaatgctgttcggcgccagcgccggcgccctgcactgcgtgggcgtgctgagcggcatccccctggagcagaccctgcaggtgctgagcgacctggtgagaaaggccagaagcagaaacatcggcatcttccaccccagcttcaacctgagcaagttcctgagacagggcctgtgcaagtgcctgcccgccaacgtgcaccagctgatcagcggcaagatcggcatcagcctgaccagagtgagcgacggcgagaacgtgctggtgagcgacttcagaagcaaggacgaggtggtggacgccctggtgtgcagctgcttcatccccttctacagcggcctgatcccccccagcttcagaggcgtgagatacgtggacggcggcgtgagcgacaacgtgcccttcatcgacgccaagaccaccatcaccgtgagccccttctacggcgagtacgacatctgccccaaggtgaagagcaccaacttcctgcacgtggacatcaccaagctgagcctgagactgtgcaccggcaacctgtacctgctgagcagagccttcgtgccccccgacctgaaggtgctgggcgagatctgcctgagaggctacctggacgccttcagattcctggaggagaagggcatctgcaacagaccccagcccggcctgaagagcagcagcgagggcatggaccccgaggtggccatgcccagctgggccaacatgagcctggacagcagccccgagagcgccgccctggccgtgagactggagggcgacgagctgctggaccacctgagactgagcatcctgccctgggacgagagcatcctggacaccctgagccccagactggccaccgccctgagcgaggagatgaaggacaagggcggctacatgagcaagatctgcaacctgctgcccatcagaatcatgagctacgtgatgctgccctgcaccctgcccgtggagagcgccatcgccatcgtgcagagactggtgacctggctgcccgacatgcccgacgacgtgctgtggctgcagtgggtgaccagccaggtgttcaccagagtgctgatgtgcctgctgcccgccagcagaagccagatgcccgtgagcagccagcaggccagcccctgcacccccgagcaggactggccctgctggaccccctgcagccccaagggctgccccgccgagaccaaggccgaggccacccccagaagcatcctgagaagcagcctgaacttcttcctgggcaacaaggtgcccgccggcgccgagggcctgagcaccttccccagcttcagcctggagaagagcctgtag

SEQ ID NO: 11711 - DNA, 4149 bp, Artificial Sequence
  Description of Artificial Sequence: Synthetic coding sequence
atgtacaagggcaagaagagacacgagatgcccccccacatctacgccatcaccgacaccgcctacagaagcatgatgcaggacagagaggaccagagcatcctgtgcaccggcgagagcggcgccggcaagaccgagaacaccaagaaggtgatccagtacctggcctacgtggccagcagccacaagagcaagaaggaccagggcgagctggagagacagctgctgcaggccaaccccatcctggaggccttcggcaacgccaagaccgtgaagaacgacaacagcagcagattcggcaagttcatcagaatcaacttcgacgtgaacggctacatcgtgggcgccaacatcgagacctacctgctggagaagagcagagccatcagacaggccaaggaggagagaaccttccacatcttctactacctgctgagcggcgccggcgagcacctgaagaccgacctgctgctggagccctacaacaagtacagattcctgagcaacggccacgtgaccatccccggccagcaggacaaggacatgttccaggagaccatggaggccatgagaatcatgggcatccccgaggaggagcagatgggcctgctgagagtgatcagcggcgtgctgcagctgggcaacatcgtgttcaagaaggagagaaacaccgaccaggccagcatgcccgacaacaccgccgcccagaaggtgagccacctgctgggcatcaacgtgaccgacttcaccagaggcatcctgacccccagaatcaaggtgggcagagactacgtgcagaaggcccagaccaaggagcaggccgacttcgccatcgaggccctggccaaggccacctacgagagaatgttcagatggctggtgctgagaatcaacaaggccctggacaagaccaagagacagggcgccagcttcatcggcatcctggacatcgccggcttcgagatcttcgacctgaacagcttcgagcagctgtgcatcaactacaccaacgagaagctgcagcagctgttcaaccacaccatgttcatcctggagcaggaggagtaccagagagagggcatcgagtggaacttcatcgacttcggcctggacctgcagccctgcatcgacctgatcgagaagcccgccggcccccccggcatcctggccctgctggacgaggagtgctggttccccaaggccaccgacaagagcttcgtggagaaggtgatgcaggagcagggcacccaccccaagttccagaagcccaagcagctgaaggacaaggccgacttctgcatcatccactacgccggcaaggtggactacaaggccgacgagtggctgatgaagaacatggaccccctgaacgacaacatcgccaccctgctgcaccagagcagcgacaagttcgtgagcgagctgtggaaggacgtggacagaatcatcggcctggaccaggtggccggcatgagcgagaccgccctgcccggcgccttcaagaccagaaagggcatgttcagaaccgtgggccagctgtacaaggagcagctggccaagctgatggccaccctgagaaacaccaaccccaacttcgtgagatgcatcatccccaaccacgagaagaaggccggcaagctggacccccacctggtgctggaccagctgagatgcaacggcgtgctggagggcatcagaatctgcagacagggcttccccaacagagtggtgttccaggagttcagacagagatacgagatcctgacccccaacagcatccccaagggcttcatggacggcaagcaggcctgcgtgctgatgatcaaggccctggagctggacagcaacctgtacagaatcggccagagcaaggtgttcttcagagccggcgtgctggcccacctggaggaggagagagacctgaagatcaccgacgtgatcatcggcttccaggcctgctgcagaggctacctggccagaaaggccttcgccaagagacagcagcagctgaccgccatgaaggtgctgcagagaaactgcgccgcctacctgaagctgagaaactggcagtggtggagactgttcaccaaggtgaagcccctgctgcaggtgagcagacaggaggaggagatgatggccaaggaggaggagctggtgaaggtgagagagaagcagctggccgccgagaacagactgaccgagatggagaccctgcagagccagctgatggccgagaagctgcagctgcaggagcagctgcaggccgagaccgagctgtgcgccgaggccgaggagctgagagccagactgaccgccaagaagcaggagctggaggagatctgccacgacctggaggccagagtggaggaggaggaggagagatgccagcacctgcaggccgagaagaagaagatgcagcagaacatccaggagctggaggagcagctggaggaggaggagagcgccagacagaagctgcagctggagaaggtgaccaccgaggccaagctgaagaagctggaggaggagctggacgacctgctggtggacctggaccaccagagacagagcgcctgcaacctggagaagaagcagaagaagttcgaccagctgctggccgaggagaagaccatcagcgccaagtacgccgaggagagagacagagccgaggccgaggccagagagaaggagaccaaggccctgagcctggccagagccctggaggaggccatggagcagaaggccgagctggagagactgaacaagcagttcagaaccgagatggaggacctgatgagcagcaaggacgacgtgggcaagagcgtgcacgagctggagaagagcaagagagccctggagcagcaggtggaggagatgaagacccagctggaggagctggaggacgagctgcaggccaccgaggacgccaagctgagactggaggtgaacctgcaggccatgaaggcccagttcgagagagacctgcagggcagagacgagcagagcgaggagaagaagaagcagctggtgagacaggtgagagagatggaggccgagctggaggacgagagaaagcagagaagcatggccgtggccgccagaaagaagctggagatggacctgaaggacctggaggcccacatcgacagcgccaacaagaacagagacgaggccatcaagcagctgagaaagctgcaggcccagatgaaggactgcatgagagagctggacgacaccagagccagcagagaggagatcctggcccaggccaaggagaacgagaagaagctgaagagcatggaggccgagatgatccagctgcaggaggagctggccgccgccgagagagccaagagacaggcccagcaggagagagacgagctggccgacgagatcgccaacagcagcggcaagggcgccctggccctggaggagaagagaagactggaggccagaatcgcccagctggaggaggagctggaggaggagcagggcaacaccgagctgatcaacgacagactgaagaaggccaacctgcagatcgaccagatcaacaccgacctgaacctggagagaagccacgcccagaagaacgagaacgccagacagcagctggagagacagaacaaggagctgaaggtgaagctgcaggagatggagggcaccgtgaagagcaagtacaaggccagcatcaccgccctggaggccaagatcgcccagctggaggagcagctggacaacgagaccaaggagagacaggccgcctgcaagcaggtgagaagaaccgagaagaagctgaaggacgtgctgctgcaggtggacgacgagagaagaaacgccgagcagtacaaggaccaggccgacaaggccagcaccagactgaagcagctgaagagacagctggaggaggccgaggaggaggcccagagagccaacgccagcagaagaaagctgcagagagagctggaggacgccaccgagaccgccgacgccatgaacagagaggtgagcagcctgaagaacaagctgagaagaggcgacctgcccttcgtggtgcccagaagaatggccagaaagggcgccggcgacggcagcgacgaggaggtggacggcaaggccgacggcgccgaggccaagcccgccgagtag

SEQ ID NO: 11712 - DNA, 1689 bp, Artificial Sequence
  Description of Artificial Sequence: Synthetic coding sequence
gccagcggcaccagaagaagatggccccccaccaccagctggagaagacccagaagaggctgcagcagaagctggaccacctgctggtggacctggaccaccagcgccagagccagagccacctggagaagaagcagaagaagcctgaccagcagctggagaagaagaagacccagcctgcccagcatgcagagaagcgccaccggcctgagaagaagacccgagagaagaagacccagactgtgcagatggcccggccccgaggaggccatggagcagaaggccgagctggagagactgaacaagcagttcagaaccgagatggaggacctgatgagcagcaaggacgacgtgggcaagagcgtgcacgagctggagaagagcaagagagccctggagcagcaggtggaggagatgaagacccagctggaggagctggaggacgagctgcaggccaccgaggacgccaagctgagactggaggtgaacctgcaggccatgaaggcccagttcgagagagacctgcagggcagagacgagcagagcgaggagaagaagaagcagctggtgagacaggtgagagagatggaggccgagctggaggacgagagaaagcagagaagcatggccgtggccgccagaaagaagctggagatggacctgaaggacctggaggcccacatcgacagcgccaacaagaacagagacgaggccatcaagcagctgagaaagctgcaggcccagatgaaggactgcatgagagagctggacgacaccagagccagcagagaggagatcctggcccaggccaaggagaacgagaagaagctgaagagcatggaggccgagatgatccagctgcaggaggagctggccgccgccgagagagccaagagacaggcccagcaggagagagacgagctggccgacgagatcgccaacagcagcggcaagggcgccctggccctggaggagaagagaagactggaggccagaatcgcccagctggaggaggagctggaggaggagcagggcaacaccgagctgatcaacgacagactgaagaaggccaacctgcagatcgaccagatcaacaccgacctgaacctggagagaagccacgcccagaagaacgagaacgccagacagcagctggagagacagaacaaggagctgaaggtgaagctgcaggagatggagggcaccgtgaagagcaagtacaaggccagcatcaccgccctggaggccaagatcgcccagctggaggagcagctggacaacgagaccaaggagagacaggccgcctgcaagcaggtgagaagaaccgagaagaagctgaaggacgtgctgctgcaggtggacgacgagagaagaaacgccgagcagtacaaggaccaggccgacaaggccagcaccagactgaagcagctgaagagacagctggaggaggccgaggaggaggcccagagagccaacgccagcagaagaaagctgcagagagagctggaggacgccaccgagaccgccgacgccatgaacagagaggtgagcagcctgaagaacaagctgagaagaggcgacctgcccttcgtggtgcccagaagaatggccagaaagggcgccggcgacggcagcgacgaggaggtggacggcaaggccgacggcgccgaggccaagcccgccgagtag

SEQ ID NO: 11713 - DNA, 657 bp, Artificial Sequence
  Description of Artificial Sequence: Synthetic coding sequence
atggcccagcaggccgccgacaagtacctgtacgtggacaagaacttcatcaacaaccccctggcccaggccgactgggccgccaagaagctggtgtgggtgcccagcgacaagagcggcttcgagcccgccagcctgaaggaggaggtgggcgaggaggccatcgtggagctggtggagaacggcaagaaggtgaaggtgaacaaggacgacatccagaagatgaacccccccaagttcagcaaggtggaggacatggccgagctgacctgcctgaacgaggccagcgtgctgcacaacctgaaggagagatactacagcggcctgatctacacctacagcggcctgttctgcgtggtgatcaacccctacaagaacctgcccatctacagcgaggagatcgtggagatgtacaagggcaagaagagacacgagatgcccccccacatctacgccatcaccgacaccgcctacagaagcatgatgcaggacagagaggaccagagcatcctgtgcaccggcgagagcggcgccggcaagaccgagaacaccaagaaggtgatccagtacctggcctacgtggccagcagccacaagagcaagaaggaccaggaggcctacttcaagaacagagccgtgagactgggcgtgctgtag

SEQ ID NO: 11714 - DNA, 312 bp, Artificial Sequence
  Description of Artificial Sequence: Synthetic coding sequence
atggcccagcaggccgccgacaagtacctgtacgtggacaagaacttcatcaacaaccccctggcccaggccgactgggccgccaagaagctggtgtgggtgcccagcgacaagagcggcttcgagcccgccagcctgaaggaggaggtgggcgaggaggccatcgtggagctggtggagaacggcaagaaggtgaaggtgaacaaggacgacatccagaagatgaacccccccaagttcagcaaggtggaggacatggccgagctgacctgcctgaacgaggccagcgtgctgcacaacctgaaggagtag

SEQ ID NO: 11715 - DNA, 519 bp, Artificial Sequence
  Description of Artificial Sequence: Synthetic coding sequence
atgagcagcaagagagccaaggccaagaccaccaagaagagaccccagagagccaccagcaacgtgttcgccatgttcgaccagagccagatccaggagttcaaggaggccttcaacatgatcgaccagaacagagacggcttcatcgacaaggaggacctgcacgacatgctggccagcctgggcaagaaccccaccgacgagtacctggagggcatgatgagcgaggcccccggccccatcaacttcaccatgttcctgaccatgttcggcgagaagctgaacggcaccgaccccgaggacgtgatcagaaacgccttcgcctgcttcgacgaggaggccagcggcttcatccacgaggaccacctgagagagctgctgaccaccatgggcgacagattcaccgacgaggaggtggacgagatgtacagagaggcccccatcgacaagaagggcaacttcaactacgtggagttcaccagaatcctgaagcacggcgccaaggacaaggacgactag

SEQ ID NO: 11716 - DNA, 357 bp, Artificial Sequence
  Description of Artificial Sequence: Synthetic coding sequence
atgagcagcaagagagccaaggccaagaccaccaagaagagaccccagagagccaccagcaacgtgttcgccatgttcgaccagagccagatccaggagttcaaggaggccttcaacatgatcgaccagaacagagacggcttcatcgacaaggaggacctgcacgacatgctggccagcctgggcttcatccacgaggaccacctgagagagctgctgaccaccatgggcgacagattcaccgacgaggaggtggacgagatgtacagagaggcccccatcgacaagaagggcaacttcaactacgtggagttcaccagaatcctgaagcacggcgccaaggacaaggacgactag

SEQ ID NO: 11717 - DNA, 927 bp, Artificial Sequence
  Description of Artificial Sequence: Synthetic coding sequence
atgcaggagctgaccctgagccccggccccgccaagctgacccccaccctggaccccacccacagaatggagctgatcctgagcaccagccccgccgagctgaccctggaccccgcctgccagcccaagctgcccctggacagcacctgccagcccgagatgaccttcaaccccggccccaccgagctgaccctggaccccgagcaccagcccgaggagacccccgcccccagcctggccgagctgaccctggagcccgtgcacagaagacccgagctgctggacgcctgcgccgacctgatcaacgaccagtggcccagaagcagaaccagcagactgcacagcctgggccagagcagcgacgccttccccctgtgcctgatgctgctgagcccccaccccaccctggaggccgcccccgtggtggtgggccacgccagactgagcagagtgctgaaccagccccagagcctgctggtggagaccgtggtggtggccagagccctgagaggcagaggcttcggcagaagactgatggagggcctggaggtgttcgccagagccagaggcttcagaaagctgcacctgaccacccacgaccaggtgcacttctacacccacctgggctaccagctgggcgagcccgtgcagggcctggtgttcaccagcagaagactgcccgccaccctgctgaacgccttccccaccgcccccagccccagaccccccagaaaggcccccaacctgaccgcccaggccgcccccagaggccccaagggcccccccctgcccccccccccccccctgcccgagtgcctgaccatcagcccccccgtgcccagcggcccccccagcaagagcctgctggagacccagtaccagaacgtgagaggcagacccatcttctggatggagaaggacatctag

SEQ ID NO: 11718 - DNA, 861 bp, Artificial Sequence
  Description of Artificial Sequence: Synthetic coding sequence
atggagctgatcctgagcaccagccccgccgagctgaccctggaccccgcctgccagcccaagctgcccctggacagcacctgccagcccgagatgaccttcaaccccggccccaccgagctgaccctggaccccgagcaccagcccgaggagacccccgcccccagcctggccgagctgaccctggagcccgtgcacagaagacccgagctgctggacgcctgcgccgacctgatcaacgaccagtggcccagaagcagaaccagcagactgcacagcctgggccagagcagcgacgccttccccctgtgcctgatgctgctgagcccccaccccaccctggaggccgcccccgtggtggtgggccacgccagactgagcagagtgctgaaccagccccagagcctgctggtggagaccgtggtggtggccagagccctgagaggcagaggcttcggcagaagactgatggagggcctggaggtgttcgccagagccagaggcttcagaaagctgcacctgaccacccacgaccaggtgcacttctacacccacctgggctaccagctgggcgagcccgtgcagggcctggtgttcaccagcagaagactgcccgccaccctgctgaacgccttccccaccgcccccagccccagaccccccagaaaggcccccaacctgaccgcccaggccgcccccagaggccccaagggcccccccctgcccccccccccccccctgcccgagtgcctgaccatcagcccccccgtgcccagcggcccccccagcaagagcctgctggagacccagtaccagaacgtgagaggcagacccatcttctggatggagaaggacatctag

SEQ ID NO: 11719 - DNA, 174 bp, Artificial Sequence
  Description of Artificial Sequence: Synthetic coding sequence
atggagctgatcctgagcaccagccccgccgagctgaccctggaccccgcctgccagcccaagctgcccctggacagcacctgccagcccgagatgaccttcaaccccggccccaccgagctgaccctggaccccgagcaccagcccgaggagacccccgcccccagcctgtag

SEQ ID NO: 11720 - DNA, 861 bp, Artificial Sequence; identical to SEQ ID NO: 11718
  Description of Artificial Sequence: Synthetic coding sequence

SEQ ID NO: 11721 - DNA, 861 bp, Artificial Sequence; identical to SEQ ID NO: 11718
  Description of Artificial Sequence: Synthetic coding sequence

SEQ ID NO: 11722 - DNA, 261 bp, Artificial Sequence
  Description of Artificial Sequence: Synthetic coding sequence
atggagctgatcctgagcaccagccccgccgagctgaccctggaccccgcctgccagcccaagctgcccctggacagcacctgccagcccgagatgaccttcaaccccggccccaccgagctgaccctggaccccgagcaccagcccgaggagacccccgcccccagcctggccgagctgaccctggagcccgtgcacagaagacccgagctgctggacgcctgcgccgacctgatcaacgaccagtggcccagaagctag

SEQ ID NO: 11723 - DNA, 30 bp, Artificial Sequence
  Description of Artificial Sequence: Synthetic coding sequence
atggagctgatcctgagcaccagcccctag

SEQ ID NO: 11724 - DNA, 987 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcaccctgagatgccccgtgatgctggtggtgggcgaccaggccccccacgaggacgccgtggtggagtgcaacagcaagctggaccccacccagaccagcttcctgaagatggccgacagcggcggccagccccagctgacccagcccggcaagctgaccgaggccttcaagtacttcctgcagggcatgggctacatggccagcagctgcatgaccagactgagcagaagcagaaccgccagcctgaccagcgccgccagcgtggacggcaacagaagcagaagcagaaccctgagccagagcagcgagagcggcaccctgagcagcggcccccccggccacaccatggaggtgagctgctag

SEQ ID NO: 11725 - DNA, 1116 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcaccctgagatgccccgtgatgctggtggtgggcgaccaggccccccacgaggacgccgtggtggagtgcaacagcaagctggaccccacccagaccagcttcctgaagatggccgacagcggcggccagccccagctgacccagcccggcaagctgaccgaggccttcaagtacttcctgcagggcatgggctacatggccagcagctgcatgaccagactgagcagaagcagaaccgccagcctgaccagcgccgccagcgtggacggcaacagaagcagaagcagaaccctgagccagagcagcgagagcggcaccctgagcagcggcccccccggccacaccatggaggtgagctgctag

SEQ ID NO: 11726 - DNA, 1074 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcaccctgagatgccccgtgatgctggtggtgggcgaccaggccccccacgaggacgccgtggtggagtgcaacagcaagctggaccccacccagaccagcttcctgaagatggccgacagcggcggccagccccagctgacccagcccggcaagctgaccgaggccttcaagtacttcctgcagggcatgggctacatggccagcagctgcatgaccagactgagcagaagcagaaccgccagcctgaccagcgccgccagcgtggacggcaacagaagcagaagcagaaccctgagccagagcagcgagagcggcaccctgagcagcggcccccccggccacaccatggaggtgagctgctag

SEQ ID NO: 11727 - DNA, 1074 bp, Artificial Sequence; identical to SEQ ID NO: 11726
  Description of Artificial Sequence: Synthetic coding sequence

SEQ ID NO: 11728 - DNA, 1026 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcaccctgagatgccccgtgatgctggtggtgggcgaccaggccccccacgaggacgccgtgatggccgacagcggcggccagccccagctgacccagcccggcaagctgaccgaggccttcaagtacttcctgcagggcatgggctacatggccagcagctgcatgaccagactgagcagaagcagaaccgccagcctgaccagcgccgccagcgtggacggcaacagaagcagaagcagaaccctgagccagagcagcgagagcggcaccctgagcagcggcccccccggccacaccatggaggtgagctgctag

SEQ ID NO: 11729 - DNA, 1083 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcaccctgagatgccccgtgatgctggtggtggagtgcaacagcaagctggaccccacccagaccagcttcctgaagatggccgacagcggcggccagccccagctgacccagcccggcaagctgaccgaggccttcaagtacttcctgcagggcatgggctacatggccagcagctgcatgaccagactgagcagaagcagaaccgccagcctgaccagcgccgccagcgtggacggcaacagaagcagaagcagaaccctgagccagagcagcgagagcggcaccctgagcagcggcccccccggccacaccatggaggtgagctgctag

SEQ ID NO: 11730 - DNA, 1116 bp, Artificial Sequence; identical to SEQ ID NO: 11725
  Description of Artificial Sequence: Synthetic coding sequence

SEQ ID NO: 11731 - DNA, 1116 bp, Artificial Sequence; identical to SEQ ID NO: 11725
  Description of Artificial Sequence: Synthetic coding sequence

SEQ ID NO: 11732 - DNA, 987 bp, Artificial Sequence; identical to SEQ ID NO: 11724
  Description of Artificial Sequence: Synthetic coding sequence

SEQ ID NO: 11733 - DNA, 1026 bp, Artificial Sequence; identical to SEQ ID NO: 11728
  Description of Artificial Sequence: Synthetic coding sequence

SEQ ID NO: 11734 - DNA, 1116 bp, Artificial Sequence; identical to SEQ ID NO: 11725
  Description of Artificial Sequence: Synthetic coding sequence

SEQ ID NO: 11735 - DNA, 1104 bp, Artificial Sequence
  Description of Artificial Sequence: Synthetic coding sequence
atggagaacggcggcagcatgcaggccaccatggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcaccctgagatgccccgtgatgctggtggtgggcgaccaggccccccacgaggacgccgtggtggagtgcaacagcaagctggaccccacccagaccagcttcctgaagatggccgacagcggcggccagccccagctgacccagcccggcaagctgaccgaggccttcaagtacttcctgcagggcatgggctacatggccagcagctgcatgaccagactgagcagaagcagaaccgccagcctgaccagcgccgccagcgtggacggcaacagaagcagaagcagaaccctgagccagagcagcgagagcggcaccctgagcagcggcccccccggccacaccatggaggtgagctgctag

SEQ ID NO: 11736 - DNA, 504 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactggtag

SEQ ID NO: 11737 - DNA, 1074 bp, Artificial Sequence; identical to SEQ ID NO: 11726
  Description of Artificial Sequence: Synthetic coding sequence

SEQ ID NO: 11738 - DNA, 522 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgacccctag

SEQ ID NO: 11739 - DNA, 759 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaacttcgagagaggcggcgacatcacctag

SEQ ID NO: 11740 - DNA, 525 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggctag

SEQ ID NO: 11741 - DNA, 1074 bp, Artificial Sequence; identical to SEQ ID NO: 11726
  Description of Artificial Sequence: Synthetic coding sequence

SEQ ID NO: 11742 - DNA, 450 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctag

SEQ ID NO: 11743 - DNA, 261 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgagtag

SEQ ID NO: 11744 - DNA, 390 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctag

SEQ ID NO: 11745 - DNA, 447 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggctag

SEQ ID NO: 11746 - DNA, 405 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggctag

SEQ ID NO: 11747 - DNA, 327 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggactag

SEQ ID NO: 11748 - DNA, 363 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtactag

SEQ ID NO: 11749 - DNA, 300 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcactag

SEQ ID NO: 11750 - DNA, 279 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggagtag

SEQ ID NO: 11751 - DNA, 462 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgtag

SEQ ID NO: 11752 - DNA, 1074 bp, Artificial Sequence; identical to SEQ ID NO: 11726
  Description of Artificial Sequence: Synthetic coding sequence

SEQ ID NO: 11753 - DNA, 585 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatcccctag

SEQ ID NO: 11754 - DNA, 387 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggctag

SEQ ID NO: 11755 - DNA, 660 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaactag

SEQ ID NO: 11756 - DNA, 666 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaactag

SEQ ID NO: 11757 - DNA, 1116 bp, Artificial Sequence; identical to SEQ ID NO: 11725
  Description of Artificial Sequence: Synthetic coding sequence

SEQ ID NO: 11758 - DNA, 432 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgtag

SEQ ID NO: 11759 - DNA, 483 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaactag

SEQ ID NO: 11760 - DNA, 426 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatctag

SEQ ID NO: 11761 - DNA, 357 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtactag

SEQ ID NO: 11762 - DNA, 423 bp, Artificial Sequence
  Description of Artificial Sequence: Synthetic coding sequence
atggccgagctgcaggaggtgcagatcaccgaggagaagcccctgctgcccggccagacccccgaggccgccaaggaggccgagctggccgccagaatcctgctggaccagggccagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatctag

SEQ ID NO: 11763 - DNA, 435 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaactag

SEQ ID NO: 11764 - DNA, 462 bp, Artificial Sequence; identical to SEQ ID NO: 11751
  Description of Artificial Sequence: Synthetic coding sequence

SEQ ID NO: 11765 - DNA, 675 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagggcctggtgctgatcaacatcgaccccaacgccaagggctggatggactgggccgcccacaagctgaccggcctgaccagcagcatccccgagatgatcctgggccacctgttcagccaggaggagctgagcggcaacagcgagctgatccagaagtacagaaacatcatcacccacgcccccaacctggacaacatcgagctgtactggaacagctacaactag

SEQ ID NO: 11766 - DNA, 453 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtggagtag

SEQ ID NO: 11767 - DNA, 384 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatctag

SEQ ID NO: 11768 - DNA, 450 bp, Artificial Sequence
  Description of Artificial Sequence: Synthetic coding sequence
atggccgagctgcaggaggtgcagatcaccgaggagaagcccctgctgcccggccagacccccgaggccgccaagacccacagcgtggagaccccctacggcagcgtgaccttcaccgtgtacggcacccccaagcccaagagacccgccatcctgacctaccacgacgtgggcctgaactacaagagctgcttccagcccctgttccagttcgaggacatgcaggagatcatccagaacttcgtgagagtgcacgtggacgcccccggcatggaggagggcgcccccgtgttccccctgggctaccagtaccccagcctggaccagctggccgacatgatcccctgcgtgctgcagtacctgaacttcagcaccatcatcggcgtgggcgtgggcgccggcgcctacatcctggccagatacgccctgaaccaccccgacaccgtgtag

SEQ ID NO: 11769 - DNA, 1128 bp, Artificial Sequence
  Description of Artificial Sequence: Synthetic coding sequence
atggacgagctgcaggacgtgcagctgaccgagatcaagcccctgctgaacgacaagaacggcaccagaaacttccaggacttcgactgccaggagcacgacatcgagaccacccacggcgtggtgcacgtgaccatcagaggcctgcccaagggcaacagacccgtgatcctgacctaccacgacatcggcctgaaccacaagagctgcttcaacgccttcttcaacttcgaggacatgcaggagatcacccagcacttcgccgtgtgccacgtggacgcccccggccagcaggagggcgcccccagcttccccaccggctaccagtaccccaccatggacgagctggccgagatgctgccccccgtgctgacccacctgagcctgaagagcatcatcggcatcggcgtgggcgccggcgcctacatcctgagcagattcgccctgaaccaccccgagctggtggagggcctggtgctgatcaacgtggacccctgcgccaagggctggatcgactgggccgccagcaagctgagcggcctgaccaccaacgtggtggacatcatcctggcccaccacttcggccaggaggagctgcaggccaacctggacctgatccagacctacagaatgcacatcgcccaggacatcaaccaggacaacctgcagctgttcctgaacagctacaacggcagaagagacctggagatcgagagacccatcctgggccagaacgacaacaagagcaagaccctgaagtgcagcaccctgctggtggtgggcgacaacagccccgccgtggaggccgtggtggagtgcaacagcagactgaaccccatcaacaccaccctgctgaagatggccgactgcggcggcctgccccaggtggtgcagcccggcaagctgaccgaggccttcaagtacttcctgcagggcatgggctacatccccagcgccagcatgaccagactggccagaagcagaacccacagcaccagcagcagcctgggcagcggcgagagccccttcagcagaagcgtgaccagcaaccagagcgacggcacccaggagagctgcgagagccccgacgtgctggacagacaccagaccatggaggtgagctgctag

SEQ ID NO: 11770 - DNA, 1092 bp, Artificial Sequence
  Description of Artificial Sequence: Synthetic coding sequence
atggacgagctgcaggacgtgcagctgaccgagatcaagcccctgctgaacgacaaggagcacgacatcgagaccacccacggcgtggtgcacgtgaccatcagaggcctgcccaagggcaacagacccgtgatcctgacctaccacgacatcggcctgaaccacaagagctgcttcaacgccttcttcaacttcgaggacatgcaggagatcacccagcacttcgccgtgtgccacgtggacgcccccggccagcaggagggcgcccccagcttccccaccggctaccagtaccccaccatggacgagctggccgagatgctgccccccgtgctgacccacctgagcctgaagagcatcatcggcatcggcgtgggcgccggcgcctacatcctgagcagattcgccctgaaccaccccgagctggtggagggcctggtgctgatcaacgtggacccctgcgccaagggctggatcgactgggccgccagcaagctgagcggcctgaccaccaacgtggtggacatcatcctggcccaccacttcggccaggaggagctgcaggccaacctggacctgatccagacctacagaatgcacatcgcccaggacatcaaccaggacaacctgcagctgttcctgaacagctacaacggcagaagagacctggagatcgagagacccatcctgggccagaacgacaacaagagcaagaccctgaagtgcagcaccctgctggtggtgggcgacaacagccccgccgtggaggccgtggtggagtgcaacagcagactgaaccccatcaacaccaccctgctgaagatggccgactgcggcggcctgccccaggtggtgcagcccggcaagctgaccgaggccttcaagtacttcctgcagggcatgggctacatccccagcgccagcatgaccagactggccagaagcagaacccacagcaccagcagcagcctgggcagcggcgagagccccttcagcagaagcgtgaccagcaaccagagcgacggcacccaggagagctgcgagagccccgacgtgctggacagacaccagaccatggaggtgagctgctag

SEQ ID NO: 11771 - DNA, 843 bp, Artificial Sequence
  Description of Artificial Sequence: Synthetic coding sequence
atggtgcaggagaccagcagaaccctgaccgtgagataccagtaccccaccatggacgagctggccgagatgctgccccccgtgctgacccacctgagcctgaagagcatcatcggcatcggcgtgggcgccggcgcctacatcctgagcagattcgccctgaaccaccccgagctggtggagggcctggtgctgatcaacgtggacccctgcgccaagggctggatcgactgggccgccagcaagctgagcggcctgaccaccaacgtggtggacatcatcctggcccaccacttcggccaggaggagctgcaggccaacctggacctgatccagacctacagaatgcacatcgcccaggacatcaaccaggacaacctgcagctgttcctgaacagctacaacggcagaagagacctggagatcgagagacccatcctgggccagaacgacaacaagagcaagaccctgaagtgcagcaccctgctggtggtgggcgacaacagccccgccgtggaggccgtggtggagtgcaacagcagactgaaccccatcaacaccaccctgctgaagatggccgactgcggcggcctgccccaggtggtgcagcccggcaagctgaccgaggccttcaagtacttcctgcagggcatgggctacatccccagcgccagcatgaccagactggccagaagcagaacccacagcaccagcagcagcctgggcagcggcgagagccccttcagcagaagcgtgaccagcaaccagagcgacggcacccaggagagctgcgagagccccgacgtgctggacagacaccagaccatggaggtgagctgctag

SEQ ID NO: 11772 - DNA, 816 bp, Artificial Sequence
  Description of Artificial Sequence: Synthetic coding sequence
atgatcagataccagtaccccaccatggacgagctggccgagatgctgccccccgtgctgacccacctgagcctgaagagcatcatcggcatcggcgtgggcgccggcgcctacatcctgagcagattcgccctgaaccaccccgagctggtggagggcctggtgctgatcaacgtggacccctgcgccaagggctggatcgactgggccgccagcaagctgagcggcctgaccaccaacgtggtggacatcatcctggcccaccacttcggccaggaggagctgcaggccaacctggacctgatccagacctacagaatgcacatcgcccaggacatcaaccaggacaacctgcagctgttcctgaacagctacaacggcagaagagacctggagatcgagagacccatcctgggccagaacgacaacaagagcaagaccctgaagtgcagcaccctgctggtggtgggcgacaacagccccgccgtggaggccgtggtggagtgcaacagcagactgaaccccatcaacaccaccctgctgaagatggccgactgcggcggcctgccccaggtggtgcagcccggcaagctgaccgaggccttcaagtacttcctgcagggcatgggctacatccccagcgccagcatgaccagactggccagaagcagaacccacagcaccagcagcagcctgggcagcggcgagagccccttcagcagaagcgtgaccagcaaccagagcgacggcacccaggagagctgcgagagccccgacgtgctggacagacaccagaccatggaggtgagctgctag

SEQ ID NO: 11773 - DNA, 420 bp, Artificial Sequence
  Description of Artificial Sequence: Synthetic coding sequence
atgcccgagggccccgagctgcacctggccagccagttcgtgaacgaggcctgcagagccctggtgttcggcggctgcgtggagaagagcagcgtgagcagaaaccccgaggtgcccttcgagagcagcgcctacagaatcagcgccagcgccagaggcaaggagctgagactgatcctgagccccctgcccggcgcccagccccagcaggagcccagagcccccagaggcgccgccaccccctgcccccccgccctgctgcacggccccgcctggccccccgccagacccatgttcagaggccacccccccgtgagacccctgggcccctggggcaaggtggccgccggccccagagccctgtgcctggccggcgtgcccgccgtgcagggcgagtgcgccaccaagcccagcggctag

SEQ ID NO: 11774 - DNA, 1173 bp, Artificial Sequence
  Description of Artificial Sequence: Synthetic coding sequence
atgcccgagggccccgagctgcacctggccagccagttcgtgaacgaggcctgcagagccctggtgttcggcggctgcgtggagaagagcagcgtgagcagaaaccccgaggtgcccttcgagagcagcgcctacagaatcagcgccagcgccagaggcaaggagctgagactgatcctgagccccctgcccggcgcccagccccagcaggagcccctggccctggtgttcagattcggcatgagcggcagcttccagctggtgcccagagaggagctgcccagacacgcccacctgagattctacaccgccccccccggccccagactggccctgtgcttcgtggacatcagaagattcggcagatgggacctgggcggcaagtggcagcccggcagaggcccctgcgtgctgcaggagtaccagcagttcagagagaacgtgctgagaaacctggccgacaaggccttcgacagacccatctgcgaggccctgctggaccagagattcttcaacggcatcggcaactacctgagagccgagatcctgtacagactgaagatcccccccttcgagaaggccagaagcgtgctggaggccctgcagcagcacagacccagccccgagctgaccctgagccagaagatcagaaccaagctgcagaaccccgacctgctggagctgtgccacagcgtgcccaaggaggtggtgcagctgggcggcaagggctacggcagcgagagcggcgaggaggacttcgccgccttcagagcctggctgagatgctacggcatgcccggcatgagcagcctgcaggacagacacggcagaaccatctggttccagggcgaccccggccccctggcccccaagggcagaaagagcagaaagaagaagagcaaggccacccagctgagccccgaggacagagtggaggacgccctgccccccagcaaggcccccagcagaaccagaagagccaagagagacctgcccaagagaaccgccacccagagacccgagggcaccagcctgcagcaggaccccgaggcccccaccgtgcccaagaagggcagaagaaagggcagacaggccgccagcggccactgcagacccagaaaggtgaaggccgacatccccagcctggagcccgagggcaccagcgccagctag

SEQ ID NO: 11775 - DNA, 1173 bp, Artificial Sequence; identical to SEQ ID NO: 11774
  Description of Artificial Sequence: Synthetic coding sequence

SEQ ID NO: 11776 - DNA, 999 bp, Artificial Sequence
  Description of Artificial Sequence: Synthetic coding sequence
atgcccgagggccccctggtgagaaagttccaccacctggtgagccccttcgtgggccagcaggtggtgaagaccggcggcagcagcaagaagctgcagcccgccagcctgcagagcctgtggctgcaggacacccaggtgcacggcaagaagctgttcctgagattcgacctggacgaggagatgggcccccccggcagcagccccacccccgagcccccccagaaggaggtgcagaaggagggcgccgccgaccccaagcaggtgggcgagcccagcggccagaagaccctggacggcagcagcagaagcgccgagctggtgccccagggcgaggacgacagcgagtacctggagagagacgcccccgccggcgacgccggcagatggctgagagtgagcttcggcctgttcggcagcgtgtgggtgaacgacttcagcagagccaagaaggccaacaagagaggcgactggagagaccccagccccagactggtgctgcacttcggcggcggcggcttcctggccttctacaactgccagctgagctggagcagcagccccgtggtgacccccacctgcgacatcctgagcgagaagttccacagaggccaggccctggaggccctgggccaggcccagcccgtgtgctacaccctgctggaccagagatacttcagcggcctgggcaacatcatcaagaacgaggccctgtacagagccggcatccaccccctgagcctgggcagcgtgctgagcgccagcagaagagaggtgctggtggaccacgtggtggagttcagcaccgcctggctgcagggcaagttccagggcagaccccagcacacccaggtgtaccagaaggagcagtgccccgccggccaccaggtgatgaaggaggccttcggccccgaggacggcctgcagagactgacctggtggtgcccccagtgccagccccagctgagcgaggagcccgagcagtgccagttcagctag

SEQ ID NO: 11777 - DNA, 954 bp, Artificial Sequence
  Description of Artificial Sequence: Synthetic coding sequence
atgcccgagggccccctggtgagaaagttccaccacctggtgagccccttcgtgggccagcaggtggtgaagaccggcggcagcagcaagaagctgcagcccgccagcctgcagagcctgtggctgcaggacacccaggtgcacggcaagaagctgttcctgagattcgacctggacgaggagatgggcccccccggcagcagccccacccccgagcccccccagaaggaggtgcagaagaagaccctggacggcagcagcagaagcgccgagctggtgccccagggcgaggacgacagcgagtacctggagagagacgcccccgccggcgacgccggcagatggctgagagtgagcttcggcctgttcggcagcgtgtgggtgaacgacttcagcagagccaagaaggccaacaagagaggcgactggagagaccccagccccagactggtgctgcacttcggcggcggcggcttcctggccttctacaactgccagctgagctggagcagcagccccgtggtgacccccacctgcgacatcctgagcgagaagttccacagaggccaggccctggaggccctgggccaggcccagcccgtgtgctacaccctgctggaccagagatacttcagcggcctgggcaacatcatcaagaacgaggccctgtacagagccggcatccaccccctgagcctgggcagcgtgctgagcgccagcagaagagaggtgctggtggaccacgtggtggagttcagcaccgcctggctgcagggcaagttccagggcagaccccagcacacccaggtgtaccagaaggagcagtgccccgccggccaccaggtgatgaaggaggccttcggccccgaggacggcctgcagagactgacctggtggtgcccccagtgccagccccagctgagcgaggagcccgagcagtgccagttcagctag

SEQ ID NO: 11778 - DNA, 816 bp, Artificial Sequence
  Description of Artificial Sequence: Synthetic coding sequence
atgggcccccccggcagcagccccacccccgagcccccccagaaggaggtgcagaaggagggcgccgccgaccccaagcaggtgggcgagcccagcggccagaagaccctggacggcagcagcagaagcgccgagctggtgccccagggcgaggacgacagcgagtacctggagagagacgcccccgccggcgacgccggcagatggctgagagtgagcttcggcctgttcggcagcgtgtgggtgaacgacttcagcagagccaagaaggccaacaagagaggcgactggagagaccccagccccagactggtgctgcacttcggcggcggcggcttcctggccttctacaactgccagctgagctggagcagcagccccgtggtgacccccacctgcgacatcctgagcgagaagttccacagaggccaggccctggaggccctgggccaggcccagcccgtgtgctacaccctgctggaccagagatacttcagcggcctgggcaacatcatcaagaacgaggccctgtacagagccggcatccaccccctgagcctgggcagcgtgctgagcgccagcagaagagaggtgctggtggaccacgtggtggagttcagcaccgcctggctgcagggcaagttccagggcagaccccagcacacccaggtgtaccagaaggagcagtgccccgccggccaccaggtgatgaaggaggccttcggccccgaggacggcctgcagagactgacctggtggtgcccccagtgccagccccagctgagcgaggagcccgagcagtgccagttcagctag

SEQ ID NO: 11779 - DNA, 999 bp, Artificial Sequence; identical to SEQ ID NO: 11776
  Description of Artificial Sequence: Synthetic coding sequence

SEQ ID NO: 11780 - DNA, 999 bp, Artificial Sequence; identical to SEQ ID NO: 11776
  Description of Artificial Sequence: Synthetic coding sequence

SEQ ID NO: 11781 - DNA, 651 bp, Artificial Sequence
  Description of Artificial Sequence: Synthetic coding sequence
atgcccgagggccccctggtgagaaagttccaccacctggtgagccccttcgtgggccagcaggtggtgaagaccggcggcagcagcaagaagctgcagcccgccagcctgcagagcctgtggctgcaggacacccaggtgagactggtgctgcacttcggcggcggcggcttcctggccttctacaactgccagctgagctggagcagcagccccgtggtgacccccacctgcgacatcctgagcgagaagttccacagaggccaggccctggaggccctgggccaggcccagcccgtgtgctacaccctgctggaccagagatacttcagcggcctgggcaacatcatcaagaacgaggccctgtacagagccggcatccaccccctgagcctgggcagcgtgctgagcgccagcagaagagaggtgctggtggaccacgtggtggagttcagcaccgcctggctgcagggcaagttccagggcagaccccagcacacccaggtgtaccagaaggagcagtgccccgccggccaccaggtgatgaaggaggccttcggccccgaggacggcctgcagagactgacctggtggtgcccccagtgccagccccagctgagcgaggagcccgagcagtgccagttcagctag

SEQ ID NO: 11782 - DNA, 1818 bp, Artificial Sequence
  Description of Artificial Sequence: Synthetic coding sequence
atggtggagggccccggctgcaccctgaacggcgagaagatcagagccagagtgctgcccggccaggccgtgaccggcgtgagaggcagcgccctgagaagcctgcagggcagagccctgagactggccgccagcaccgtggtggtgagcccccaggccgccgccctgaacaacgacagcagccagaacgtgctgagcctgttcaacggctacgtgtacagcggcgtggagaccctgggcaaggagctgttcatgtacttcggccccaaggccctgagaatccacttcggcatgaagggcttcatcatgatcaaccccctggagtacaagtacaagaacggcgccagccccgtgctggaggtgcagctgaccaaggacctgatctgcttcttcgacagcagcgtggagctgagaaacagcatggagagccagcagagaatcagaatgatgaaggagctggacgtgtgcagccccgagttcagcttcctgagagccgagagcgaggtgaagaagcagaagggcagaatgctgggcgacgtgctgatggaccagaacgtgctgcccggcgtgggcaacatcatcaagaacgaggccctgttcgacagcggcctgcaccccgccgtgaaggtgtgccagctgaccgacgagcagatccaccacctgatgaagatgatcagagacttcagcatcctgttctacagatgcagaaaggccggcctggccctgagcaagcactacaaggtgtacaagagacccaactgcggccagtgccactgcagaatcaccgtgtgcagattcggcgacaacaacagaatgacctacttctgcccccactgccagaaggagaacccccagcacgtggacatctgcaagctgcccaccagaaacaccatcatcagctggaccagcagcagagtggaccacgtgatggacagcgtggccagaaagagcgaggagcactggacctgcgtggtgtgcaccctgatcaacaagcccagcagcaaggcctgcgacgcctgcctgaccagcagacccatcgacagcgtgctgaagagcgaggagaacagcaccgtgttcagccacctgatgaagtacccctgcaacaccttcggcaagccccacaccgaggtgaagatcaacagaaagaccgccttcggcaccaccaccctggtgctgaccgacttcagcaacaagagcagcaccctggagagaaagaccaagcagaaccagatcctggacgaggagttccagaacagcccccccgccagcgtgtgcctgaacgacatccagcaccccagcaagaagaccaccaacgacatcacccagcccagcagcaaggtgaacatcagccccaccatcagcagcgagagcaagctgttcagccccgcccacaagaagcccaagaccgcccagtacagcagccccgagctgaagagctgcaaccccggctacagcaacagcgagctgcagatcaacatgaccgacggccccagaaccctgaaccccgacagccccagatgcagcaagcacaacagactgtgcatcctgagagtggtgggcaaggacggcgagaacaagggcagacagttctacgcctgccccctgcccagagaggcccagtgcggcttcttcgagtgggccgacctgagcttccccttctgcaaccacggcaagagaagcaccatgaagaccgtgctgaagatcggccccaacaacggcaagaacttcttcgtgtgccccctgggcaaggagaagcagtgcaacttcttccagtgggccgagaacggccccggcatcaagatcatccccggctgctag

SEQ ID NO: 11783 - DNA, 1743 bp, Artificial Sequence
  Description of Artificial Sequence: Synthetic coding sequence
atgcccggctggccctggggcctgctgctgaccgccggcaccctgttcgccgccctgagccccggcccccccgcccccgccgacccctgccacgacgagggcggcgcccccagaggctgcgtgcccggcctggtgaacgccgccctgggcagagaggtgctggccagcagcacctgcggcagacccgccaccagagcctgcgacgccagcgaccccagaagagcccacagccccgccctgctgaccagccccggcggcaccgccagccccctgtgctggagaagcgagagcctgcccagagcccccctgaacgtgaccctgaccgtgcccctgggcaaggccttcgagctggtgttcgtgagcctgagattctgcagcgccccccccgccagcgtggccctgctgaagagccaggaccacggcagaagctgggcccccctgggcttcttcagcagccactgcgacctggactacggcagactgcccgcccccgccaacggccccgccggccccggccccgaggccctgtgcttccccgcccccctggcccagcccgacggcagcggcctgctggccttcagcatgcaggacagcagcccccccggcctggacctggacagcagccccgtgctgcaggactgggtgaccgccaccgacgtgagagtggtgctgaccagacccagcaccgccggcgaccccagagacatggaggccgtggtgccctacagctacgccgccaccgacctgcaggtgggcggcagatgcaagtgcaacggccacgccagcagatgcctgctggacacccagggccacctgatctgcgactgcagacacggcaccgagggccccgactgcggcagatgcaagcccttctactgcgacagaccctggcagagagccaccgccagagagagccacgcctgcctggcctgcagctgcaacggccacgccagaagatgcagattcaacatggagctgtacagactgagcggcagaagaagcggcggcgtgtgcctgaactgcagacacaacaccgccggcagacactgccactactgcagagagggcttctacagagaccccggcagagccctgagcgacagaagagcctgcagagcctgcgactgccaccccgtgggcgccgccggcaagacctgcaaccagaccaccggccagtgcccctgcaaggacggcgtgaccggcctgacctgcaacagatgcgcccccggcttccagcagagcagaagccccgtggccccctgcgtgaagacccccatccccggccccaccgaggacagcagccccgtgcagccccaggactgcgacagccactgcaagcccgccagaggcagctacagaatcagcctgaagaagttctgcaagaaggactacgccgtgcaggtggccgtgggcgccagaggcgaggccagaggcgcctggaccagattccccgtggccgtgctggccgtgttcagaagcggcgaggagagagccagaagaggcagcagcgccctgtgggtgcccgccggcgacgccgcctgcggctgccccagactgctgcccggcagaagatacctgctgctgggcggcggccccggcgccgccgccggcggcgccggcggcagaggccccggcctgatcgccgccagaggcagcctggtgctgccctggagagacgcctggaccagaagactgagaagactgcagagaagagagagaagaggcagatgcagcgccgcctag

SEQ ID NO: 11784 - DNA, 2547 bp, Artificial Sequence
  Description of Artificial Sequence: Synthetic coding sequence
ctgttctgcttcgtgttcagcgtgagcctgcaggtggacatcgtgcccagccagggcgagatcagcgtgggcgagagcaagttcttcctgtgccaggtggccggcgacgccaaggacaaggacatcagctggttcagccccaacggcgagaagctgacccccaaccagcagagaatcagcgtggtgtggaacgacgacagcagcagcaccctgaccatctacaacgccaacatcgacgacgccggcatctacaagtgcgtggtgaccggcgaggacggcagcgagagcgaggccaccgtgaacgtgaagatcttccagaagctgatgttcaagaacgcccccaccccccaggagttcagagagggcgaggacgccgtgatcgtgtgcgacgtggtgagcagcctgccccccaccatcatctggaagcacaagggcagagacgtgatcctgaagaaggacgtgagattcatcgtgctgagcaacaactacctgcagatcagaggcatcaagaagaccgacgagggcacctacagatgcgagggcagaatcctggccagaggcgagatcaacttcaaggacatccaggtgatcgtgaacgtgccccccaccatccaggccagacagaacatcgtgaacgccaccgccaacctgggccagagcgtgaccctggtgtgcgacgccgagggcttccccgagcccaccatgagctggaccaaggacggcgagcagatcgagcaggaggaggacgacgagaagtacatcttcagcgacgacagcagccagctgaccatcaagaaggtggacaagaacgacgaggccgagtacatctgcatcgccgagaacaaggccggcgagcaggacgccaccatccacctgaaggtgttcgccaagcccaagatcacctacgtggagaaccagaccgccatggagctggaggagcaggtgaccctgacctgcgaggccagcggcgaccccatccccagcatcacctggagaaccagcaccagaaacatcagcagcgaggagaaggccagctggaccagacccgagaagcaggagaccctggacggccacatggtggtgagaagccacgccagagtgagcagcctgaccctgaagagcatccagtacaccgacgccggcgagtacatctgcaccgccagcaacaccatcggccaggacagccagagcatgtacctggaggtgcagtacgcccccaagctgcagggccccgtggccgtgtacacctgggagggcaaccaggtgaacatcacctgcgaggtgttcgcctaccccagcgccaccatcagctggttcagagacggccagctgctgcccagcagcaactacagcaacatcaagatctacaacacccccagcgccagctacctggaggtgacccccgacagcgagaacgacttcggcaactacaactgcaccgccgtgaacagaatcggccaggagagcctggagttcatcctggtgcaggccgacacccccagcagccccagcatcgaccaggtggagccctacagcagcaccgcccaggtgcagttcgacgagcccgaggccaccggcggcgtgcccatcctgaagtacaaggccgagtggagagccgtgggcgaggaggtgtggcacagcaagtggtacgacgccaaggaggccagcatggagggcatcgtgaccatcgtgggcctgaagcccgagaccacctacgccgtgagactggccgccctgaacggcaagggcctgggcgagatcagcgccgccagcgagttcaagacccagcccgtgcccggcgagcccagcgcccccaagctggagggccagatgggcgaggacggcaacagcatcaaggtgaacctgatcaagcaggacgacggcggcagccccatcagacactacctggtgagatacagagccctgagcagcgagtggaagcccgagatcagactgcccagcggcagcgaccacgtgatgctgaagagcctggactggaacgccgagtacgaggtgtacgtggtggccgagaaccagcagggcaagagcaaggccgcccacttcgtgttcagaaccagcgcccagcccaccgccatccccgccaacggcagccccaccagcggcctgagcaccggcgccatcgtgggcatcctgatcgtgatcttcgtgctgctgctggtggtggtggacatcacctgctacttcctgaacaagtgcggcctgttcatgtgcatcgccgtgaacctgtgcggcaaggccggccccggcgccaagggcaaggacatggaggagggcaaggccgccttcagcaaggacgagagcaaggagcccatcgtggaggtgagaaccgaggaggagagaacccccaaccacgacggcggcaagcacaccgagcccaacgagaccacccccctgaccgagcccgagaagggccccgtggaggccaagcccgagtgccaggagaccgagaccaagcccgcccccgccgaggtgaagaccgtgcccaacgacgccacccagaccaaggagaacgagagcaaggcctag

SEQ ID NO: 11785 - DNA, 1995 bp, Artificial Sequence
  Description of Artificial Sequence: Synthetic coding sequence
atcaccatcagagacgagatctgggtgctgttctgcttcgtgttcagcgtgagcctgcaggtggacatcgtgcccagccagggcgagatcagcgtgggcgagagcaagttcttcctgtgccaggtggccggcgacgccaaggacaaggacatcagctggttcagccccaacggcgagaagctgacccccaaccagcagagaatcagcgtggtgtggaacgacgacagcagcagcaccctgaccatctacaacgccaacatcgacgacgccggcatctacaagtgcgtggtgaccggcgaggacggcagcgagagcgaggccaccgtgaacgtgaagatcttccagaagctgatgttcaagaacgcccccaccccccaggagttcagagagggcgaggacgccgtgatcgtgtgcgacgtggtgagcagcctgccccccaccatcatctggaagcacaagggcagagacgtgatcctgaagaaggacgtgagattcatcgtgctgagcaacaactacctgcagatcagaggcatcaagaagaccgacgagggcacctacagatgcgagggcagaatcctggccagaggcgagatcaacttcaaggacatccaggtgatcgtgaacgtgccccccaccatccaggccagacagaacatcgtgaacgccaccgccaacctgggccagagcgtgaccctggtgtgcgacgccgagggcttccccgagcccaccatgagctggaccaaggacggcgagcagatcgagcaggaggaggacgacgagaagtacatcttcagcgacgacagcagccagctgaccatcaagaaggtggacaagaacgacgaggccgagtacatctgcatcgccgagaacaaggccggcgagcaggacgccaccatccacctgaaggtgttcgccaagcccaagatcacctacgtggagaaccagaccgccatggagctggaggagcaggtgaccctgacctgcgaggccagcggcgaccccatccccagcatcacctggagaaccagcaccagaaacatcagcagcgaggagaaggccagctggaccagacccgagaagcaggagaccctggacggccacatggtggtgagaagccacgccagagtgagcagcctgaccctgaagagcatccagtacaccgacgccggcgagtacatctgcaccgccagcaacaccatcggccaggacagccagagcatgtacctggaggtgcagtacgcccccaagctgcagggccccgtggccgtgtacacctgggagggcaaccaggtgaacatcacctgcgaggtgttcgcctaccccagcgccaccatcagctggttcagagacggccagctgctgcccagcagcaactacagcaacatcaagatctacaacacccccagcgccagctacctggaggtgacccccgacagcgagaacgacttcggcaactacaactgcaccgccgtgaacagaatcggccaggagagcctggagttcatcctggtgcaggccgacacccccagcagccccagcatcgaccaggtggagccctacagcagcaccgcccaggtgcagttcgacgagcccgaggccaccggcggcgtgcccatcctgaagtacaaggccgagtggagagccgtgggcgaggaggtgtggcacagcaagtggtacgacgccaaggaggccagcatggagggcatcgtgaccatcgtgggcctgaagcccgagaccacctacgccgtgagactggccgccctgaacggcaagggcctgggcgagatcagcgccgccagcgagttcaagacccagcccgtgcaggcccccccccccaccgccagcgccagcagcagcacccccgtgcccctgagcccccccgacaccacctggcccctgcccgccctggccaccaccgagcccgccaagaacatcgcccagaaccactgctgcaacatgttccaggccggcctgcacaacgccctgatgaagtag

SEQ ID NO: 11786 - DNA, 942 bp, Artificial Sequence
  Description of Artificial Sequence: Synthetic coding sequence
atggagggcatcgtgaccatcgtgggcctgaagcccgagaccacctacgccgtgagactggccgccctgaacggcaagggcctgggcgagatcagcgccgccagcgagttcaagacccagcccgtgcacagcccccccccccccgccagcgccagcagcagcacccccgtgcccctgagcccccccgacaccggcgagcccagcgcccccaagctggagggccagatgggcgaggacggcaacagcatcaaggtgaacctgatcaagcaggacgacggcggcagccccatcagacactacctggtgagatacagagccctgagcagcgagtggaagcccgagatcagactgcccagcggcagcgaccacgtgatgctgaagagcctggactggaacgccgagtacgaggtgtacgtggtggccgagaaccagcagggcaagagcaaggccgcccacttcgtgttcagaaccagcgcccagcccaccgccatccccgccaacggcagccccaccagcggcctgagcaccggcgccatcgtgggcatcctgatcgtgatcttcgtgctgctgctggtggtggtggacatcacctgctacttcctgaacaagtgcggcctgttcatgtgcatcgccgtgaacctgtgcggcaaggccggccccggcgccaagggcaaggacatggaggagggcaaggccgccttcagcaaggacgagagcaaggagcccatcgtggaggtgagaaccgaggaggagagaacccccaaccacgacggcggcaagcacaccgagcccaacgagaccacccccctgaccgagcccgagaagggccccgtggaggccaagcccgagtgccaggagaccgagaccaagcccgcccccgccgaggtgaagaccgtgcccaacgacgccacccagaccaaggagaacgagagcaaggcctag

SEQ ID NO: 11787 - DNA, 570 bp, Artificial Sequence
  Description of Artificial Sequence: Synthetic coding sequence
atgaccgagtacaagctggtggtggtgggcgccggcggcgtgggcaagagcgccctgaccatccagctgatccagaaccacttcgtggacgagtacgaccccaccatcgaggacagctacagaaagcaggtggtgatcgacggcgagacctgcctgctggacatcctggacaccgccggccaggaggagtacagcgccatgagagaccagtacatgagaaccggcgagggcttcctgtgcgtgttcgccatcaacaacagcaagagcttcgccgacatcaacctgtacagagagcagatcaagagagtgaaggacagcgacgacgtgcccatggtgctggtgggcaacaagtgcgacctgcccaccagaaccgtggacaccaagcaggcccacgagctggccaagagctacggcatccccttcatcgagaccagcgccaagaccagacagggcgtggaggacgccttctacaccctggtgagagagatcagacagtacagaatgaagaagctgaacagcagcgacgacggcacccagggctgcatgggcctgccctgcgtggtgatgtag

SEQ ID NO: 11788 - DNA, 651 bp, Artificial Sequence
  Description of Artificial Sequence: Synthetic coding sequence
atgcccggcaacctgatgagccagaccagcagagccgtgagcatctggaagttccccgccaagctgggcaagacccacggccacagagccctggaggccaccggcatgatgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgcactgcagctgccaggcctgcggcaaggagcccagccacgagggcctgagcgtgtacgtgcagggcgaggacggccccggcagccagcccggcacccacccccacccccacccccacccccaccccggcggccagacccccgagcccgaggacccccccggcgccccccacaccgaggaggagggcgccgaggactag

SEQ ID NO: 11789 - DNA, 546 bp, Artificial Sequence
  Description of Artificial Sequence: Synthetic coding sequence
atgatgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgcactgcagctgccaggcctgcggcaaggagcccagccacgagggcctgagcgtgtacgtgcagggcgaggacggccccggcagccagcccggcacccacccccacccccacccccacccccaccccggcggccagacccccgagcccgaggacccccccggcgccccccacaccgaggaggagggcgccgaggactag

SEQ ID NO: 11790 - DNA, 351 bp, Artificial Sequence
  Description of Artificial Sequence: Synthetic coding sequence
atgatgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgtag

SEQ ID NO: 11791 - DNA, 492 bp, Artificial Sequence
  Description of Artificial Sequence: Synthetic coding sequence
atgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgcactgcagctgccaggcctgcggcaaggagcccagccacgagggcctgagcgtgtacgtgcagggcgaggacggccccggcagccagcccggcacccacccccacccccacccccacccccaccccggcggccagacccccgagtag

SEQ ID NO: 11792 - DNA, 354 bp, Artificial Sequence
  Description of Artificial Sequence: Synthetic coding sequence
atgatgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgcactag

SEQ ID NO: 11793 - DNA, 330 bp, Artificial Sequence
  Description of Artificial Sequence: Synthetic coding sequence
atgatgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggactag

SEQ ID NO: 11794 - DNA, 387 bp, Artificial Sequence
  Description of Artificial Sequence: Synthetic coding sequence
atgatgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgcactgcagctgccaggcctgcggcaaggagcccagctag

SEQ ID NO: 11795 - DNA, 543 bp, Artificial Sequence
  Description of Artificial Sequence: Synthetic coding sequence
atgctgagagtgctggtgggcgccgtgctgcccgccatgctgctggccgcccccccccccatcaacaagctggccctgttccccgacaagagcgcctggtgcgaggccaagaacatcacccagatcgtgggccacagcggctgcgaggccaagagcatccagaacagagcctgcctgggccagtgcttcagctacagcgtgcccaacaccttcccccagagcaccgagagcctggtgcactgcgacagctgcatgcccgcccagagcatgtgggagatcgtgaccctggagtgccccggccacgaggaggtgcccagagtggacaagctggtggagaagatcctgcactgcagctgccaggcctgcggcaaggagcccagccacgagggcctgagcgtgtacgtgcagggcgaggacggccccggcagccagcccggcacccacccccacccccacccccacccccaccccggcggccagacccccgagcccgaggacccccccggcgccccccacaccgaggaggagggcgccgaggactag

SEQ ID NO: 11796 - DNA, 8457 bp, Artificial Sequence
  Description of Artificial Sequence: Synthetic coding sequence
atggccgcccacagacccgtggagtgggtgcaggccgtggtgagcagattcgacgagcagctgcccatcaagaccggccagcagaacacccacaccaaggtgagcaccgagcacaacaaggagtgcctgatcaacatcagcaagtacaagttcagcctggtgatcagcggcctgaccaccatcctgaagaacgtgaacaacatgagaatcttcggcgaggccgccgagaagaacctgtacctgagccagctgatcatcctggacaccctggagaagtgcctggccggccagcccaaggacaccatgagactggacgagaccatgctggtgaagcagctgctgcccgagatctgccacttcctgcacacctgcagagagggcaaccagcacgccgccgagctgagaaacagcgccagcggcgtgctgttcagcctgagctgcaacaacttcaacgccgtgttcagcagaatcagcaccagactgcaggagctgaccgtgtgcagcgaggacaacgtggacgtgcacgacatcgagctgctgcagtacatcaacgtggactgcgccaagctgaagagactgctgaaggagaccgccttcaagttcaaggccctgaagaaggtggcccagctggccgtgatcaacagcctggagaaggccttctggaactgggtggagaactaccccgacgagttcaccaagctgtaccagatcccccagaccgacatggccgagtgcgccgagaagctgttcgacctggtggacggcttcgccgagagcaccaagagaaaggccgccgtgtggcccctgcagatcatcctgctgatcctgtgccccgagatcatccaggacatcagcaaggacgtggtggacgagaacaacatgaacaagaagctgttcctggacagcctgagaaaggccctggccggccacggcggcagcagacagctgaccgagagcgccgccatcgcctgcgtgaagctgtgcaaggccagcacctacatcaactgggaggacaacagcgtgatcttcctgctggtgcagagcatggtggtggacctgaagaacctgctgttcaaccccagcaagcccttcagcagaggcagccagcccgccgacgtggacctgatgatcgactgcctggtgagctgcttcagaatcagcccccacaacaaccagcacttcaagatctgcctggcccagaacagccccagcaccttccactacgtgctggtgaacagcctgcacagaatcatcaccaacagcgccctggactggtggcccaagatcgacgccgtgtactgccacagcgtggagctgagaaacatgttcggcgagaccctgcacaaggccgtgcagggctgcggcgcccaccccgccatcagaatggcccccagcctgaccttcaaggagaaggtgaccagcctgaagttcaaggagaagcccaccgacctggagaccagaagctacaagtacctgctgctgagcatggtgaagctgatccacgccgaccccaagctgctgctgtgcaaccccagaaagcagggccccgagacccagggcagcaccgccgagctgatcaccggcctggtgcagctggtgccccagagccacatgcccgagatcgcccaggaggccatggaggccctgctggtgctgcaccagctggacagcatcgacctgtggaaccccgacgcccccgtggagaccttctgggagatcagcagccagatgctgttctacatctgcaagaagctgaccagccaccagatgctgagcagcaccgagatcctgaagtggctgagagagatcctgatctgcagaaacaagttcctgctgaagaacaagcaggccgacagaagcagctgccacttcctgctgttctacggcgtgggctgcgacatccccagcagcggcaacaccagccagatgagcatggaccacgaggagctgctgagaacccccggcgccagcctgagaaagggcaagggcaacagcagcatggacagcgccgccggctgcagcggcaccccccccatctgcagacaggcccagaccaagctggaggtggccctgtacatgttcctgtggaaccccgacaccgaggccgtgctggtggccatgagctgcttcagacacctgtgcgaggaggccgacatcagatgcggcgtggacgaggtgagcgtgcacaacctgctgcccaactacaacaccttcatggagttcgccagcgtgagcaacatgatgagcaccggcagagccgccctgcagaagagagtgatggccctgctgagaagaatcgagcaccccaccgccggcaacaccgaggcctgggaggacacccacgccaagtgggagcaggccaccaagctgatcctgaactaccccaaggccaagatggaggacggccaggccgccgagagcctgcacaagaccatcgtgaagagaagaatgagccacgtgagcggcggcggcagcatcgacctgagcgacaccgacagcctgcaggagtggatcaacatgaccggcttcctgtgcgccctgggcggcgtgtgcctgcagcagagaagcaacagcggcctggccacctacagcccccccatgggccccgtgagcgagagaaagggcagcatgatcagcgtgatgagcagcgagggcaacgccgacacccccgtgagcaagttcatggacagactgctgagcctgatggtgtgcaaccacgagaaggtgggcctgcagatcagaaccaacgtgaaggacctggtgggcctggagctgagccccgccctgtaccccatgctgttcaacaagctgaagaacaccatcagcaagttcttcgacagccagggccaggtgctgctgaccgacaccaacacccagttcgtggagcagaccatcgccatcatgaagaacctgctggacaaccacaccgagggcagcagcgagcacctgggccaggccagcatcgagaccatgatgctgaacctggtgagatacgtgagagtgctgggcaacatggtgcacgccatccagatcaagaccaagctgtgccagctggtggaggtgatgatggccagaagagacgacctgagcttctgccaggagatgaagttcagaaacaagatggtggagtacctgaccgactgggtgatgggcaccagcaaccaggccgccgacgacgacgtgaagtgcctgaccagagacctggaccaggccagcatggaggccgtggtgagcctgctggccggcctgcccctgcagcccgaggagggcgacggcgtggagctgatggaggccaagagccagctgttcctgaagtacttcaccctgttcatgaacctgctgaacgactgcagcgaggtggaggacgagagcgcccagaccggcggcagaaagagaggcatgagcagaagactggccagcctgagacactgcaccgtgctggccatgagcaacctgctgaacgccaacgtggacagcggcctgatgcacagcatcggcctgggctaccacaaggacctgcagaccagagccaccttcatggaggtgctgaccaagatcctgcagcagggcaccgagttcgacaccctggccgagaccgtgctggccgacagattcgagagactggtggagctggtgaccatgatgggcgaccagggcgagctgcccatcgccatggccctggccaacgtggtgccctgcagccagtgggacgagctggccagagtgctggtgaccctgttcgacagcagacacctgctgtaccagctgctgtggaacatgttcagcaaggaggtggagctggccgacagcatgcagaccctgttcagaggcaacagcctggccagcaagatcatgaccttctgcttcaaggtgtacggcgccacctacctgcagaagctgctggaccccctgctgagaatcgtgatcaccagcagcgactggcagcacgtgagcttcgaggtggaccccaccagactggagcccagcgagagcctggaggagaaccagagaaacctgctgcagatgaccgagaagttcttccacgccatcatcagcagcagcagcgagttccccccccagctgagaagcgtgtgccactgcctgtaccaggtggtgagccagagattcccccagaacagcatcggcgccgtgggcagcgccatgttcctgagattcatcaaccccgccatcgtgagcccctacgaggccggcatcctggacaagaagcccccccccagaatcgagagaggcctgaagctgatgagcaagatcctgcagagcatcgccaaccacgtgctgttcaccaaggaggagcacatgagacccttcaacgacttcgtgaagagcaacttcgacgccgccagaagattcttcctggacatcgccagcgactgccccaccagcgacgccgtgaaccacagcctgagcttcatcagcgacggcaacgtgctggccctgcacagactgctgtggaacaaccaggagaagatcggccagtacctgagcagcaacagagaccacaaggccgtgggcagaagacccttcgacaagatggccaccctgctggcctacctgggcccccccgagcacaagcccgtggccgacacccactggagcagcctgaacctgaccagcagcaagttcgaggagttcatgaccagacaccaggtgcacgagaaggaggagttcaaggccctgaagaccctgagcatcttctaccaggccggcaccagcaaggccggcaaccccatcttctactacgtggccagaagattcaagaccggccagatcaacggcgacctgctgatctaccacgtgctgctgaccctgaagccctactacgccaagccctacgagatcgtggtggacctgacccacaccggccccagcaacagattcaagaccgacttcctgagcaagtggttcgtggtgttccccggcttcgcctacgacaacgtgagcgccgtgtacatctacaactgcaacagctgggtgagagagtacaccaagtaccacgagagactgctgaccggcctgaagggcagcaagagactggtgttcatcgactgccccggcaagctggccgagcacatcgagcacgagcagcagaagctgcccgccgccaccctggccctggaggaggacctgaaggtgttccacaacgccctgaagctggcccacaaggacaccaaggtgagcatcaaggtgggcagcaccgccgtgcaggtgaccagcgccgagagaaccaaggtgctgggccagagcgtgttcctgaacgacatctactacgccagcgagatcgaggagatctgcctggtggacgagaaccagttcaccctgaccatcgccaaccagggcacccccctgaccttcatgcaccaggagtgcgaggccatcgtgcagagcatcatccacatcagaaccagatgggagctgagccagcccgacagcatcccccagcacaccaagatcagacccaaggacgtgcccggcaccctgctgaacatcgccctgctgaacctgggcagcagcgaccccagcctgagaagcgccgcctacaacctgctgtgcgccctgacctgcaccttcaacctgaagatcgagggccagctgctggagaccagcggcctgtgcatccccgccaacaacaccctgttcatcgtgagcatcagcaagaccctggccgccaacgagccccacctgaccctggagttcctggaggagtgcatcagcggcttcagcaagagcagcatcgagctgaagcacctgtgcctggagtacatgaccccctggctgagcaacctggtgagattctgcaagcacaacgacgacgccaagagacagagagtgaccgccatcctggacaagctgatcaccatgaccatcaacgagaagcagatgtaccccagcatccaggccaagatctggggcagcctgggccagatcaccgacctgctggacgtggtgctggacagcttcatcaagaccagcgccaccggcggcctgggcagcatcaaggccgaggtgatggccgacaccgccgtggccctggccagcggcaacgtgaagctggtgagcagcaaggtgatcggcagaatgtgcaagatcatcgacaagacctgcctgagccccacccccaccctggagcagcacctgatgtgggacgacatcgccatcctggccagatacatgctgatgctgagcttcaacaacagcctggacgtggccgcccacctgccctacctgttccacgtggtgaccttcctggtggccaccggccccctgagcctgagagccagcacccacggcctggtgatcaacatcatccacagcctgtgcacctgcagccagctgcacttcagcgaggagaccaagcaggtgctgagactgagcctgaccgagttcagcctgcccaagttctacctgctgttcggcatcagcaaggtgaagagcgccgccgtgatcgccttcagaagcagctacagagacagaagcttcagccccggcagctacgagagagagaccttcgccctgaccagcctggagaccgtgaccgaggccctgctggagatcatggaggcctgcatgagagacatccccacctgcaagtggctggaccagtggaccgagctggcccagagattcgccttccagtacaaccccagcctgcagcccagagccctggtggtgttcggctgcatcagcaagagagtgagccacggccagatcaagcagatcatcagaatcctgagcaaggccctggagagctgcctgaagggccccgacacctacaacagccaggtgctgatcgaggccaccgtgatcgccctgaccaagctgcagcccctgctgaacaaggacagccccctgcacaaggccctgttctgggtggccgtggccgtgctgcagctggacgaggtgaacctgtacagcgccggcaccgccctgctggagcagaacctgcacaccctggacagcctgagaatcttcaacgacaagagccccgaggaggtgttcatggccatcagaaaccccctggagtggcactgcaagcagatggaccacttcgtgggcctgaacttcaacagcaacttcaacttcgccctggtgggccacctgctgaagggctacagacaccccagccccgccatcgtggccagaaccgtgagaatcctgcacaccctgctgaccctggtgaacaagcacagaaactgcgacaagttcgaggtgaacacccagagcgtggcctacctggccgccctgctgaccgtgagcgaggaggtgagaagcagatgcagcctgaagcacagaaagagcctgctgctgaccgacatcagcatggagaacgtgcccatggacacctaccccatccaccacggcgaccccagctacagaaccctgaaggagacccagccctggagcagccccaagggcagcgagggctacctggccgccacctaccccaccgtgggccagaccagccccagagccagaaagagcatgagcctggacatgggccagcccagccaggccaacaccaagaagctgctgggcaccagaaagagcttcgaccacctgatcagcgacaccaaggcccccaagagacaggagatggagagcggcatcaccaccccccccaagatgagaagagtggccgagaccgactacgagatggagacccagagaatcagcagcagccagcagcacccccacctgagaaaggtgagcgtgagcgagagcaacgtgctgctggacgaggaggtgctgaccgaccccaagatccaggccctgctgctgaccgtgctggccaccctggtgaagtacaccaccgacgagttcgaccagagaatcctgtacgagtacctggccgaggccagcgtggtgttccccaaggtgttccccgtggtgcacaacctgctggacagcaagatcaacaccctgctgagcctgtgccaggaccccaacctgctgaaccccatccacggcatcgtgcagagcgtggtgtaccacgaggagagccccccccagtaccagaccagctacctgcagagcttcggcttcaacggcctgtggagattcgccggccccttcagcaagcagacccagatccccgactacgccgagctgatcgtgaagttcctggacgccctgatcgacacctacctgcccggcatcgacgaggagaccagcgaggagagcctgctgacccccaccagcccctacccccccgccctgcagagccagctgagcatcaccgccaacctgaacctgagcaacagcatgaccagcctggccaccagccagcacagccccggcatcgacaaggagaacgtggagctgagccccaccaccggccactgcaacagcggcagaaccagacacggcagcgccagccaggtgcagaagcagagaagcgccggcagcttcaagagaaacagcatcaagaagatcgtgtag

SEQ ID NO: 11797 - DNA, 8520 bp, Artificial Sequence
  Description of Artificial Sequence: Synthetic coding sequence
atggccgcccacagacccgtggagtgggtgcaggccgtggtgagcagattcgacgagcagctgcccatcaagaccggccagcagaacacccacaccaaggtgagcaccgagcacaacaaggagtgcctgatcaacatcagcaagtacaagttcagcctggtgatcagcggcctgaccaccatcctgaagaacgtgaacaacatgagaatcttcggcgaggccgccgagaagaacctgtacctgagccagctgatcatcctggacaccctggagaagtgcctggccggccagcccaaggacaccatgagactggacgagaccatgctggtgaagcagctgctgcccgagatctgccacttcctgcacacctgcagagagggcaaccagcacgccgccgagctgagaaacagcgccagcggcgtgctgttcagcctgagctgcaacaacttcaacgccgtgttcagcagaatcagcaccagactgcaggagctgaccgtgtgcagcgaggacaacgtggacgtgcacgacatcgagctgctgcagtacatcaacgtggactgcgccaagctgaagagactgctgaaggagaccgccttcaagttcaaggccctgaagaaggtggcccagctggccgtgatcaacagcctggagaaggccttctggaactgggtggagaactaccccgacgagttcaccaagctgtaccagatcccccagaccgacatggccgagtgcgccgagaagctgttcgacctggtggacggcttcgccgagagcaccaagagaaaggccgccgtgtggcccctgcagatcatcctgctgatcctgtgccccgagatcatccaggacatcagcaaggacgtggtggacgagaacaacatgaacaagaagctgttcctggacagcctgagaaaggccctggccggccacggcggcagcagacagctgaccgagagcgccgccatcgcctgcgtgaagctgtgcaaggccagcacctacatcaactgggaggacaacagcgtgatcttcctgctggtgcagagcatggtggtggacctgaagaacctgctgttcaaccccagcaagcccttcagcagaggcagccagcccgccgacgtggacctgatgatcgactgcctggtgagctgcttcagaatcagcccccacaacaaccagcacttcaagatctgcctggcccagaacagccccagcaccttccactacgtgctggtgaacagcctgcacagaatcatcaccaacagcgccctggactggtggcccaagatcgacgccgtgtactgccacagcgtggagctgagaaacatgttcggcgagaccctgcacaaggccgtgcagggctgcggcgcccaccccgccatcagaatggcccccagcctgaccttcaaggagaaggtgaccagcctgaagttcaaggagaagcccaccgacctggagaccagaagctacaagtacctgctgctgagcatggtgaagctgatccacgccgaccccaagctgctgctgtgcaaccccagaaagcagggccccgagacccagggcagcaccgccgagctgatcaccggcctggtgcagctggtgccccagagccacatgcccgagatcgcccaggaggccatggaggccctgctggtgctgcaccagctggacagcatcgacctgtggaaccccgacgcccccgtggagaccttctgggagatcagcagccagatgctgttctacatctgcaagaagctgaccagccaccagatgctgagcagcaccgagatcctgaagtggctgagagagatcctgatctgcagaaacaagttcctgctgaagaacaagcaggccgacagaagcagctgccacttcctgctgttctacggcgtgggctgcgacatccccagcagcggcaacaccagccagatgagcatggaccacgaggagctgctgagaacccccggcgccagcctgagaaagggcaagggcaacagcagcatggacagcgccgccggctgcagcggcaccccccccatctgcagacaggcccagaccaagctggaggtggccctgtacatgttcctgtggaaccccgacaccgaggccgtgctggtggccatgagctgcttcagacacctgtgcgaggaggccgacatcagatgcggcgtggacgaggtgagcgtgcacaacctgctgcccaactacaacaccttcatggagttcgccagcgtgagcaacatgatgagcaccggcagagccgccctgcagaagagagtgatggccctgctgagaagaatcgagcaccccaccgccggcaacaccgaggcctgggaggacacccacgccaagtgggagcaggccaccaagctgatcctgaactaccccaaggccaagatggaggacggccaggccgccgagagcctgcacaagaccatcgtgaagagaagaatgagccacgtgagcggcggcggcagcatcgacctgagcgacaccgacagcctgcaggagtggatcaacatgaccggcttcctgtgcgccctgggcggcgtgtgcctgcagcagagaagcaacagcggcctggccacctacagcccccccatgggccccgtgagcgagagaaagggcagcatgatcagcgtgatgagcagcgagggcaacgccgacacccccgtgagcaagttcatggacagactgctgagcctgatggtgtgcaaccacgagaaggtgggcctgcagatcagaaccaacgtgaaggacctggtgggcctggagctgagccccgccctgtaccccatgctgttcaacaagctgaagaacaccatcagcaagttcttcgacagccagggccaggtgctgctgaccgacaccaacacccagttcgtggagcagaccatcgccatcatgaagaacctgctggacaaccacaccgagggcagcagcgagcacctgggccaggccagcatcgagaccatgatgctgaacctggtgagatacgtgagagtgctgggcaacatggtgcacgccatccagatcaagaccaagctgtgccagctggtggaggtgatgatggccagaagagacgacctgagcttctgccaggagatgaagttcagaaacaagatggtggagtacctgaccgactgggtgatgggcaccagcaaccaggccgccgacgacgacgtgaagtgcctgaccagagacctggaccaggccagcatggaggccgtggtgagcctgctggccggcctgcccctgcagcccgaggagggcgacggcgtggagctgatggaggccaagagccagctgttcctgaagtacttcaccctgttcatgaacctgctgaacgactgcagcgaggtggaggacgagagcgcccagaccggcggcagaaagagaggcatgagcagaagactggccagcctgagacactgcaccgtgctggccatgagcaacctgctgaacgccaacgtggacagcggcctgatgcacagcatcggcctgggctaccacaaggacctgcagaccagagccaccttcatggaggtgctgaccaagatcctgcagcagggcaccgagttcgacaccctggccgagaccgtgctggccgacagattcgagagactggtggagctggtgaccatgatgggcgaccagggcgagctgcccatcgccatggccctggccaacgtggtgccctgcagccagtgggacgagctggccagagtgctggtgaccctgttcgacagcagacacctgctgtaccagctgctgtggaacatgttcagcaaggaggtggagctggccgacagcatgcagaccctgttcagaggcaacagcctggccagcaagatcatgaccttctgcttcaaggtgtacggcgccacctacctgcagaagctgctggaccccctgctgagaatcgtgatcaccagcagcgactggcagcacgtgagcttcgaggtggaccccaccagactggagcccagcgagagcctggaggagaaccagagaaacctgctgcagatgaccgagaagttcttccacgccatcatcagcagcagcagcgagttccccccccagctgagaagcgtgtgccactgcctgtaccaggccacctgccacagcctgctgaacaaggccaccgtgaaggagaagaaggagaacaagaagagcgtggtgagccagagattcccccagaacagcatcggcgccgtgggcagcgccatgttcctgagattcatcaaccccgccatcgtgagcccctacgaggccggcatcctggacaagaagcccccccccagaatcgagagaggcctgaagctgatgagcaagatcctgcagagcatcgccaaccacgtgctgttcaccaaggaggagcacatgagacccttcaacgacttcgtgaagagcaacttcgacgccgccagaagattcttcctggacatcgccagcgactgccccaccagcgacgccgtgaaccacagcctgagcttcatcagcgacggcaacgtgctggccctgcacagactgctgtggaacaaccaggagaagatcggccagtacctgagcagcaacagagaccacaaggccgtgggcagaagacccttcgacaagatggccaccctgctggcctacctgggcccccccgagcacaagcccgtggccgacacccactggagcagcctgaacctgaccagcagcaagttcgaggagttcatgaccagacaccaggtgcacgagaaggaggagttcaaggccctgaagaccctgagcatcttctaccaggccggcaccagcaaggccggcaaccccatcttctactacgtggccagaagattcaagaccggccagatcaacggcgacctgctgatctaccacgtgctgctgaccctgaagccctactacgccaagccctacgagatcgtggtggacctgacccacaccggccccagcaacagattcaagaccgacttcctgagcaagtggttcgtggtgttccccggcttcgcctacgacaacgtgagcgccgtgtacatctacaactgcaacagctgggtgagagagtacaccaagtaccacgagagactgctgaccggcctgaagggcagcaagagactggtgttcatcgactgccccggcaagctggccgagcacatcgagcacgagcagcagaagctgcccgccgccaccctggccctggaggaggacctgaaggtgttccacaacgccctgaagctggcccacaaggacaccaaggtgagcatcaaggtgggcagcaccgccgtgcaggtgaccagcgccgagagaaccaaggtgctgggccagagcgtgttcctgaacgacatctactacgccagcgagatcgaggagatctgcctggtggacgagaaccagttcaccctgaccatcgccaaccagggcacccccctgaccttcatgcaccaggagtgcgaggccatcgtgcagagcatcatccacatcagaaccagatgggagctgagccagcccgacagcatcccccagcacaccaagatcagacccaaggacgtgcccggcaccctgctgaacatcgccctgctgaacctgggcagcagcgaccccagcctgagaagcgccgcctacaacctgctgtgcgccctgacctgcaccttcaacctgaagatcgagggccagctgctggagaccagcggcctgtgcatccccgccaacaacaccctgttcatcgtgagcatcagcaagaccctggccgccaacgagccccacctgaccctggagttcctggaggagtgcatcagcggcttcagcaagagcagcatcgagctgaagcacctgtgcctggagtacatgaccccctggctgagcaacctggtgagattctgcaagcacaacgacgacgccaagagacagagagtgaccgccatcctggacaagctgatcaccatgaccatcaacgagaagcagatgtaccccagcatccaggccaagatctggggcagcctgggccagatcaccgacctgctggacgtggtgctggacagcttcatcaagaccagcgccaccggcggcctgggcagcatcaaggccgaggtgatggccgacaccgccgtggccctggccagcggcaacgtgaagctggtgagcagcaaggtgatcggcagaatgtgcaagatcatcgacaagacctgcctgagccccacccccaccctggagcagcacctgatgtgggacgacatcgccatcctggccagatacatgctgatgctgagcttcaacaacagcctggacgtggccgcccacctgccctacctgttccacgtggtgaccttcctggtggccaccggccccctgagcctgagagccagcacccacggcctggtgatcaacatcatccacagcctgtgcacctgcagccagctgcacttcagcgaggagaccaagcaggtgctgagactgagcctgaccgagttcagcctgcccaagttctacctgctgttcggcatcagcaaggtgaagagcgccgccgtgatcgccttcagaagcagctacagagacagaagcttcagccccggcagctacgagagagagaccttcgccctgaccagcctggagaccgtgaccgaggccctgctggagatcatggaggcctgcatgagagacatccccacctgcaagtggctggaccagtggaccgagctggcccagagattcgccttccagtacaaccccagcctgcagcccagagccctggtggtgttcggctgcatcagcaagagagtgagccacggccagatcaagcagatcatcagaatcctgagcaaggccctggagagctgcctgaagggccccgacacctacaacagccaggtgctgatcgaggccaccgtgatcgccctgaccaagctgcagcccctgctgaacaaggacagccccctgcacaaggccctgttctgggtggccgtggccgtgctgcagctggacgaggtgaacctgtacagcgccggcaccgccctgctggagcagaacctgcacaccctggacagcctgagaatcttcaacgacaagagccccgaggaggtgttcatggccatcagaaaccccctggagtggcactgcaagcagatggaccacttcgtgggcctgaacttcaacagcaacttcaacttcgccctggtgggccacctgctgaagggctacagacaccccagccccgccatcgtggccagaaccgtgagaatcctgcacaccctgctgaccctggtgaacaagcacagaaactgcgacaagttcgaggtgaacacccagagcgtggcctacctggccgccctgctgaccgtgagcgaggaggtgagaagcagatgcagcctgaagcacagaaagagcctgctgctgaccgacatcagcatggagaacgtgcccatggacacctaccccatccaccacggcgaccccagctacagaaccctgaaggagacccagccctggagcagccccaagggcagcgagggctacctggccgccacctaccccaccgtgggccagaccagccccagagccagaaagagcatgagcctggacatgggccagcccagccaggccaacaccaagaagctgctgggcaccagaaagagcttcgaccacctgatcagcgacaccaaggcccccaagagacaggagatggagagcggcatcaccaccccccccaagatgagaagagtggccgagaccgactacgagatggagacccagagaatcagcagcagccagcagcacccccacctgagaaaggtgagcgtgagcgagagcaacgtgctgctggacgaggaggtgctgaccgaccccaagatccaggccctgctgctgaccgtgctggccaccctggtgaagtacaccaccgacgagttcgaccagagaatcctgtacgagtacctggccgaggccagcgtggtgttccccaaggtgttccccgtggtgcacaacctgctggacagcaagatcaacaccctgctgagcctgtgccaggaccccaacctgctgaaccccatccacggcatcgtgcagagcgtggtgtaccacgaggagagccccccccagtaccagaccagctacctgcagagcttcggcttcaacggcctgtggagattcgccggccccttcagcaagcagacccagatccccgactacgccgagctgatcgtgaagttcctggacgccctgatcgacacctacctgcccggcatcgacgaggagaccagcgaggagagcctgctgacccccaccagcccctacccccccgccctgcagagccagctgagcatcaccgccaacctgaacctgagcaacagcatgaccagcctggccaccagccagcacagccccggcatcgacaaggagaacgtggagctgagccccaccaccggccactgcaacagcggcagaaccagacacggcagcgccagccaggtgcagaagcagagaagcgccggcagcttcaagagaaacagcatcaagaagatcgtgtag

SEQ ID NO: 11798 - DNA, 615 bp, Artificial Sequence
  Description of Artificial Sequence: Synthetic coding sequence
atgcacgagagatacagcaacgtgcaggtggccggccccgtggacagaaccagcagcaaggacagccccctgcacaaggccctgttctgggtggccgtggccgtgctgcagctggacgaggtgaacctgtacagcgccggcaccgccctgctggagcagaacctgcacaccctggacagcctgagaatcttcaacgacaagagccccgaggaggtgttcatggccatcagaaaccccctggagtggcactgcaagcagatggaccacttcgtgggcctgaacttcaacagcaacttcaacttcgccctggtgggccacctgctgaagggctacagacaccccagccccgccatcgtggccagaaccgtgagaatcctgcacaccctgctgaccctggtgaacaagcacagaaactgcgacaagttcgaggtgaacacccagagcgtggcctacctggccgccctgctgaccgtgagcgaggaggtgagaagcagatgcagcctgaagcacagaaagagcctgctgctgaccgacatcagcatggagaacgtgcccatggacacctaccccatccaccacggcgaccccagctacagaaacaaggagaagttctag

SEQ ID NO: 11799 - DNA, 1782 bp, Artificial Sequence
  Description of Artificial Sequence: Synthetic coding sequence
atggccgcccacagacccgtggagtgggtgcaggccgtggtgagcagattcgacgagcagctgcccatcaagaccggccagcagaacacccacaccaaggtgagcaccgagcacaacaaggagtgcctgatcaacatcagcaagtacaagttcagcctggtgatcagcggcctgaccaccatcctgaagaacgtgaacaacatgagaatcttcggcgaggccgccgagaagaacctgtacctgagccagctgatcatcctggacaccctggagaagtgcctggccggccagcccaaggacaccatgagactggacgagaccatgctggtgaagcagctgctgcccgagatctgccacttcctgcacacctgcagagagggcaaccagcacgccgccgagctgagaaacagcgccagcggcgtgctgttcagcctgagctgcaacaacttcaacgccgtgttcagcagaatcagcaccagactgcaggagctgaccgtgtgcagcgaggacaacgtggacgtgcacgacatcgagctgctgcagtacatcaacgtggactgcgccaagctgaagagactgctgaaggagaccgccttcaagttcaaggccctgaagaaggtggcccagctggccgtgatcaacagcctggagaaggccttctggaactgggtggagaactaccccgacgagttcaccaagctgtaccagatcccccagaccgacatggccgagtgcgccgagaagctgttcgacctggtggacggcttcgccgagagcaccaagagaaaggccgccgtgtggcccctgcagatcatcctgctgatcctgtgccccgagatcatccaggacatcagcaaggacgtggtggacgagaacaacatgaacaagaagctgttcctggacagcctgagaaaggccctggccggccacggcggcagcagacagctgaccgagagcgccgccatcgcctgcgtgaagctgtgcaaggccagcacctacatcaactgggaggacaacagcgtgatcttcctgctggtgcagagcatggtggtggacctgaagaacctgctgttcaaccccagcaagcccttcagcagaggcagccagcccgccgacgtggacctgatgatcgactgcctggtgagctgcttcagaatcagcccccacaacaaccagcacttcaagatctgcctggcccagaacagccccagcaccttccactacgtgctggtgaacagcctgcacagaatcatcaccaacagcgccctggactggtggcccaagatcgacgccgtgtactgccacagcgtggagctgagaaacatgttcggcgagaccctgcacaaggccgtgcagggctgcggcgcccaccccgccatcagaatggcccccagcctgaccttcaaggagaaggtgaccagcctgaagttcaaggagaagcccaccgacctggagaccagaagctacaagtacctgctgctgagcatggtgaagctgatccacgccgaccccaagctgctgctgtgcaaccccagaaagcagggccccgagacccagggcagcaccgccgagctgatcaccggcctggtgcagctggtgccccagagccacatgcccgagatcgcccaggaggccatggaggccctgctggtgctgcaccagctggacagcatcgacctgtggaaccccgacgcccccgtggagaccttctgggagatcagatacatgtacttctacttcctgaacagcaccttcaagttctacttcgtgttcctgagctag

SEQ ID NO: 11800 - DNA, 1917 bp, Artificial Sequence
  Description of Artificial Sequence: Synthetic coding sequence
atgcacgagagatacagcaacgtgcaggtggccggccccgtggacagaaccagcagcaagttctgcggcagcttcaactgcagattcgccttccagtacaaccccagcctgcagcccagagccctggtggtgttcggctgcatcagcaagagagtgagccacggccagatcaagcagatcatcagaatcctgagcaaggccctggagagctgcctgaagggccccgacacctacaacagccaggtgctgatcgaggccaccgtgatcgccctgaccaagctgcagcccctgctgaacaaggacagccccctgcacaaggccctgttctgggtggccgtggccgtgctgcagctggacgaggtgaacctgtacagcgccggcaccgccctgctggagcagaacctgcacaccctggacagcctgagaatcttcaacgacaagagccccgaggaggtgttcatggccatcagaaaccccctggagtggcactgcaagcagatggaccacttcgtgggcctgaacttcaacagcaacttcaacttcgccctggtgggccacctgctgaagggctacagacaccccagccccgccatcgtggccagaaccgtgagaatcctgcacaccctgctgaccctggtgaacaagcacagaaactgcgacaagttcgaggtgaacacccagagcgtggcctacctggccgccctgctgaccgtgagcgaggaggtgagaagcagatgcagcctgaagcacagaaagagcctgctgctgaccgacatcagcatggagaacgtgcccatggacacctaccccatccaccacggcgaccccagctacagaaccctgaaggagacccagccctggagcagccccaagggcagcgagggctacctggccgccacctaccccaccgtgggccagaccagccccagagccagaaagagcatgagcctggacatgggccagcccagccaggccaacaccaagaagctgctgggcaccagaaagagcttcgaccacctgatcagcgacaccaaggcccccaagagacaggagatggagagcggcatcaccaccccccccaagatgagaagagtggccgagaccgactacgagatggagacccagagaatcagcagcagccagcagcacccccacctgagaaaggtgagcgtgagcgagagcaacgtgctgctggacgaggaggtgctgaccgaccccaagatccaggccctgctgctgaccgtgctggccaccctggtgaagtacaccaccgacgagttcgaccagagaatcctgtacgagtacctggccgaggccagcgtggtgttccccaaggtgttccccgtggtgcacaacctgctggacagcaagatcaacaccctgctgagcctgtgccaggaccccaacctgctgaaccccatccacggcatcgtgcagagcgtggtgtaccacgaggagagccccccccagtaccagaccagctacctgcagagcttcggcttcaacggcctgtggagattcgccggccccttcagcaagcagacccagatccccgactacgccgagctgatcgtgaagttcctggacgccctgatcgacacctacctgcccggcatcgacgaggagaccagcgaggagagcctgctgacccccaccagcccctacccccccgccctgcagagccagctgagcatcaccgccaacctgaacctgagcaacagcatgaccagcctggccaccagccagcacagccccggcatcgacaaggagaacgtggagctgagccccaccaccggccactgcaacagcggcagaaccagacacggcagcgccagccaggtgcagaagcagagaagcgccggcagcttcaagctggccctgctgaacctgctgaccgcccaccagaacagcctgtag

SEQ ID NO: 11801 - DNA, 7509 bp, Artificial Sequence
  Description of Artificial Sequence: Synthetic coding sequence
aactgggaggacaacagcgtgatcttcctgctggtgcagagcatggtggtggacctgaagaacctgctgttcaaccccagcaagcccttcagcagaggcagccagcccgccgacgtggacctgatgatcgactgcctggtgagctgcttcagaatcagcccccacaacaaccagcacttcaagatctgcctggcccagaacagccccagcaccttccactacgtgctggtgaacagcctgcacagaatcatcaccaacagcgccctggactggtggcccaagatcgacgccgtgtactgccacagcgtggagctgagaaacatgttcggcgagaccctgcacaaggccgtgcagggctgcggcgcccaccccgccatcagaatggcccccagcctgaccttcaaggagaaggtgaccagcctgaagttcaaggagaagcccaccgacctggagaccagaagctacaagtacctgctgctgagcatggtgaagctgatccacgccgaccccaagctgctgctgtgcaaccccagaaagcagggccccgagacccagggcagcaccgccgagctgatcaccggcctggtgcagctggtgccccagagccacatgcccgagatcgcccaggaggccatggaggccctgctggtgctgcaccagctggacagcatcgacctgtggaaccccgacgcccccgtggagaccttctgggagatcagcagccagatgctgttctacatctgcaagaagctgaccagccaccagatgctgagcagcaccgagatcctgaagtggctgagagagatcctgatctgcagaaacaagttcctgctgaagaacaagcaggccgacagaagcagctgccacttcctgctgttctacggcgtgggctgcgacatccccagcagcggcaacaccagccagatgagcatggaccacgaggagctgctgagaacccccggcgccagcctgagaaagggcaagggcaacagcagcatggacagcgccgccggctgcagcggcaccccccccatctgcagacaggcccagaccaagctggaggtggccctgtacatgttcctgtggaaccccgacaccgaggccgtgctggtggccatgagctgcttcagacacctgtgcgaggaggccgacatcagatgcggcgtggacgaggtgagcgtgcacaacctgctgcccaactacaacaccttcatggagttcgccagcgtgagcaacatgatgagcaccggcagagccgccctgcagaagagagtgatggccctgctgagaagaatcgagcaccccaccgccggcaacaccgaggcctgggaggacacccacgccaagtgggagcaggccaccaagctgatcctgaactaccccaaggccaagatggaggacggccaggccgccgagagcctgcacaagaccatcgtgaagagaagaatgagccacgtgagcggcggcggcagcatcgacctgagcgacaccgacagcctgcaggagtggatcaacatgaccggcttcctgtgcgccctgggcggcgtgtgcctgcagcagagaagcaacagcggcctggccacctacagcccccccatgggccccgtgagcgagagaaagggcagcatgatcagcgtgatgagcagcgagggcaacgccgacacccccgtgagcaagttcatggacagactgctgagcctgatggtgtgcaaccacgagaaggtgggcctgcagatcagaaccaacgtgaaggacctggtgggcctggagctgagccccgccctgtaccccatgctgttcaacaagctgaagaacaccatcagcaagttcttcgacagccagggccaggtgctgctgaccgacaccaacacccagttcgtggagcagaccatcgccatcatgaagaacctgctggacaaccacaccgagggcagcagcgagcacctgggccaggccagcatcgagaccatgatgctgaacctggtgagatacgtgagagtgctgggcaacatggtgcacgccatccagatcaagaccaagctgtgccagctggtggaggtgatgatggccagaagagacgacctgagcttctgccaggagatgaagttcagaaacaagatggtggagtacctgaccgactgggtgatgggcaccagcaaccaggccgccgacgacgacgtgaagtgcctgaccagagacctggaccaggccagcatggaggccgtggtgagcctgctggccggcctgcccctgcagcccgaggagggcgacggcgtggagctgatggaggccaagagccagctgttcctgaagtacttcaccctgttcatgaacctgctgaacgactgcagcgaggtggaggacgagagcgcccagaccggcggcagaaagagaggcatgagcagaagactggccagcctgagacactgcaccgtgctggccatgagcaacctgctgaacgccaacgtggacagcggcctgatgcacagcatcggcctgggctaccacaaggacctgcagaccagagccaccttcatggaggtgctgaccaagatcctgcagcagggcaccgagttcgacaccctggccgagaccgtgctggccgacagattcgagagactggtggagctggtgaccatgatgggcgaccagggcgagctgcccatcgccatggccctggccaacgtggtgccctgcagccagtgggacgagctggccagagtgctggtgaccctgttcgacagcagacacctgctgtaccagctgctgtggaacatgttcagcaaggaggtggagctggccgacagcatgcagaccctgttcagaggcaacagcctggccagcaagatcatgaccttctgcttcaaggtgtacggcgccacctacctgcagaagctgctggaccccctgctgagaatcgtgatcaccagcagcgactggcagcacgtgagcttcgaggtggaccccaccagactggagcccagcgagagcctggaggagaaccagagaaacctgctgcagatgaccgagaagttcttccacgccatcatcagcagcagcagcgagttccccccccagctgagaagcgtgtgccactgcctgtaccaggtggtgagccagagattcccccagaacagcatcggcgccgtgggcagcgccatgttcctgagattcatcaaccccgccatcgtgagcccctacgaggccggcatcctggacaagaagcccccccccagaatcgagagaggcctgaagctgatgagcaagatcctgcagagcatcgccaaccacgtgctgttcaccaaggaggagcacatgagacccttcaacgacttcgtgaagagcaacttcgacgccgccagaagattcttcctggacatcgccagcgactgccccaccagcgacgccgtgaaccacagcctgagcttcatcagcgacggcaacgtgctggccctgcacagactgctgtggaacaaccaggagaagatcggccagtacctgagcagcaacagagaccacaaggccgtgggcagaagacccttcgacaagatggccaccctgctggcctacctgggcccccccgagcacaagcccgtggccgacacccactggagcagcctgaacctgaccagcagcaagttcgaggagttcatgaccagacaccaggtgcacgagaaggaggagttcaaggccctgaagaccctgagcatcttctaccaggccggcaccagcaaggccggcaaccccatcttctactacgtggccagaagattcaagaccggccagatcaacggcgacctgctgatctaccacgtgctgctgaccctgaagccctactacgccaagccctacgagatcgtggtggacctgacccacaccggccccagcaacagattcaagaccgacttcctgagcaagtggttcgtggtgttccccggcttcgcctacgacaacgtgagcgccgtgtacatctacaactgcaacagctgggtgagagagtacaccaagtaccacgagagactgctgaccggcctgaagggcagcaagagactggtgttcatcgactgccccggcaagctggccgagcacatcgagcacgagcagcagaagctgcccgccgccaccctggccctggaggaggacctgaaggtgttccacaacgccctgaagctggcccacaaggacaccaaggtgagcatcaaggtgggcagcaccgccgtgcaggtgaccagcgccgagagaaccaaggtgctgggccagagcgtgttcctgaacgacatctactacgccagcgagatcgaggagatctgcctggtggacgagaaccagttcaccctgaccatcgccaaccagggcacccccctgaccttcatgcaccaggagtgcgaggccatcgtgcagagcatcatccacatcagaaccagatgggagctgagccagcccgacagcatcccccagcacaccaagatcagacccaaggacgtgcccggcaccctgctgaacatcgccctgctgaacctgggcagcagcgaccccagcctgagaagcgccgcctacaacctgctgtgcgccctgacctgcaccttcaacctgaagatcgagggccagctgctggagaccagcggcctgtgcatccccgccaacaacaccctgttcatcgtgagcatcagcaagaccctggccgccaacgagccccacctgaccctggagttcctggaggagtgcatcagcggcttcagcaagagcagcatcgagctgaagcacctgtgcctggagtacatgaccccctggctgagcaacctggtgagattctgcaagcacaacgacgacgccaagagacagagagtgaccgccatcctggacaagctgatcaccatgaccatcaacgagaagcagatgtaccccagcatccaggccaagatctggggcagcctgggccagatcaccgacctgctggacgtggtgctggacagcttcatcaagaccagcgccaccggcggcctgggcagcatcaaggccgaggtgatggccgacaccgccgtggccctggccagcggcaacgtgaagctggtgagcagcaaggtgatcggcagaatgtgcaagatcatcgacaagacctgcctgagccccacccccaccctggagcagcacctgatgtgggacgacatcgccatcctggccagatacatgctgatgctgagcttcaacaacagcctggacgtggccgcccacctgccctacctgttccacgtggtgaccttcctggtggccaccggccccctgagcctgagagccagcacccacggcctggtgatcaacatcatccacagcctgtgcacctgcagccagctgcacttcagcgaggagaccaagcaggtgctgagactgagcctgaccgagttcagcctgcccaagttctacctgctgttcggcatcagcaaggtgaagagcgccgccgtgatcgccttcagaagcagctacagagacagaagcttcagccccggcagctacgagagagagaccttcgccctgaccagcctggagaccgtgaccgaggccctgctggagatcatggaggcctgcatgagagacatccccacctgcaagtggctggaccagtggaccgagctggcccagagattcgccttccagtacaaccccagcctgcagcccagagccctggtggtgttcggctgcatcagcaagagagtgagccacggccagatcaagcagatcatcagaatcctgagcaaggccctggagagctgcctgaagggccccgacacctacaacagccaggtgctgatcgaggccaccgtgatcgccctgaccaagctgcagcccctgctgaacaaggacagccccctgcacaaggccctgttctgggtggccgtggccgtgctgcagctggacgaggtgaacctgtacagcgccggcaccgccctgctggagcagaacctgcacaccctggacagcctgagaatcttcaacgacaagagccccgaggaggtgttcatggccatcagaaaccccctggagtggcactgcaagcagatggaccacttcgtgggcctgaacttcaacagcaacttcaacttcgccctggtgggccacctgctgaagggctacagacaccccagccccgccatcgtggccagaaccgtgagaatcctgcacaccctgctgaccctggtgaacaagcacagaaactgcgacaagttcgaggtgaacacccagagcgtggcctacctggccgccctgctgaccgtgagcgaggaggtgagaagcagatgcagcctgaagcacagaaagagcctgctgctgaccgacatcagcatggagaacgtgcccatggacacctaccccatccaccacggcgaccccagctacagaaccctgaaggagacccagccctggagcagccccaagggcagcgagggctacctggccgccacctaccccaccgtgggccagaccagccccagagccagaaagagcatgagcctggacatgggccagcccagccaggccaacaccaagaagctgctgggcaccagaaagagcttcgaccacctgatcagcgacaccaaggcccccaagagacaggagatggagagcggcatcaccaccccccccaagatgagaagagtggccgagaccgactacgagatggagacccagagaatcagcagcagccagcagcacccccacctgagaaaggtgagcgtgagcgagagcaacgtgctgctggacgaggaggtgctgaccgaccccaagatccaggccctgctgctgaccgtgctggccaccctggtgaagtacaccaccgacgagttcgaccagagaatcctgtacgagtacctggccgaggccagcgtggtgttccccaaggtgttccccgtggtgcacaacctgctggacagcaagatcaacaccctgctgagcctgtgccaggaccccaacctgctgaaccccatccacggcatcgtgcagagcgtggtgtaccacgaggagagccccccccagtaccagaccagctacctgcagagcttcggcttcaacggcctgtggagattcgccggccccttcagcaagcagacccagatccccgactacgccgagctgatcgtgaagttcctggacgccctgatcgacacctacctgcccggcatcgacgaggagaccagcgaggagagcctgctgacccccaccagcccctacccccccgccctgcagagccagctgagcatcaccgccaacctgaacctgagcaacagcatgaccagcctggccaccagccagcacagccccgccagcctgccctgcagcaagagcgccgtgttcatgcagctgttcccccaccagggcatcgacaaggagaacgtggagctgagccccaccaccggccactgcaacagcggcagaaccagacacggcagcgccagccaggtgcagaagcagagaagcgccggcagcttcaagagaaacagcatcaagaagatcgtgtag

SEQ ID NO: 11802 - DNA, 1524 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11803 - DNA, 1788 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagctgaccctgcagagcgccaagagcagagtggccttcttcgaggagctgtag

SEQ ID NO: 11804 - DNA, 663 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgaggtgaagaagcagatcctggacgagaagatctactgcccccccgaggccagcgtgctgctggccagctacgccgtgcaggccaagaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagggccagagaggcagaagcgccgaggccggccccgccggcagcaccagaggcggcgccaagagccaggccgaggcccccggcgactgccaccaggcccacgtgcccgcccacgagcccaacagcagcaccgtggccagctag

SEQ ID NO: 11805 - DNA, 1524 bp, Artificial Sequence; identical to SEQ ID NO: 11802
  Description of Artificial Sequence: Synthetic coding sequence

SEQ ID NO: 11806 - DNA, 1773 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11807 - DNA, 1650 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11808 - DNA, 1647 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11809 - DNA, 1773 bp, Artificial Sequence; identical to SEQ ID NO: 11806
  Description of Artificial Sequence: Synthetic coding sequence

SEQ ID NO: 11810 - DNA, 1806 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagggcatgttcctgttcttcttcatcctgttctgctggttcagcctgaagcccaaggccgaggacctgagcgccttcgagcccagcaacagcccctgcagagcccccagccccgagtggcccagcctgaagagcagcagcagatag

SEQ ID NO: 11811 - DNA, 1686 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11812 - DNA, 1773 bp, Artificial Sequence; identical to SEQ ID NO: 11806
  Description of Artificial Sequence: Synthetic coding sequence

SEQ ID NO: 11813 - DNA, 498 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagctgaccctgcagagcgccaagagcagagtggccttcttcgaggagctgtag

SEQ ID NO: 11814 - DNA, 663 bp, Artificial Sequence; identical to SEQ ID NO: 11804
  Description of Artificial Sequence: Synthetic coding sequence

SEQ ID NO: 11815 - DNA, 2772 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgagttccccacctacggcttcaactgcgagttcggctggggcagccacaagaccttctgccactgggagcacgacaaccacgtgcagctgaagtggagcgtgctgaccagcaagaccggccccatccaggaccacaccggcgacggcaacttcatctacagccaggccgacgagaaccagaagggcaaggtggccagactggtgagccccgtggtgtacagccagaacagcgcccactgcatgaccttctggtaccacatgagcggcagccacgtgggcaccctgagagtgaagctgagataccagaagcccgaggagtacgaccagctggtgtggatggccatcggccaccagggcgaccactggaaggagggcagagtgctgctgcacaagagcctgaagctgtaccaggtgatcttcgagggcgagatcggcaagggcaacctgggcggcatcgccgtggacgacatcagcatcaacaaccacatcagccaggaggactgcgccaagcccgccgacctggacaagaagaaccccgagatcaagatcgacgagaccggcagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11816 - DNA, 420 bp, Artificial Sequence
  Description of Artificial Sequence: Synthetic coding sequence
atggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcggcagcagattcttcaagcaccaccacaagcagcagagcatgagaccccagaacctgcaccacaacagcatcctgctgctgtag

SEQ ID NO: 11817 - DNA, 1926 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggagggcaccatcaacaccgaccaggagtgcccctgcgccagagccctggccaaggacgccaagaagaagaagagatgggccgacagcacccactgcagatgcgtgagaagcatccacggcgagatgtggagcagcggcaagggcgtgtgcagcctggacgccaacctgtag

SEQ ID NO: 11818 - DNA, 567 bp, Artificial Sequence
  Description of Artificial Sequence: Synthetic coding sequence
atgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggacgccaagtacagactgagagtgagcgtggtgagaagcaagagcagcagcagcagcaccagcctggagcccagacccctgagcagcctgaagctgagcttcttcagctacaagatcaagatcacctag

SEQ ID NO: 11819 - DNA, 1830 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggagggcggcaccaccgtgctggccaccgagaagcccaccgtgatcgacagcaccatccagagcggcatcaagtag

SEQ ID NO: 11820 - DNA, 1935 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcggcatcaagtag

SEQ ID NO: 11821 - DNA, 2115 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcgccgagaccatcttcatccccctgctgtaccacttcagcagctgcctgagctgggaccagctgacccccgtgtgcgtgctggtgaccccccacggcagagagctgcccagaaacagaagctgcctggccagaaccagagccagcagcttcccccacgtgatctggatcgacgagctgttcctgatcgccaccaccatctgcaacaacaacctgagccacttcgagagccagagactgggcctgagctag

SEQ ID NO: 11822 - DNA, 261 bp, Artificial Sequence
  Description of Artificial Sequence: Synthetic coding sequence
atggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgccagactggaggtgagcaccctgaacctgagcctgcacaaccccccccagcagaaggccctgatctag

SEQ ID NO: 11823 - DNA, 2772 bp, Artificial Sequence; identical to SEQ ID NO: 11815
  Description of Artificial Sequence: Synthetic coding sequence

SEQ ID NO: 11824 - DNA, 2208 bp, Artificial Sequence
  Description of Artificial Sequence: Synthetic coding sequence
atgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcggcaccaccgtgctggccaccgagaagcccaccgtgatcgacagcaccatccagagcgagttccccacctacggcttcaactgcgagttcggctggggcagccacaagaccttctgccactgggagcacgacaaccacgtgcagctgaagtggagcgtgctgaccagcaagaccggccccatccaggaccacaccggcgacggcaacttcatctacagccaggccgacgagaaccagaagggcaaggtggccagactggtgagccccgtggtgtacagccagaacagcgcccactgcatgaccttctggtaccacatgagcggcagccacgtgggcaccctgagagtgaagctgagataccagaagcccgaggagtacgaccagctggtgtggatggccatcggccaccagggcgaccactggaaggagggcagagtgctgctgcacaagagcctgaagctgtaccaggtgatcttcgagggcgagatcggcaagggcaacctgggcggcatcgccgtggacgacatcagcatcaacaaccacatcagccaggaggactgcgccaagcccgccgacctggacaagaagaaccccgagatcaagatcgacgagaccggcagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11825 - DNA, 2721 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgagttccccacctacggcttcaactgcgagttcggctggggcagccacaagaccttctgccactgggagcacgacaaccacgtgcagctgaagtggagcgtgctgaccagcaagaccggccccatccaggaccacaccggcgacggcaacttcatctacagccaggccgacgagaaccagaagggcaaggtggccagactggtgagccccgtggtgtacagccagaacagcgcccactgcatgaccttctggtaccacatgagcggcagccacgtgggcaccctgagagtgaagctgagataccagaagcccgaggagtacgaccagctggtgtggatggccatcggccaccagggcgaccactggaaggagggcagagtgctgctgcacaagagcctgaagctgtaccaggtgatcttcgagggcgagatcggcaagggcaacctgggcggcatcgccgtggacgacatcagcatcaacaaccacatcagccaggaggactgcgccagaagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11826 - DNA, 318 bp, Artificial Sequence
  Description of Artificial Sequence: Synthetic coding sequence
aaccacatcagccaggaggactgcgccagaagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11827 - DNA, 234 bp, Artificial Sequence
  Description of Artificial Sequence: Synthetic coding sequence
tgacccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgccagactggaggtgagcaccctgaacctgagcctgcacaaccccccccagcagaaggccctgatctag

SEQ ID NO: 11828 - DNA, 303 bp, Artificial Sequence
  Description of Artificial Sequence: Synthetic coding sequence
tgaacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcggcagcagattcttcaagcaccaccacaagcagcagagcatgagaccccagaacctgcaccacaacagcatcctgctgctgtag

SEQ ID NO: 11829 - DNA, 711 bp, Artificial Sequence
  Description of Artificial Sequence: Synthetic coding sequence
gtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaaggtgagagccggcgactgggaggaggtgatcccctacgtgctggacttcaaccagggccccctggccttcagcagatag

SEQ ID NO: 11830 - DNA, 513 bp, Artificial Sequence
  Description of Artificial Sequence: Synthetic coding sequence
tgacccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggacgccaagtacagactgagagtgagcgtggtgagaagcaagagcagcagcagcagcaccagcctggagcccagacccctgagcagcctgaagctgagcttcttcagctacaagatcaagatcacctag

SEQ ID NO: 11831 - DNA, 2721 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccggcgagaacttcaagggcggcaccctgctgcccggcaccgagcccaccgtggacaccgtgcccatgcagcccatccccgcctactggtactacgtgatggccgccggcggcgccgtgctggtgctggtgagcgtggccctggccctggtgctgcactaccacagattcagatacgccgccaagaagaccgaccacagcatcacctacaagaccagccactacaccaacggcgcccccctggccgtggagcccaccctgaccatcaagctggagcaggacagaggcagccactgctag

SEQ ID NO: 11832 - DNA, 300 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaacctgctgagcgcctggaagatcagcctgaccagcagaagcttcgcctag

SEQ ID NO: 11833 - DNA, 1668 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaaggtgggctgcagctggagacccctgtag

SEQ ID NO: 11834 - DNA, 2706 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccggcggcaccctgctgcccggcaccgagcccaccgtggacaccgtgcccatgcagcccatccccgcctactggtactacgtgatggccgccggcggcgccgtgctggtgctggtgagcgtggccctggccctggtgctgcactaccacagattcagatacgccgccaagaagaccgaccacagcatcacctacaagaccagccactacaccaacggcgcccccctggccgtggagcccaccctgaccatcaagctggagcaggacagaggcagccactgctag

SEQ ID NO: 11835 - DNA, 2781 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccgtggacatccccgagatccacgagagagagggctacgaggacgagatcgacgacgagtacgaggtggactggagcaacagcagcagcgccaccagcggcagcggcgcccccagcaccgacaaggagaagagctggctgtacaccctggaccccatcctgatcaccatcatcgccatgagcagcctgggcgtgctgctgggcgccacctgcgccggcctgctgctgtactgcacctgcagctacagcggcctgagcagcagaagctgcaccaccctggagaactacaacttcgagctgtacgacggcctgaagcacaaggtgaagatgaaccaccagaagtgctgcagcgaggcctag
